United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 27

SEQ ID NO: 347 - DNA, 860713 bp, Homo sapiens
tctcttgacagaagaaaaatgagccttagaaattgtttccaaatcctgaaagagtcatcattccatgtactcaggacagatttagagagtgctgaccctgccctttgaaagatgttatttgcctcttagtgcccaaataaggaaggataattaggaatcagaagcctacctagggctcccctctctcctctcaaaattgcacttggtgtcatattgccctagaatttatgcctggtgctggcaaatatttttaaatttattttttaatcttttccttttctgcaatcaaatttcttgaggggctgagaagaagaaataggcccagagagaagcaaggcagtctgggtgcaggctctagacagcccagggagaagaaagagggagcagctccctgtgtcctggagggagccctgtccccattgggcttcctgctctgatgtcccctagtggaggctcctcagggagtccagcctcccagaactgccctataaacctcacagtgagctaagcaagtatatccaggaaggagggtctgtggagatgtgagactaaggtgtgttatggcctaaacactgcccatctccatccttcttggggatgacaaagtgaacagtggaggagacaggatacatgggtgcatctggacctcaagcagtaggctgttctgtggtctgtccctaaatcttgtgctggagaccccatacgagagccactccctgaccctgggctggagccctctaccccctgctcacaagaccagcagctgtttccttataggcccccagggagccacagaacagcatcaaccaagaccatcctcttcatgtgtcagcttttcagggagggatcgaagtcatggcccaggaaagggcttggacagcccaggggaggaggctggttggtatgaaggatgccctcctcaccctgagctgctggagggagtacaagggacttggagagcccaggctcagttgatgatcctcaggatgtagagctatgtatgggtctccactgtggtctctcccccgccttctccttcactgcacaggtggctagggctcagtgtcagggctggtgatcaaaagaccaaggtttatgcatgtgtctctgtccactgacccacctctcaccctgtgtctgtcttaatgtccagcgtcctgagcccagcctgtgctgacccagccacctgcagtgcatgcatctgtggggcaggtgggtaccagctcctgcactagaagcagcagcaatgttgggcacgggcatgtgctctggtacaaacatgcctccgagagacccagagctccacatatataaaagcagtcattgacccttaggggcataggcccaatgctgaggctccaggttggagaacatggcctctctgagcatctctggactccaggcagaggaaaaggctgatttttattctcagcttgggacacaagcaccaaggctcaggcagtacttcaggccagtggggaagtgggagaaaaagctgctgcccatccagcaatggagcttctctgtgcagcccccacttcttgggcaagtcagctgattaacgttgcttttcatttgtttagtaaaaatttagattttaaaactcactccagtgaacgcagtgtggagaatgtgtttctgtcctctcaattctaccctcacacccaacccttggcagtaacaaattgtcgtattgtctcatattaagagaaatccctcaataccaagatcaggctgtcctggaaaccaaatccataatgggtcaaaacaggaccagggtcattgtgtctgactcaggatagtcgactcccaaaggtctgtttatccacctcattcactgagaagctactatgcaccagcctcagatccagggattcaaggtacatgatgaacaagagaggaaggggccctgtcctcatggagctgacactgagtggtggaacagataaggcaatcaagtaaaaatgtcaatgcgacaatatgatgtcatcacacagtgaggagagctcagttgggggtagaggagccatcagaaggttgggcaaggaagacacaggatctgactcaagtttatgaagaaaagtccagatgcctcaaagaagatgaacaaggagacagcaagcatgaaggccacggggccagttggggtcattggagagaaaggtcaggtctagcctgtgtttgtaagaggagggactgaagcctgggtgaggagagagggctcaggaatagccttggaaagtggagggagtggatgcgaaacccctgctgagggggcctccatgagcaatgaggctgggggaggccctgagctaatcaccatgatggaaactcagacaacagcctcccagcctctttcaaagttgtcacaggacgcttttctctccaaatggcaaggggggaatcccactatgagttttatttgagatgtctcttctccatgtcctgtcctgtccctaggctaaattcccatgcgcaaacaagatactgctcagtctcaggtatcacattcacacacaaatgctccagaatgagggaatgcactctgaccaacccaccaggaatttttgcctttgagaatactagatcagatcactcacaccatctcccctgacaccatcatgttgaccagtgggttgtctgatcggtttggacagcagaatgcagatgcctgtagttgcagctggggtcagtcacatgctcatctcatggctgggagactttgggtccagacaacaggaaaaaaaggaggtttgcctacgtgatcccacaatgtgcatcactctgtcatccactcccatccttagttcatgttgggttttgtcctgtagatgctgggacctggacaggatcacaagccaggcgatttctggctcacaaagttacagctcaagctccctgatgttgctgacattcttcccacagaccaattttagacagacacactattgccatgcaggcactgacctgagatacaggtagtctcaggagagggaggaagcagatacacatccccatgatggcctccttgtcccagagtgggtaagaaaggcaaggaggccaggaagccacaggagtggccactgcccaccacctgtgcacctgtccctccctcaggtgagaagcagcctgagggtccagcacctgcaccttttcccagtgcccacacacttccaagtggggcctccttctgctcacctcccaaagctactgctttccgggacatctgtgtcattgctgagagtctacttttcatggggcccttgtcccagtggtctgggatcagtgtcagcctgtttaattcagcactgtctctgtcctttcaggacaccaatctagctattaaagctctaattgaattctcctttttttgccctgaaactttagactctccttctcagtgtctctctagaatattttgtctctatccaataagatcaagttatgtcttcaggcctacagccacttctttccccaaattctgcaccttcttttaagttcttattccctcttatggcttattttccactaactagctaatgatgccaaaacatttatctattttacctccttcaggaataaaaaagaaaagcatttatcaatagcccattgtcacaaagaaaggaacagaggagagatatcttctagaaaaatacaggtgaacaaggaaaaagttttaattcctcataggaactactccatgatccaagaaaataaattccagagattcaagagttcactccttagaaacaacagtgtaaatacaaggtagtaaattttcttggttttctcaatgaataacctcaaaagggttagagtatgattataataaaaagattatacattactttcaaaaatgtaagatgaacatgtcaaaaattttaatcgactcatatttctgaaaagaccagtaaaatggtgaataattttaaagaacattttaaaacacacagagtttctattccacgagggcaggacctgtgaggataatttcctgtgttagagaaacactgtcctaaacaacaatagtagaactctctaagctctgaatttatcttctcctgtaagaaaaaatctacaaagtgacaggatccaatttatataaaatatctagcaaagattttggacattcccatctcacacctcctctccaggctctcctcaagtgaaatctactctccttctgcccgtgttctcacctttctgcacgcttccgcctgctgacacatggcttctcctgctttcctttccagtagccctaacagatcaggccctgccagtaagtaagctcctggcctgagggaaccacatcgcatgttactggatttctgaggcacttgccctgccagggtctctctttctgaatcacaatccctgtattcctgggaattctcttctcctggattctgttattcagctctgtgtttctccctccatatctactttgtgaatttctctacatcttcacctgaatcccaggaagcctaaggacatgctgatgcttcctcagttctcatgtcacaccctgttccctcctcctctatgatcccaccaggtcatcctgcatcagaaccctgagtgcggcagaggcttctctggcctccttacccccagtggcagaagggaggaagggaggtcccctgtggcctcccatccttgtgctcccattagggtcagcatgaagcaggaatgaggctgtctatatcatcatggcattcccaacactaaactctgtgcccaggagaaggtaggcactcaataactatttgacaattgaagaactgcctctcaccacactggccacattgtactggactcaggatggggctgaactggaagagtcagctgtgaacctgctcttgtctctgccctcagcctgagagctgaaggggaacctaacagggagagcacccatgggcagggaaggtacattagtagcctcatcctgtttgtgaggctctgctcagccttgggaatccctgtttattcaaggcagagaagaaggaaaacaattaaccaggcctggccaacaggcagcatctacaaggcgatgagttgagggccagatggtcagagttggttctggcatctctcaggcgcctctctccatgttgcccttttttgcgatccaggggtgaggtttcaccccactgagcccccacccatctagatgggctctgctgagagaaaaacccattttctagatgagcccactgaggctcaaggggcacatgtacttggtgatgcaccttcttcctttagagactggtcagcctagaacaccccctctcgagtggccttctggtccctcatctgcccagccccacccagatctccatgaacctgagctgtgtgagagaagagggaagagtaggaggaagggaggagtccaggccatggtgtggatgttgcaggaacccctgggtcttcaaactgaggctggacaccgcaatgttctttttatctccctcaaattttttggtaaaatgtcagtgcttgtctggtccattattcaaacctgattctttttaccaccatcataggcatacatttctgagtcttcatcccagagaacagctcctctctaaaggggaggtgtagggtggctgtgagttctgagtttgcccctggggaggaagcacctgctccaccatgtgcacaggcctgtaagcaagagtccaactttgttgaaataggaaccatttgagtttgcttcaggccttgctgacctcagaagtttcacattgtcccctggtgacctcttcacaatgatgttagtggtgatggaacaatgcaggacagaaggccttccttactttctttcaacaaaaaaatggtgtattatctagcctgacagtaccctagctggagacagtgaaaataatttacattttaaacaaataatgtttgttattttttcaatctcatgagtgtaagataaaagtaatcctatctcaataccaaaacaaacaaacacgaaaaaccagaatctgaggagactgaagtgtgttgattgagagacagtaagaataacttagtccagctcccctgcctggctgtgaaatccaatgatccagtgtcccactctacagacaaacctacaggtttttcacccaatgcagacagaagacatggtattgaattcatgagtccccgctgagagtcacaataggctggtgtggcacaatgcattatgggaggcacagaatgaagggacaacatgtattcagtggattctgctctcttatcagactgagtcactgcacagactgctcacagggtttctccactgcattctgcctcacataaataaacaccaagagccataggatattagtcaattatattttctccttcagtgtcatacttgagatctctatcatatttgaaattggactcagagagcttcaattattttgttgcaatatatattatctttacaaaaattacctagactactgtgtttctgaaaaataaatcttacaatttattttacttccatgatggtattaaacttgaatggttagcatatcagccagtagtgtgtctggggctggacaacagagagtgtttggggtccattcctgaagggtgtgtgtgtgctcagagctggcatcatccacctattctgactcctgccctctgctaagtcctcacagctgtgaacttccaaacccctgggacaacacagctccactcctgctcattcccctgatccccaaaggcacagggccctgatcctgacccaaacacagagtgggatcaaaaagctgagaggttgtcacttgcataggtggatttttttcctcaaagagtataaagagagggagaaagattgggagaagctctgcggtagctgtaggcacagaaggcaggaatcaggccaatctccaccatggactggtcccctctcctcctcatactcctcactcactgtacaggtgactagacacaggcccaggggaggagccctgggaagcccaagggactctgctttctcatcttgtctctagaacagtatcaccacttctgtgtctcttccacttccagggtcctgggccaagtctgtgctgactcaacctccatcagtggcaggggccccaagatagagggtcactatctcctgcactggaagtgccaccagcactgggggtggttttcatgttaatgagtactagcagctcccaggaatggctccatagctcctcatttgtgaaaacagccattggccttcagggttctgtcctggttcacaggcttcgctgagcatttctgggctccagtctggggataaggctgactatttttctttatcttggcacacaagcattaatgctcacacagaactgtaggccaccggggaaggaagacaaagatatgctgtctttccagtgacagagtttccctgtgcagcccccaacccattcaccaaataagtgcttaactgtgattttttttggtggacaaaatgtggagtatgagaagcactgaagcaaacatggtctaaataatgtttcccagtcctctctcaattctacccccatatccaacccttggcaataataaattgtcatactgtcatatattgaaataaatatctatattagtccattctcacattgctataaagaactacctgagacagggtaatttatgaagaaaggctcacagtctttaattgactcacagttctgcaggctgtacaggaagcatgaattggaggcctcaggaaacttacaatcatggaggaaggacgaggggagcaagtacatcttgatatggcagagcaggagagagagagaaggggaaatactacgcacttttaaacaaccagaactcacaagaactcactcatgatagtgaatcttaagaacagcaagaaagaaatctgcccccacgatccaatcacctcctaccagcccctcctcagcatgagatttgggtggggacacagagccaagccatatcaattcctcaataccagggtcaggcttccctgggaaccaagtccatcatggatcaggacaggaccaggaacacagcacccactgtgtctgaccaaagagcctcaactgccagatgtctgtccatccacaccattcaattagcacctactatgtgccagccttaggtctaggggctcaaaaacagggtggacaagacaggaagtgtccctgtcctcatggaccagacaccatctggtggaagagatgagacaattgagtaataatatcaatacaataagatgtcatcacttagtgaggagaggagaggagagctcagtaatggtggtagaggagccatcagagggttggacaaggaagacagaggatctgagctaagtttgtgaagaaaagtccagatgcctcagacaagatggacaaggaggtgggaagcatgatggctgtgggtccaactagggtcactgggggagactgtttatacccagcatatgtttgtggggaggagggactgaagcctgggtgaggggagagggctcaaggctggccttaggacatggacaggatggtattgagtcacgctgcagaaggagccttcatgggcaagggggctgggggaggccctgagctcattattccaatggaaatatcaaactgcctgttagcctttgtcaaaggtatcaaagagactttttcattcaagatggcaagagaggaatctccctcttagacttctttgagatattctttcttcatgaccgtttcttgcccctggatgaatgctcacatgggagcaaattacctcctcagtcccaggatttcaatttgcacacaatccccccagaatgatcgagacctgccatccctgacccactgatcaggaattctggccttcaggacaacttgaccagatcagtcacaccatgtcccctgacaccatcgtggtgactggggtgaactgtcagactggtttgggtaatacatgtcctgtccctggagttgcagaacctgttcagaaagataatggtgtggatggagggaggctaattccagccacatcagaaagcaagaaagacatggagaccacccttgagctggcacagcatccttgggtctcacatgtgtctctagcgactggaaaaggaactcagatttaactaattctattttctcatctgtcactctccctttcactactgactcctgaagccccaacaaaagcagcactatgggattatggtcatggaatagaggccttgctgctgaacttttcttttttattctaaaaagtacaacacagataatgcatattaactaaaaattataaaaatgtatttaaatgatgtgacaatgaatgtataaggggttaataggagaaaataataaacaatgttaaaaaatacaaaataccaatacactataagagttatactatgtcatggattgtataaatcagtattgtaaagatggcagtgtcctaggattaatccatcaaattaatataagtgtaattaaaatttcagtaatattttaggaaactgcttaacttattttaaaactcaaattgaaaattgagataaaaattacctaagattatttaccaaaaatttgtaatggaagtgataccagatattgagttatttgaccaagcaatattagctaaaatcatgcatgattgagatcttgacatttacataattctcttaaaaattagagtagataggactgatgattttttatgtgaccttggaaatatggctaactctgttcataaaattaagtagagtacctaattcatacttttattaaaaaatccaaacagatttaaaatataatttagaaaagaaaaagtttaaaaactttagtttggaaaaatagaaatattatttttatttcatatgagaaagtacttcttaaataaacccaaaagtcaattcataaaagaaaatttgaagtatttggttgcaattatttgaagctttttttttcccaaagaggaccacagttggtaaaaagagagaaggatatgcaagagtggaaagacattggcaaggacaaagtattgctgtttgcatccagaagacaactttgaaatgagcgaagacagaaaaaaaggaaacccagtaaaaatgttcaaaggacacaaacaagccattcacgggtctcaaaatgagagcagataaatgtgacatcaaaatatgttaaattccaccagagacaaagagaagggaataagatcttcaagtagaaattgtggaatgagccaagcatgtctgtgcatggggagctttccaggccttgcaaaaagcaaagagagtaagaaaagagcaagaagggagtgagaagcccttttgtagagaaaccaagaaaagaaagtttagagtgttagagcctgggccagaaagataaaagagagagaagaggtagataatgtgggatttgagtgacctttgattcctgtgggcatacttctgagtaagacatgaagccactgagggtggaaagctgttaaatgatattgcaaatttaaataaaaaaaaaagatgccagtgaggatgtggggaatcccaaactctcactcacagcaggttgtaaaaacaaattcagctattttgagcaaagtccctcagcacgaagataccttaagagggtgagcatctgtcttgcaccaagtccactctgtacagagacacaaggaaatgtttatgagaaggtccttactaggggaaaagtataaaaaacaagctagttgtcaaacacaaggggaatttataacctgcagttagctgatggaatgctaactagttggaagtaataaaataaaagtattattatgagtttcaaaggcaataaatatataaataaaattaaaaagccaagagctaaagaaataaattattttaaaatatgaacatgcactataattttttttaagtttataccatgagctatttgaaagttagactggaagcacattatatacacttatgtaagagcctctgaaaaagatggaaacacatacgaaggttaaaagataatttaaaacaatagagagttatttcagtagctgaagatatgagtgccaataaaatgaatgcgattcaaccctgtgagcattgctttcataaaaaaattaaaacagaaaatgaatattaatagatgacttaagtgaaatcacaatgtatgtggtgatacagctgaaagacaaacgttttgttagtaagaagggcatcgctaagcctgatgagtgctttgtttagaattcccagctaccctggattcctctccaacctcatgaacagcttcagaaaagaggatcaggacaaccgatgctcctctcattgaaatgcccggatgtggcagagaggcaggaaatattttgggtctgaggacagtgaggatcatcactgagatgatcctgcccaaatgaaaaccactcagggcctccaagggagttcagccatcagctcactggactaggtttgggatgcaacactgacctgccccgacccagagtcataatgagccaggccacctccacccactgggtcagctcatctcctctttatcttttctccttctgacctgtgagtacccagatcagggtggacaagtaagagacacatagcaaggtcttatgtgaatacagtgactctaccttacgacgtttttgggagatacaaaggtacttagaggagctcagtttccaaagcagtgctccaggaagctggaaatctgcactatgctctgggctcctctcctccatctccaccctcactattcaggtgagaaagaaccttatgtcgggggatccacacccagctctgctccataccccctcactctctggctcactgggttgtaaacctgctctcatggccctctctgtccccctgcagtgtctgtggcccaggcagggcagactcagcagctctctgtatccaagggcttgggatagacaaccacactcacctgcactggggacagcaacaatgttggcaaagatggagctgtctggccgcagcagcaccagggccatgcccccaaacacctgatcaacaggaaaaacagccaactctcagggatctcagagagattccctggctcccggttaggaacatggcatctctgaccatctctggcctccagaccaaggacaagcctgcctattactgctcagcctgggacagcagcctcagtgctcacacagcgcctcaggggaagtgagacgaaaactcaggagctcccctagcttcactcggtatgcgggggcgtcatagagcactgtttaaactaaaccaaaaatgacaagggctggtttccacgtgacaaagtgtgtgctattcaaaactattaaaaataatatcataagttaaaataactaaatctgcagtattaatgaatatttataggaaacattgttgtgaatatatttgtggctagatacttacatgaacatacacatgcattaatcagtagtaaaaatgaatgcaagggtaaactaaggaaatatttattttcccagattttccttctcttttatttggagatgctggactaaatgctcagaggttccggtggtctgcctttgagtgtgtgttcagcagggtcacctcaagcttatcccaccttcttatgacctgggcccatgcctgtcctctcattagaatcccctttccctctgtcacagagctctctttattccttctacagacccagacttgttcctcacacttagttgaggcttcctgggccccacgtccctgtttgcccccaacacccacacaagacaatgatcccatgtgtgtgctcttgttgtgccctttccttatcctctgacatacctcaggcagtatctggaaagaacaaatgaagtgggagcgttagcttgtagttgaaaatgatttttgatattttggggaaaatatctggtttaaagatagttttccatcgagataaaaatgcatgtgtgacagcaccacatttctaatggcggaccaaagccccccacatctttgccccccacatggctccagggacattgacttgttaatatacaacccaggagagagcactgtgtcctatgcaactgcaatgcagaggcaggtttctgcccgctcctccaatgaagtgagtagcaaccccaaccccatcttcacccatcatttagatgacccccatacaaccacaacatagaaacacattgatcaaagggcctttttctctttgcagagacccctatttgtttatttggcatgtgagattttagacttttaccaacaattaaaatatactttattagaaaagttacacttcttaagaaactctgattcttactgtgaagttaatacctaatgcatcctataagcatagtaagtggaaaattgttctgtaaggagaagattaatcaatgaaataaaatacaagtatttgagagcaatctaataggtaaaagattagaggacataattgtgaatgccaggtgcaatataaaggaaatgtgggccgggcatggtggctcaaccctgtaatcccagcactttgggaggccgaggtgggcggatcacctgaggtcaggagctcgacaccagcctggccaacatggagaaaccccatctctactaaatatacaaaaattagccaggtgtggtggtgcatgcttgtagtcccagctactcaggaggctaagggaggagaatcacttgaacccaggaggcggaggttgcagtgagccaagatcacactattgcactttggcctgggtgacagagtgaggctcagcctaaaataaaataaaataaaataaaacaaaggaaatgtgaatacctagagttgattaaattgtggcccctcaccttcaacactcgaaaagctcagagtgggtagaaaagcttgttgagttatcttctgatgtcattgacaagataaatcagggacaatagaaggaatatgtggaaagaggtgccagaggctagaggggaaagtgtgaagtagccagcagagaggagcctgctggctgactacttgtgttagtagtagcaggtggtgttgacgccatctcccaggggaaaaccctgggaaacaggaaagctaaaagcaggctcaccatcctcatccctaacagaaccactgaagtgagcacaccagagtgtggggttccctcccggctcttcagatgacattgttatttggcaccaagctgatgttagtatgttctttataaatatatattgcacaaagaattgcataaaaccttcaataatttaatgaggactttctcacttaaaaaggtttttatgtctcttctgtggcccccataggtagccggggatccctcactgcatttcagtctgacaactcatcacatggacagagtccaccgtgtgtgactgtgtgtctgtgataataggtggcaaagcttcactgtcatagccgcacctgcttcattgcctggtgcttgcctttctgaaataggaaaataaactcttaccaatgtgtcataattaggttctatttaaaatctcctaccaaagttaagagcagcctgcacaactggtccacaaaatgagaaacctccaatttatttggactcttttctctaccctacccagtgatccaactggtcaccagccatgtggattctctctccaaaacgcttttaaattcaactctcctgtttactttccattctcatgtcttatgtcaaatattcatgtcacttacctagttctgatcagttctctggctccatggacagctcccccaactctgccttcctgaccatctctgggctgcggattggagatgaggctgacttctcctgtcagtctcatgatgaaagctacaatctcacagtgctgcaggcccattgggcagtgacaggaaaactccccagagcaccctcaccctgagtctgccatcagcctctccccaccagcatgggttgctttttcctgtcccctgtttgaatgtttgaattcaaattttctgtttatgtgtctctctattttctttccaaaatacacaactttttctttcttgtcttcatggatggtttttctggtccctgtgaaattactttatgaagaatatttagtttaaaacatagtttctgaacattgtcattttaacattgtgcactgggtcattcattgtgtgaggggggctgttctgttcatggttggacatttataagattattgggactcacacatcagatgcctatagcaccctaattcccaaattctaacaaacaagcaaaaaatgtagacattgcaaaatatcctagggagacagcactgcagaatcacccttgtctgagaaccactggattaaaaggacatggtttcacgtattgggcagccttttgtgttgaaccctccttatcccattccactgaatataaggctacatgcattatatctcgatggttccaaatttcctcttaaacaaatgtgtgggatacaactccaaaggttatgttgacagatgaataatcctctgaacaccattagttcagaaaacctgctacccaatgtacagcatctcttgctgaccagagtgtggagtgaaacatttgaccaaactgtgtgcataattgctaattcaaatttttaggtaaaacacctaaaacataacacattcttctctacttatcctcttaggggttgcttttcaagcatggtgtacaaaattatgacaaggcctcgtatgtgtggagtttacattttagaatgggtagacgacagtagacaagagcagcctcagaactgagcagtcagtgaagtcctttttttagccctagcgctggatgcaaattttaccagctgccatttgtgtttttgggcttgctccacccagtacagtccccatgaactgcatgttgatatgtatatttcaaagttaattaattaaaactaaataaactttaaaaaatattcctcagccacaccagcttcatttcacctgcctcctggactcatgctctccatccatggctctcatgctggagagttcagacacagggcatctccaccatggcataaagttctactgcagagcacagtctgtgacaatctatttaacacttccttaggccagtttcttcattacctgtaatggggatatagtaacactcaagttctcttcacagtctggaacactattctctgtgggagtattacctcggccccttcttcctacagaacggaggagtgataatgtaactagtattggccaataagatgaacagaaatgagaggtgtaatttctgagcagtagatgtaagattagcctgtgctttgtcaagttctatcatctctgacgtaacacccacagtgttctcacagaattctctcaaccatcctgcatcctgggatgaaggtgaagtgaactgaagccccaagcatttcaatcagagatgggaatggtggaggagtgagaaatatacattcgttgtgagtcaccaagatttctgtcaatttctcactgcatccaagcctagccagtactgagtgctatggaaattataagtgaatgtggggagccacaatgacaaaattaacatctatctataaatatatataatatatattaattacattatatcatatactaatattaatatataataaatatataatatataacacttacatattatataagtatataatatataacacttacatattatataagtatataatatacaataattaatctatattacatataatatattaatataaatatatatacataatttgatttgatgcaatactgtgaacatttagtagactacggagattgcatgatgtttcattttattcactggcaaatatttaattaagctgtcaccataataaacattaaaacacacagaattgacaaaataattctcctgagctgtggatatacaagttagacaactgattagaagcataggttcactcctgtgccatttgtggaatttttacaacttatttactttaagtgatgattttaagcataattggtttttgttcttgctttttatttattcaagcagaagaaagacacaagaatgataacccacatacatacagagtagtagaatggcaagagctaattattctcaaacacaaattcttaaagataaatgtaaaatatttgaattaaacattttgctatccaaaaaaaggtatgccgtttttttcctgagtactccagggcaggaaagtatattcatcaatccccctggtgtccgctttcttaacacattgttcatattggtatatatttttttcttattacttaacttactcatcctatatattgtgtttcctaaatatatttcaaattcattctcagccttgtgatttccctcgccctcattatgtcccatgtcctgctggggctcccccataccacccctctcctcatctgtaatgccccctcccagttcctgccctcctgggaactgctgtgctcttttctgccctgagccttgttacctccttcttgtactacctatttgtctcagtgagctcctcttccattcttcaaaggctccagagccctagagaagagcatcatctcaaaaaatttcccaagaagctgcaagtaatgagagtgtctaagaccactctttctgctttatggcaattttatatttaacgtggtattgagtcttgctgaattttcagtctgaagtcataatgtgctcaaatatacaaattccagagacacagagcagaatggtggctgccaggagctgaggggaggaggaaatggggagttgctggtcaacaggtgtaaagttttagttatgcaagaatatgttataaagatgtgctgtgcaacacttatctaaatattaattattaatcaaacaaaaaattcaaaattattaacacacatttccccctgggtttactggacagatgattttatatttgtctctgctaagtagactaaggtgtaaggatttggcacgaaagttgtaaaccacaaacccagccaaaaacaaaatattctttatacagtttttcaataaataaaattaatttaatattgctagtttaataaaatagctgtgtcttctaagttatagataaattttgcatatttttcactttaaggatcttacttaggtaaacaactgcatataccaactactaatattactaagaaaaaatgatttagagaaataaaaataattttcttgtgtctcagttttcacatataatctaaataaatttttaagtaactaaattagatgaatataaatgaagtaaacacttctatctaaactttttgtataatttaaaatcttaaaaaataaattaaataataggtactcttaaaaaagtgtaggtcatttaaaattaaaaatatatattttggatatagttataaaaatattaaaatagttctcatgtataaaagatgaatttatgagagacaattcaaagtttcttacatcctaggttttgagtaaaaattattgttaaaataattaaaaattctaattaatatataattcaatatataaaataagacaaaaataaaaatactaaatatatgtttttaagttaaaaaagcaaagtcataaaatatatgctttattaaaataattttgccaagttaagatgttatataatggttacttataaagcaatataaaataaattagagagatataaaatattataaatatagatatctttttgtaaaaaacattagaacataattttatattgaacaatcttatataatttttgtcctaaaataagatgatttactattttaagaagacaaatcaaaatgtcccaacaagtcttagtctatgtaaattataataaaatacatttgggaattatgtcccaacatatcttactctatgtaaattatagtaaaatacatttgggaattatttaataaaattaagtataattaacaggactataattttaaaaattatgtcttcctaaatattaaactttaatattgaaaatacacaaatacaaaactgaatattttgattttctatgtccaaacacagttttcttaatattaatttactctaaataaaagatttaaacattgatttttaattttaacatctatttctctttaaaacttctcaaaattacacttcaaaagttcaaattttgttaatattttcacacataatttacagacttttattgtcatacctttcaaaaaaatgtaatttttttacttcactgggacaataactcttttctttaacctttttttaaattattatactttaagttttagggtacatgtgcacaacgtgcaggtttgttacataggtatacatgtgctatgttggtttgctgcacccatcaattcctcatttatattaggtatttctcctaatgctatctctcccccagccccccacccccaaacaagccctggtgtgtgatgttccctgccctgtgtccatgtgttctccttgttcaactcccacttatgagtgagaacatgcggtgtttggttttctgtccttgtgacagtttgcttagaatgatggcttccagcttcatccatgtcactacaaaggacatgaactcatccttttttatggctgcatagtattccatggtgcatatatgccacattttcttaatccagtctatcagtgatggacatttgggttggttccaagtctttgctattgtgaatagtgccataataaacacacatgtgcatgtgtctttatagtagcatgattcataatcctttgggtacatacccagtaatgggatggctgagtcaaatggtatttctagttctagatccttgaggaatcaccacactgtcttccacaatggttgaactagtttacagtcccaccaacagtgtaaaagcgttcctatttctccacatcctctccagcatctgttgtttcctaactttttaatgatcaacattctaactggtgtgaaatggtatctcattgtggttttgatttgtatttatctgatgaccagtgatgatgagcattttttcatgtctgttggctgcataaatgtcttattttgagaagtgtttgttcatatcttttacccacttttcaatggggttgtttgctttttcttgtaaatttgtttaagttctttgtagattctggatattagccctttgtcaggtgggtagattgcaaagattttctcccattctgtaggttgcctgttcactctgataatagcttcttttgctgtgcagaagctctttagtttaattagatcccacttgtcaattttggcttttgttgccattgcttttggtattttagtcatgaagtctttgcccatgccaatgtcctgaatggtattgcctaggttttcttctagggttttttatggtgttaggtctttttttttttttttttctttgagacagagtctcgctctgtagcccaggctggagtacagtggtgtgatctcggctcactgcaagctccgcctcccgggttcctgcattctcttgcctcagcctcccaagtagctgggactacaggcacctgccactgcgcctggctaatttttttttgtattttttaatagagacgtggtttcaccgtgttacccaggatggtctcgatctcctgaccttgtgatctgcccgcctcggcctcccaaagtgctgggattacaggcgtgagccaccgtgcccggccatggtgttaggtcttcattcaagtctttaatccatcttgagttaatttttgtatactgtgtaaggaagacatccagtttcagctttctacatatggctagccagttttcccagcaccatttattaaagggggaatcctttcctcattgctttttttagtcaggtttgtcaaaaatcagatgattgtagatgcgtggtgttatttctgaggcctctgttctgttccattcgtctatatatatgttttggtaccagtaccatgctgttttggttactgtagacttgtagtatagtttgaagtcaggtagcatgatgcctccagctttgttctttttgcttaggattgtcttggctatgcaggctctttttaggttccatatgaactttaaagtagttttttccaattctgtgaagaaagtcagtggtagcttgatggggatagcattgaatctataaattaccttgggcagtatggccattttcatgatattggttattcttatctatgagcatggaatgttcttccatttgtttgtgtccccttttatttcatcgagcagtggtttgtagttctccttgaagaggtccttcacattccttgtaagttggattcctaggtattttattctctttgtattaattgtgagtgggagttcactcatgatttggctctctgttagtctactattggtgtataggaatgcttgtgatttttgcacattgattttgtatcctgtgaccttactgaagttgctaattagcttatggagattttgggctgagatgatggggttttccaaatatacaatcttgtcatctgcaaacggagacaatttgacttcgtcttttcccagttgaataccctttatttctttctcttgcctgattgctctagccagaacttccaacactgtgttgaataggagagggcatccttgtcttgtgctggttttcaaacagaatgcttccagtttttgcccattcagtatgatattggctgtgggtttgtcataaatagctcttattattttgagatatattccatcaatacctagtttattgagagtttttagcatgaagggctgttgaattttgtcgaaggccttttctgcatctattgaggtaatcatgtggtttttgtcgctggttctgtttatgtgatggattacatttattgatttgcatatgttgaaccagccttgcatcctagggatgaagctgacttgatcgtggtggataacctttttgatgtgctgttggatttggtttgccagtattttattgaggattttcgcatcaatgttcatcagggatattggcctaaaattctctttttttgttgtgtctctaccaggctttggtatcaagatgatgctagcctcctaaaatgagttagggaggattccctctttttctattgattgaaatagttttagaaggaatggtaccagctcctctttgtacctctggtagaattcggctgtgagtctgtctggtcctggactttttttggttggtaggctatcaattattgcctcaatttcagaacctgttattggtctattaagagattcagcctcttcctggtttagtcttgggagggtgtatgtgtccaggaatttatccatttcttctagattttctagttttcttgtgtagaggtgcttatagtattctgatggcagtttgtatttctgtgggatgggtggtgatatctcctttatcattttttgttgtgtctatttgattcttctctcttttcttctttattagtgttgctagcggtttatcaattttgttgatcttttcaaaaaaccagctcctggattcattgattttttgaagggttttttgtgtctctatctccttcagttctgctctgatcttagttatgtcttgccttctactagcttttgaatgtgtttgctcttgcttctctaattcttttaattgtgatgttagggtgtcgatttgagatctttcctgctttctcttgttggcatttagtgctataaatttccctctacacactgctttaaacgtgtcccagagattctagtacgttgtgtctttgttctcattggtttcaaataacgtctttatttctgccttcatttcgttatgtacccagtagtcattcaggagcaggtttttcagtttccatgtagttgagtggttttgagtgagtttcttaatcctgagttctagtttgattgcactgtggtccgagagacagttttttgtgatttcttttcttttacatttgctgaggagtgttttactaccaattatgtggtcaattttagaataagtgcgatgtggtgctgagaagaatgcatattctgttgatttggggtgtagagttctgtaggtgtctattaggtctgcatggtccagagctgagctcaagtcctggatatccttgttaaccttctgtctcattgatctgtctaatattgacagtaggatgttaaagccttccattattattgtgtgggagtctaagtctctttgtaggtctctaaggacttgctttatgaatctgggtgctcctgtattgggtgcatatatatttaggatagttagctcttcttgttgaattgatccctttactattatgtagtggctttctttgtctcttttgatctttgttggtttaaagtctgttttatcaaagactaggattgcaacccctgctttttttttgctttccatttgcttggtagatcttcctccatccctttattttgagcctatgtgtgtctttgcacatgagatgggtctcctggatacagcacactgatgggtctgactctttatccaatttgccagtctgtgtcttttaattggggcatttggcccatttacatttaaggttaatattgttgggtttgaatttcatcctgtcattatgatgttagctggttattttgcccgttaatgatgcagtttcttcatagcttcaatggtctttaccatttggcatgtttttgcagtggctggaacctgttgttcctttccatgtttagtacttccttcaggagctcttgtaaggcaggcctagtggtaacaaaatctctcagcatttgcttgcctgtaaaatattttatttctccttcacttattaagcttagtttggctggatatgagattctggtttgaaaattcttttctttaagaatattgaatattggcccccactctcttctggcttgtatggtttctgctgagagatccactgttagtctgatgggcttccatttgtaggtaacctgacctttctctctgggtgcttttaacattttttccttgatttcaaccttggtgaatctgacaattatgtgtcttgggattgctcttcttggggagtatctttgtggtgctctctgtatttcctgaatatgaatgttggcctgccttgctaggttgagtaagttctcctggataatatcctgaagagggttttttttttttgtttttttttttttggttttttttgagacagagtctcccactgtcacccaggttggagtgcagtggtgcgatcttggctcactgcaaactctgcctcctgggttcccaccattctcctgcctcagcctcccgagtagctgggactacaggcacccaccaccattcccggctaatttttcatattttttggtaaagacagggtttcatcatgttagccaggagggtcttgatctcctgacctcatggtctgcccacctcggccttccaaagatctgggattaggaggcatgagccaccgcacctggccctgaagagtgttttctaacttggttccattctccccgtcactctctggtacaacaatcaaacatatatttggtcttttcccgtagtcccatattttttggaggctttgttcatttcttttcactcttttttctctaatcttgtcttctttgtttatttcattaatttgatcttcaatcactgatatcgtttcttccacttgattgaatcggctattgaagcttgtgcatgcgtcacgaagttctcatgccatggttttcagctccatcaggtcatttaaggtcttctctacactgtttgttctagttagccattcgtctaacctttttcaaggtttttagcttccttgcgatgggttagaacatgctcctttagctcagagaagttcgttattaccgaccttctgaagcctacttctgtcaactcgtcaaactcattctctgtccagttttgttcccttgctggcgaggagctgtggtcctttggaggagaagaggcactctgttttttggaattttcagcttgtctgctctggtttctccccatctttatggttttatctacctttggtctttgatgttggtgacctacagatggggttttggtgtagatgtcctttctgttgatgttgatgccattcctttccgtttgttagttttccttctaacagtcagacccctcggctgcaggtctgttggagtttgctggaggtccactccagaccctgattgcctgggtatcaccagcataggctgcagatcagtaaatattgctacctgatacttcctctggaagcttcgtcccagaggggcaccgcctgtttgagacgtctgtcggcccctactgggaggtgtttcccagtcaggttacatgggtgtcagagacccgcttgaggaggcagtctgtccattctcagagctcgaacaccatgttgagagaaccactgctctcttcagagctgtcagacagggacgtttaagtctgcagaagctgtctgctgccttttgttctactatgccctcccccagaggtggaatctacagaggcagtaggccttgctgagctgtggtgggctctgcccagttcatgcttccctgcctctttgtttacactgtgagctactcaagcctcagcaatggcaggtgcccctccccccatcaagctgcagtgtcacaggttgatctcagactgctgcactagtagtgagcaaggctctgtgggcctgggacctgctgagccaggcaacgggagggtatctcctggtctgctggttgctaagactgtgggaaaagcgcagtatttggtcaggagtgtaccatttctcccagtacagtctgtcaggcttcccttggctaggaaaggggaatcccccgaccccttgtgcttcccgggtgaggtgacaccccaccatgcttcagctctttgggttgcacccactgtccaactagtcccaatgagatgaaccaggtacctcagttggaaatgcagaaatcacctgtcttctgcgtcgatctcactgggagctgcagaccagagctgttcctgtttggccatcttggaagagaccttccctgtgtattccgagccttctgcattctgccatcactgcagcctcctcatgttggatggacctgatatttttgcttttctagtaattcagaaatcctcagtggaaaggctgtttattaatatgagttatctccagacagggcaaaggtgtggtctatggatgctgtggattagcaatgaccaggctctcaggtgactccactcatgtgattttcacagaaagactgctgtctggccagtgagcagcacagggcactgtgagtcacactcagtgtctgcacagtgaaaacccaaaacttgccacccccccaaactccccagggctgggtagatggagtctgcactcactgacacagatttagcagctagatatggtcccagcacccccaccttcttccaagtcctgcgtgccagacaccccgacaacagctcccagatactgataaatccatggggagagttgggggtaggcagtgggagcaacacacttgcatccataacccctcctttgtgaggccactgaaggggataagagaggcctggagaagccactccagttctggacctcaggagggctgtgtccactgtgacctgggcacctattctcctgtgatattctatcatttctcaggtagggacaggtctcacgtcctggggaagccccctagcctgagttcttgccctgtgtttcactctcaccctttgtcctgattcctcacccacgatcatctttgcttgcaggttccctctctcagcctttgcttattcagctgccctccctctctgcacatctgagaaatgctataagacttccctgtaccccaagtagtggctgcattgttggaggctgtcacatattcttgtaccagcagaagtcacggagccttccccagtatctcctgagatactactcagactcaagtaagcaccaggactctggggtccccagtcacttctgtgaatccaaagatccctcgggcaatgtgcagggattctgcacatttctgagcagcctgagatcaagtccgactattactattttacatatcacagcaacagtggcactttcactgtgctccagacttacggggaagtgagattagaacctcccctgcattctctctgccttgtgcaggcaacaatacactgtctgggaccgagtgtggctcatcagtagcagctttgttgtttgtatttttcattcttcagtacagggtgggacctttctactggcctccattaatagtgagagtcaaacaagacagtctgtgggtgactccaaagtctaactcagggtttccttatgttagttagcttggactactcttggctcctccccagagatctcaacttctctggaattctccaggtgccacaagcactgatttcagtcttggccttgcacctcccctgagcagcttctgactctcctctcattacatctccatttatggcctgtcacccactcaatgtgttaaaaggtaaagcattttgcaaagtacttatcctgaactttagccccaaatccacccagcttccctagcccaggccagctctgcttcttatgaggctgatgagaggtacaagggctgcgacccttgctgagtccattcctgaaaatgcccccaataaagcctgattagcgccaatgccacaggacattgttctgtttcctttgcaggtggtgcccagtgaggaaagttcttcctcctgaatatgaatattttggagcatgaaacagctgagctgatctggggaggggaggcaaccccttgtgatggtggtcagattgcttggttgggattgtcacagaccatgtgataatgggattatattgcatatcacagatgcgctggaccctcaagtgtgctggggaactctggttaaagaatagaagtgatccctttgttcatattcactatgctggatgcccttttgagatccctgcaggacgctaaccctctgactgcggcagccttgccctttgatctgaagcttttatcatacattgtcctgctcaggggatttgggtggggcgttactcctatatatcatcacaagaaagggattctctggagactaaatgcaaactggaatatcccctggaggctgtccccctgattgggaaatatgaagagactaggggtgctcagtgtttaaaataaaacttcagagagtagagtctgagtgtaaacccttcaattccatttaatctctacaaatgtatataatgtcaaaacatagttatgtcatatatttacacatgtgcacacaaatctattaatacatgttcataagttcacatatatgctttatgttatacatatatgcatttatacatcaactgatgttattataatcatagttttacagactcaattttcctttgggtttttccacatttccccactttctttaacacttatttcttgaaaattttggtggctgcttactgagattttactaaaaaagagcttcagaatttcatttagagtagatcttgtggcaaattctattttttttgtctgaaaaaatggtattttttctcttttttatttttaaaacttatcttgaagcataatatgtaaagtgaaatttgcagatcttaattgtaaatttcagtgtgctttttatgaacacatatactcatgtgccccatgcgtactcacaacatttccattactgcagaattaaaacattttgttctagtcaatgaaattattccattacagaatagatatgtgtaccacatagaatgtgtacctgagacacacttcccctggggactccttataaagtgcggtgaattgtgtgtcttttttcccattgaggaggccaatgtggaaaactaaagactgagatgatgtagaaaactgccctgagagggaacctcactctgccctgaggtagggagccagcactggtcaaggccccggtggaggatggcacctctgttgggtccacctggcctctggtcacaggcacgatggacctgggcctgggcagcagggggcgctgtggggctggcacttagagtctgtggggctcttagctgggaaatgatacctggccctggcctctgcctagggctcactggggccagcagctgggtcctctctgggccctttgggagcctcagtccaggtacatcccaggcctactcttcccagaaatgacccagccactgggactgcacacgggcccagggaggggcacgcttgggcaggggaagaggagcacatttgcatgaaaggcccatctctctcctctaaggctagagggtgaacacgagagacctgccgcgtggcttcctctgcagagatccggggagtctgcaccatggccttgaccccactcctcctcctcattgtcctccttcactgcacagtccaggacggcacaaagcatcctgatcccccagctcactgacaccacctcccaactcatgccagaactgtccttccctgttctgctttattcagtgtataatggctgtctgtgttttcgggatccctctggcagcccgtgccgactcagtcgacctctgcatctgcctccctgggagccctggccaagctcgcccacactcagcagtcagcatagcagctatgccattgaatgctttcggcagcagccagggaaggcccatcagtacctgatggagcttaagagtgatggaagccacaccaagggggctgggattcccagtcactagttctcagtctccaggactggagctgaccactatagtgtcatttctacaatcccgtctgaggatggagctgactatatctgtggtacagattgtagcattggtgtgccgtttgggtaaagcacagataaatggggaaatgaggcaaaaactgtttttctactctgctaccaaggttgaaaaatggctctcagaaccagtgtctgctgacctgcatactcaaatatgttatgtgtgtgtgtgtgtgtgaatgcgtgtgtgtgtgtactttaattttacgagtagagagccagatattttctgattcctgcttccagttcccttggaaacagctttttaggccaggccttctagggagtgcactctgatctgtaactattgtgcaaatattacaacagagcctgtctcctcctgctggtctggtgtattgtggctatataggggggtgcaaagaaattctccttttcatattcagacactgggactcagctgcatacctcagtcctgtcttattgagatcatttaaatgatcaatcttagaagaaaacttctgacttaaataaattttagaagtctatcaacatgctagaaagcatattccagataaataaaaatagaataaagatttatagagattgagatgaaaagctttaaaccctttgggggtttctgaaggtattctcaggtgttcagtgcctgggatttgggagtaagggataaggaggagaacttatttccaacacactgaagatgacaacagataagcagaaagttaccaaagaaggaggaatagaaatagccatgaatatcatcctggtaaccctgatctggaatgaaggatttcatttatttacttatttatgtatttattttcaaaataagtacatctcatggagtccttggcaaaagctgaaggaagtattgcttcaggaaatatctgtccagtaattaggaaactactaatgtgattgagcagagacttcattaacttcacatgcaaagaatacagacttgcagaaccctcctggaaaaccatgaaacaatacatcatcaacaataacaactatagcaaaaacagcaacaacatcaaccaaaacgctttacaaaaaagttctaatttccagaactgtcacattatattatttaaaatttccatttgtcaaagcaaaataatgaggtaggttcaagacacaggaacatattgccatatataacggaaaataacaaagaaaaaaacattaaaaaaacaaaaaaattaaaagttgacaaaaactattttcaaagaggcagaaacactggtcttattcgaccaatacttcaactccattatttctccatttgctcaaagaaattttaaaaatgtaaaaatgttcaaaaaagcatgaaaagaatgtatctccaaataaagaatattaataaaagatataaaagaaagagtcattgaaataaacatagattaattgatattatcctattacaggaatagaatgaaataagggtggaaaaatacgcaggacctaaagaccctcttgacaccatcaagtgtaccaatatacacataatgaaaggcccagaagggtaagagtgaggaaaagaaacagaataatgtaattgaaaaatggtaaccaaaactttcccaaatttgacaaaaagaaacatactcaatccctaaaaagttcaataaaccttaatcagcattaatcggaactcatagatataaaacttatggaaagcgtcatggtgggataaagcttactaagttctaaaaagtcaaatagacaaagacggttacaccaaaagtgtgtcaatttctgtttcctgccatgatgcaatagatggagttcttacaccataaacaacactttaagacataatcgagtgcatgtaatgactatttccagacagtgaatattggccaacagggataacttgattatgtaacctcagagaaaggaccctaacacgcaaatgagcactgcagtggacacggatttctttttcttcactttttttttttcgagttagggtcctgctctgtcgcccaggctggagtacagtgatgtgatctccgctcactgcaaactctgcctcccaggttcaagcaattctcctgactcagcctcccgaatagctgagattataggcactcaccaccatgcccagctaatttttttgtccttttagtagagagggggtttcgccatgttggtcaggctggtcttaaactcctgactgatctgcccacctcggcctcccaaagtgctgggattacaggtgtgagccactgcacccagccaacacagattttttttttttaattatactttaagttttagggtacatgtgcacaacgtgcaggtctattacatatgtatacatgtgccatgttggtgtgctgcacccattaactcgtcatttaagtatatcttttttttttttttttagacggagtctcgctctgttgcccaggctggagtgcactggctctatctcggctcactgcaagctccgcctcccgggttcacgtcattctcccgcctcagcctcccgagtagctgggactacaggagcccgccaccacacctggctgattttttgtatttttttagtagagacggggtttcactgtgttaaccaggatggtctcaatttcctgacctcgtgatccgcccgcctcggcctcccaaagtgctgggattacaggcgtgagccaccgcgcctggaccacagatttttttttggagacaatttttggcccagaaggaggtggtgaccaagataatcgtgagctttttacacagctcagaacacacagatgagaagtcagaaaaacatagatggctgagactttcagagcaagacactgaaaagcaggcagctacacagagcaaggtccctgcgctctgcatgaggcccctttggatttggttgggcaaaacatgacaccttgcagggggctctaatttaatgaataggccttcccctactgggaactaagattcatattttttctctctgtcctgttttttcaccactgtatctacaaaccctaggactcagcctagcgcaaagagccaattaataccatgtttgttgaacgaatatgtgaattcacctaaatagaattctcagtaagagaaaaagatctgaggaaaataaagtgatttttactgctttatgtgtattttgagtttgggttgtgaattgattcaaggggatatattaaattagaatgttgacctccgtgtttagagaacaagagaggaatatgaacttgagtgctggaaaggtgaccagcaggatggactgggtcccatgggtttgtgcagagaccatggaaaaggatgagcctccagttactaagtaattgaacaagatatattttaggtaaacacttattttataatcacctgttggaatgggtgataactgtagatgtgactgttattcattgactctctgaaaaaattatttattcaaggcaagaaagattggagaatagttttatcttgaaacacttttcataaacatgacatattcttgctaaagcagataccatattcatctccaagctggaagggttatctcatcttcccaaacatgcaccccttatagtatattttatctgcttttatggcatgtccactttcttggtcacagacattgtaagcctcagagtttaatttgtttctctactgtatacgtatggcacctccagttggtcactgaagctggagattgaaatcctctacatcccccagatctgtcctctggctctatggcgctgtcctgttccatcagacctacattgcccttccttgtgtgaaccctaacctaagtccaatctctactccatgaaagctgtctgtaacagaagcctggcacctctttctcctttttatgaaataaatatctatttctatagatagatctagatctagacattaatagctccaaatctgtagaggacaaagtgcctagttctcaggtgataaccaacccacatcttctgtcctggaatatccagccccagatatcaccccattttctcctccctgtctcgctaaatatatattcacccaccaagccactgggtttgtagtaatttgtcacaacaagaacagaaaaatatgtggaaaagaatggaagaggagtgttgctgttaaaaaaaatacttaaaatatggaaatagttttggaagcagacaagagatagagtttggcagaattttggaaagcatgttagaaaaatcctagattgctttgagcatggtgttaatgcagatatggttgctaaagacttggctgggatgggctcagtaggaagtcagaagcatggtagcgaaaaagctacattttctttcttttttttctttctttttttttttttgagacagggtcttgctgtgttgcccaggctgcattgcagtggtacaatcttggctcactgcagcctccacctcctgggttcaagcgatttttgtgcctcagcctcccaagtagctgggactacaggtgtgcgccaccatgcccggctaaggttcgtaattttagtagagatggggtttcaccatgttgtccaggctagtctccaactcctgacttcaaatgatctgcctgcctcagcctcccaaagtgctgggattacaggcatcagccactgtgcctggtctagttacatttttcttagcaaatacctaattatacatctacagactggaagtagaaatacagccagtaccagcactttgggagaccaaggagggcagatcataaggtcaggagatcgagaccatcctggccaacatggtgaaaacttgtctctaccaaaatacaaaaaaatttagccaggtgtggtggtgcatgcctgcagtccaagctactcaggaggctgaggcaggggaatcacttgaacctgggaggtggaggttgcagtaagcccagacagatcacaccactgccctccagcctggtgacagagtgagactccatctcaaaaaaaaaaaaaaaaaaaaaaagaaagaaagaaaagaagataaaagaaatacatccagtaaaggagctcctggtgcactgatgggagttcacagggaattaagagcgctcttttgacttttgtgggaaaaccggaggaaaggggatcattgttttttggtggaaaacaggttggctggattgtttcatgcaattgtatggaaagcagaacaggtgagcagcaaacttggatatttagctgagaatatttccaagcaaagtattaaaagtataacctcattcattcttgctgcttacagtaaaattttgtgataaaaaatgtgaagtaagggaggaagtcttaaatggaaagaaactagggcatgataattgaggagattactagcatatttcgccaattacttgctcattccctcttttctgggagaccctaaaagtaactcatcatttactgttttccatccgcttccttccttgtctagaatatgggcctggaccctccacaagatgcgtagagaagtcagaaggccttgtcctgtgcaagcattcaagcatccactcctcgcactaatatttctagacagcaaactggtgatccttgctcacctgaaacatacatacgggttggaggaagacagaacctaacacaccttacctgtgtgatgttcagggctggcctctaacttctgagagcttcatttcactccacttcctacaaggattgctcatgccctccttcacttgtggtgaagttcaaacaatacattagatttgacatctttgccaagagctgtagagtgcaaggtgctcacccagagctacatcttccagcagatgaggctcacagttaaatcactgctatggtgtccgtcaactcaggcactgttgtgccttttcacagagcatcgcctgttaactgcttcacccacccactgtgggagtccaggtaggaggacaatgcctccccactagctggctcctctctggttgtacctgtgggtcacacatgcaggtgacggtttgtactacctcctacctggctgtactccccaaagccagggctgacacccctcactgcacttccattccatcccatcagtcacaggaggcagctattggctcattaccctttgcaaggagttcaagggtagaagtggcccatttataagaatatttatatggactatcttgtatatcctgtgaatcatgatactgttaaatcaactctaatacatcatgtttatgtccactgaaatgatgatgataaaaggaaaagtgatatctggacacgcagactgaaaaagatcccaaagattctgcacacaaggcccctattctctggggacatgtgggaattcaatggtcttgctgacatatagagtttgcttcactctgtgtcaatctgaggcatttgtgacctcagagttgtgttttctaagaatttaccatgtgtggcagctggacttcaagttatacctaaatatctctgtctcctagcactcacatccctgtacatattgaaaagggatcactagtacaattgataggatattgagaaaatgactgatgccaggccataatacactttgagttttgcgttctgctctctcagatcacttgctttggggaaagccagttgccatttgtgaggacactcaagtagtcccacagggagtttcatgcagcaagaagctgaggcctcctgccaccagctttgtggctcagtgaaactgtaagttgattctattgccttggtaaagtcttctcatggctttagttccccccactgaaatcctattttcaacctcatgagcctatctgagccagagccaccttgctaaactgctcccaggtttctgacccacagaaactgtgggattgcacatctttgcagttgctaagttttgtagtatttgatgtgaagtaattgaaactggatgcatcgagagaggggaatggaggtggcagagtgggtggaattaggcctggaggtctgctttcagtgagatgtgatgggaccatggcagacacctccctgtttctgattccagtggattgcttactgggcctggcctttttcttatactccatgacttcattgttaataccctacaggaattctgtatgcgctatgtcttatccatcttccttgggtaaatatttaaatataaatgaatcaaaacacatgggccactttctaatcttgattgttcaaaactgaattcctcaaattgaggggtatgattttctttattgtccttggtgctcgtctgccagtgtctatcaatggtagaatcatgtaaacagtcccctcccctattttgtttcactctctgaggacgagagagaagtcttggccttcaacagaaaatggtcaaactagaaagagtaacacttttgagctcctcagtgaatgtggccttggaaaaccccttcacctgggcagcaaaggaagagggagaaagacagagcctgaactggtaggaagtcctacctcaaaaacatcagtcagtcctcacatggatggccagggcattaaggagaactaattaagttaatttcacattctccatgacaaatgctgttgtcatcagtagggacctctcctctctttttccatcctcctacctgttctcactgtccctgacttacccacagtgaactttatgttttcaccttttatatccctatgcctggtcctctgctggcctgtgctgatcttttcataaatatttttgaaatgagaagacgcattttcttaagtaccatgaaagtcgacatcacatccatctttcagggtcctgctcccagactcttctgacttatctgttcactgtgctgggttggcagggaaaagtcatctgcagcagaaaaagtgacaaaatggagatacatagtgtgtcttggccaaaaatcagccaacagatgagagagatctaggattgtgagaagttctgccgttccccagcacctcacactatttgatgtctcaatgtttgtacatatcactatattttctagaagatgcactacatctagaaatagtgtttgctttgtttgtccccaagcaggaccccactctccactcagagccagttcacagttgccttcttccctggcccctgtggaaggagctgctcaggtgtttgctcccagagccctccgcattttccccttactgcggcctcctcacaatgaacaattgtcatgtttttcatttctcctgttcctgttattctagaaatccctcaatcaaaaaggatggttatgaatataagttacctgagacagagcaggggtgtggtccatggatgctgtgacctgacagggacccagcactcaggccaactccactcacatgattctgactgaaagactgaagtgtgcagcagggggaaatctgggtctttccaagctctgaacagtggtgcccacatatctgttatccctgggcaatggagcctgcactcactgaggaagataccacagctgtgtcttctctgggctgggtagagtctcctactcacaggtctgtggaaggtgcaggagctgcttcctcacttactcctcccgtgggacaaacgctgagtctcacccaccaacccaccatatctaaagaatcatgctcagacttcagctcttcctagggtggaacaaagattaccaggaggatacacaaatttgtgtggacagatcctcccttttcaggccactggagaagataaaagaggcctgagttaagcagcttcctctgtggggccacaggaggcggtgtccaccatggcctggacccctctgctcctcatgttcctctctcattgctcaggtgagaactggttttaggtgtctagggttagctccttagcttgcgtcagcctctctggctcagatccccaagacatgtatctctagttcctgccccagcccccatgagtgtctgtgcttgcaggttccctctcccagcctgtgctgactcagatgacctcactctctgcatctccgggagcatgagccagacttacctgcaccctgagcagtggcttcagagttggtaactttgcaatatagtggtcagctgaagccaggcagccgtcccaggtgtctcctgagatactactcagactcaaatatcactcagcaccctggggttcccatccacttctctggatccaatgatacattagccaatgcagggattctgtacattcctgggctgaagcctgagggtgaggctattactgttgtacgtgtcacagcagctccaagtcagcactccagacccactgggaggttacaaaaacctcttctctgatctcctggcctggtgtagtcactcctgctggtggctctaataaagtctatctcactgggtgacttatattttagatcttcaaccagcacctgattctttttttcagacaagtagatctgaaaatgtgactttattttcttcaattccactttcatattgattcatgctcataccttctcatttctttctggttttcacaggcagaaatcccttgctcagagacaaaaattctctaaattgagactttggaggagaccaaaagagagtggttcgggccatgcccggctcagagtctaggagtgactcagagatgcttctggtcccagagcttcaatctaggcattggatacaataccagcattcacaatggaattgtattctctatattagcaacaaaccatcacagattttgaaataaaaagaatataatttataataacatcaatataaaatatttaagggtaaatattaaaaaatggaaagtcttaaactgaaaactataaaacgttgagagtcattacaaaaaaaccttaaaataactgatattccttgtttgtagttggaaaactcaatgtgattataatttttataatgacaattctttccaaagttatctaaggaatcattgtaaggtcttcagtaaaaataggtttgcagggaatgaggagataaaaaaatctcaacaaagaaatgaaaactgtaacagaaaacatcaatgaaacaacagacctgggataatccttctcagctgccatgggatctaactgtatttaagaaaggggtgagtaggaaggcggctgccaaatccaggaacacagatgtcattttgagtgaccaaggtgagccaagggaggacagctttagtcagaagagcatagaccaggagcagaactcacatatctgaagctgatgggcagagtgtgggtgcaataggcctggcattgggtgctgctgagctgaaattatgctgtcacctgaggtgcgcccctggggtgacatggttctggttgttcttcaccccagggaaggacactgtgacctgttatctgttggaggatgaggactcagaaagctctttataagagagggcaccagtgtgatatgagggtccctgattgtctttccaaaggttggaaattgaacccgcatctttcatttttgtgtagagaacccaagatccttttctacataatcaagggttatttccaatagctgccttggcctgtctcagaaagagtgtgggtttgtcttacagcaatggtgcccactatttatgggaacgtcttgtataccctgatctatgctttcaggtctttgacatctcaggtttttggcctacctaatactagccatacgtctgggtactgtgatctacctcctactacacatataaatgcccatctcagcctcatctctccttgggatataaatgtgtgcaagggatttgaagcagctctgccttctttttgggtcctaaggatcagggttatgggtgtctccatccttccctgggtcttctcctcctcactgtcctgaaacatgacccagacacaggctcctgaggctcctgcaggccttcttccctgcttttgccaactgcaggtggaccctgccctgtgctcacaggtctttgtatctctccctgctggtcaattgccctgcaggggcttttcttatttctccattatgagaattcctttgtttttggaggaaataatttttatctaatttttgatttacttatcataatcctagaatttgtataaaaactcctgtttttgcataatgaaacagttgctatctcatgccattttattcaaagtcatgtgcttctgttcacttactggttagaactattgtttaatcattgacaaatatttatcgaacacccactctgcgccatgttctcctatgtcaggtgctgggtatacattgatgaatgaaacagactctatccttatggaacttgtgtctagtgagcttagaagtaaattttgtgagtgctaggatggagagtcaagctaaggactcttagttctgccagcatttaacatgttgttcttatacattttaagaataaattactccagaagaatctttttgttttgttttgttttgttttgttttggtgaagagtatccacatagacacacatagcaaagaccttatagaatgcatcagagataaacaaaataaaatgtaatgtttcccagagctggatgtagtttctggtttgatttattttaatgacacacagaagaaatcactttataatgaagtaaaattccacactacagaaacagagtaaaaatactttcttgaaaaaaatgccaaacctacctttaatcccaaggaaagagaattgcttgaatagatctgttagtatgaaacacataatagacaacctgctgtgtaaaattacttggaagtcatattttagaaggttttaaacattcttaatatactctgtttttgatattacgtcttatatttttctctgtggtggaaatttatttctaagaaataagaaaggatattagaatggcaaaaaatatttgtataaatgtgttaacattttaatggtaactatatatgaataaaataaaaacattgttaaaaatttattggaatgaataataaaattatcaagtttataattaataaaatcaagtatatttcttcttatgcaatttaaaaatagtgcagaatgtttattattctggtatcactaaaaatgacaaacttcattcatatctatagaaaaataattataaaattcagcaagtaatacaggagataatttgaacaaatattgaaacattttcttacttaaagacactaggtaaaaatttcagcaatgagtagagaggttatcaaggcgcattttattattgatgattgatatatgttttttctctcgagaaagtgcacaggtgggtatcagcagaggagacagtataggctccccagatgtcaaagcagggatgcgccaatacccatcagtcatcatcataaaagacagactgtgccttcctgtgtcaggctctgtgccaggagctgtgtgccccacgttcccttccagggtcctgcctgaagtctgtgctcactcagccagccccatcatctggaagtaacagtcccctcctcctgcactggaataagcagaagatttgggtggacagtgtggcctggccccatcagctcccaggagaagctctctgtctctctctcatcctgcatgccagttaatgacgataaaacccacctaaccaacccatctacaacactcagcttcatccctatctctctctcacactccatcaagggacacagtcatcccatgggttttttcccctggcatctctcactttcttcctcttccagatccctgggatcagctatcaccccacccgacaccccttctcctgcttggctgccttcaggctctttgttgagcctgacaccaaaggatgtctttctaaagtgtcagtttcatctattctgcccccagttcacaacctgaaacaacctccgatagtgaatcaagccaagcccctcactctaaagcacagagacatgccatgaattcctaaggggatgacagaatacatcattgatgagaagattgaacaagtgaagtgtgagtggcaagtcaggtgaggacatttgaatccaatctggcatttaaaatgtctcttcatttccaaagtcctatctctccctagtaatgttgtttgactgctagtcccagagcaggaccccacatcccagtgacagccaagtcacagtcgcctccttccctggcccctgtggaaagagctgctcagggctttgctcccagagccctctgcattcccaacttcctgcagcctcctttcattggatgggggtgatagtttgcacatgcctttctagtaatccaagaaaaacttactgaaaaagtctgtttgttcatgtcagtaatcaggggcatgaccagggcatggcccataaatgcctctggactgatactcaccaggctcccaggccaacaccacatacatgatttccactgagagaatgcagtctggacagagagcagcagggtacactgtaggtctgcccagtgggcatccacagctgtgccaacccctcccaccccacaaattcctcagggctgggcagtggaccctgccctcactgagcctgactcagcagctctgtcctccctgggtgtggtcccagcacccacttcctcccaggtctggcctgccagactcccccctccaccagaccctaggacttgaataaatacatagggtaaggtagaggcaggcaatgtgggggacacatttgggtccataactcctcctctgtgaggtcagtggaggggataagaggcctgaggcagcccactatggctgtggacctcaggaggactgtgttgaccatggcctgggcccctctcctgctgtttctctctcaattctcaggtaggcacaggcctcccatgtccagggcatgtccctcaggcttcaccagtcccctctggctaaaatcttacagcaactttatgctggtaggtggcccaactcccatgtgcatctgtgtctgcaggttccctctcccagcctgtgctgactcagccgccctccctctctgcacctccggatcagccagactctcctgcaccctgagcagtggcttcagtgctgatttctgctggatatactggtaccagcataaaccagggagcctccccagtatctcctgagccactaccaaaattcacttcatgaccagggctccggggtccccaggcacttctctggattaatggaaggccggtccaataaagggctcttgctcatatctgatctccagtctgaggatgaggcttactattactgtatgatcgagcacagcagagcttctcatgctgacacacacaggtggggaagtgggacaaaatctcagcctgctcagagtcttgttctctgatgaaatttagatcttaaaataacttatatcacttgtgtgggatgagtgagatatcccgagctcacaggaactgtcgatgaaaagagtcgagctctgtaaaatattgaagacatttattccaagccaaatatcagtgaccaatggcccacaacgcagccctcaggagatcctgagaacatgtaccccaggtggtcaggctgcaacttggttttatacattttaaggagacatgagacatcaatcaacacatgcgagatgtacgttggttgagtccaggaaggcagcacaactcaaagtagtggggctccaaagatcgtctttttgataattggttaaaagagttaaattattgtctaaagacttagaaccaaaggaatgcctgggttaaattaaggcattgtagtgaccaaggttttgttgctcagaggaagcctccaggtagcaggctgcagagaaaatagattgtaaatctttcttatcagatgtaaaaagtctgttctctcagaaattccaaaaatgaggaggcatatctggctccccgttcccatgatgacctgaactctctttcagattaactttggaatgcccttggccaaaaggaggggtctgttcagatggatgggagtcttagaattttatttttggtttacaatcctgtaacacgtcctgtaatttgctgcccagaggtcattaatggcctggaagaaataatgtgccagctgcagtgttgtccacagaaagacttactcattctgctgccctgagtagtgatatcagaaagatccatctgccaacagtcagaatacccttccaggagggttgcacagtaccaggggtgctggaagacctgggatctgaggcaagcagggggcactgttggatggatcccaagatgacaggattaccaggccacacaaggattaaacaagagacagtaacagtccactggctcttacacacttggataagcagtgacctccctgaagaatgactttcctgcacctgggctgaaggacccacatgagcactgggttttggataaaatagagcaatttcatttatgaacatagatgtgaaaattcctcagcatattcacaagtagaacccatgctggacctctgacctctaggatttaggctgagaacaggacatttgtgaggtcggtggggaataagcatgaactttggagggacagcaggtatgaggggtgctgagccgtatgttagatgccccaatcagggaaagagcctcgaggcttccagtgcagcttccctgataccctgtgggagagaaagatagatactggatatgctgcaatagagctcactaatgctctagtaaagagcaggcagcttgcattagcacagtccttcaggagagaaaacgcagccccaggaaagctgtcagaggccaagatgactcattagtcacattgaattcataatgcatttatgatgaaatatatgataaatgtcttatccttttgttcttttttattttttattatcgtgggtacataataggtgtatatatttatggggttatgagatgttttgatacaggcatgcaatgtgaaataattatatcatgaagaatggggtatccatcctctcaagcatttatcatttgtgttacaaatgatccaattacactctttacataattcaaaaaagtacaattaaattattatgaccataggtatcctgttgtgctatgaaatagtaggtactattcattctttctaactactttttgtacccattaaccatccccacatcacctcctactccctgctaccttcccagcctctggtaaccattattctactttctatgtacatgagtttcaaatgttttgatttttagattccataaaaaagtgagaatatgtgatgtttgcctttctgggcctggcttattacacttaatataatgatctccagttccatccctgttgttgcaaatgacagactcttattctattttatggctgaatagtactccatcgtgtgtatttaccacattttttatgcattcatctgttgatggacacttagattgcttccaaatcttagctaaacagtgctgcagcaaacataggagtgcagctatttctctgatatactgattttctttattttggatatgtatccagcagtgaaattgctggatcatatggtagccctatttttaggttttttgaggaacctccaatcgttctccatagtggctgtactaaatccaagaacattcaaaatcatatttatatcagtgctaaaaagtgtgacttgacttcaaacaatagccagtagttggtaggaatacaagtataagtttgctaaaaatatgatttgtcatttatatgaatatttctgttcccagaacaatctcatgtagactggcttctggaatctctcctacctcctactgagctgactctcctggagcctggccgtaacggtgcagggctggaagctatatactacaagcacatgctgtatggcatccagcactaacctgggcagatgacggcgaaacaatgtgtgatatttccatttgatttattttccttctttctctatagaaagtgttattataaaactgttatgttgaaggaacacaaaatttgaaggaaaggaatcaaacataaatgttaaatgtttatgtgtgtttatactgttgatctatgatatctcttgtagttactgttcaacatttctattttatatgcttttgtaaaataaacaacatattttatacaaaaactctcatgtgtgctagttgaaagtaatgccacctaaatgcaataacagaatttgaggagactaaaatgtgttgatttgagagacagtaagagtaatttagaacaagtccccatctggctctgaaatctaatcctttgctggtatccctacacctgaaaacctgcaggctttgcacctctgcagacagatgacattgggttaaattcatgggtctccactgagggtcacaataggctggtgtggcacagtgcattctgggagatacagaactgagggacagtaggctgggcgcggtggctcacacctgtaatcccagcactttggcaggccgaggcgggcagaacacgaggtcaggagatcgagaccatcctggctaacacggtgagaccctgtctctactaaaaatacaaaaaattagcctgacgtggttggggggcacctgtagtcccagctacttgggaggctgaggcaggagaatagcatgaacctgggaggaagaggttgcagtgagccgagattgtgccactgcacttcagcctgggcgacagagcaagactctgtctcaaaaaaacaaaaacagacaaacaaacaaagaactgagggacagtatatccccagtggacaccgatccataatcagccccagtcactgcacagactgggtgtatggtgtcctcagtgcctgctgcttccgtgtaaatgaacagcaggagatcctagggtattagtgaattatatattcatttccaacgtcacactcaagatgaagtctctacagtatttgaaattgaacttggacagcttcaactatttttgtttcaaaaaatattatatatacaaaaataccctatttctgaaggtaattggagtttattttacttccacaataatactaaacataaatggttagcgtattataaagtggtgtgtctaggcatggacagcagaaggcacttggagcctgttcctgaggggtctgggggtgttcggagctgagaccagccacttcccctgtctggtgctctctgttcagggctcacagctgtgatctcctcacccctgaacggctcacagcactactcatacttatccctatggcgccctcaggcagaagagtctgatccagggctcagggtgggatcagaaaagttcccatttgcatgaggagatcctccctgcctcagagtataaagagagaaaaggagagagttgggaaaagctttacttcaactgtggggcaaaaaggcaggactcaggacaatctcaagaatggcctggtcccatttcctgctcaccccctttattcactgcacaggtgactggacatggggccacggaaggggccctggggagcccatggagagctgctttctcctcttatttatagacccagaatcaccatgtctgtgtctttcccactttcagggccttgggtcccatctgcgctgattcagtcaccctcagtccctggggctctgggccagagggtcaccatctcctgcactggaagcagctccactttggttattggtgtgatatacactggttccagcagctccaaggaatgacccccaaactcctcatctataaaaacaattggtgacacctgtgggtccctgacaattctctggcttcaagtctggcaactccattttcgtgaccatcactgtgctacagcctgaagatgaggctgattatcactgccaattctacaaaaacagcctgagtgctttcacagtgctccgggttgaagtaagtcagaccaaaacacacagtgtgcccagccatgaagctctcccatgcaccccctactctgcagctaagtcaatgtgttctctcacttgtttgtcctaaaactggggcctgagaacttcttcagggtaatttttctagggaatgtgtcctcaccctctcaatatctgccccaaattcactctttggcaacaataccatgtgctcttttctcagaggtagcagctggtactgaatgccagaggccagctgccctgtggtggagtacagatgggtgaatcagtcggctggggcttccacaacaacacaccacagactggagtcttcaccaacagatatgtattgtcttactgttctggagtctgaaaggaccagatgaaggtgccaccccgtttggttttctctttgccctctttcctttgcttccagatggctcttttctcactgtgtcctcacatggccacccccaggtctgcatgtggtttttgtacacatttcttatgaagtctttagtccttttggattagagactcattcctatgacttcattgaatcttaataatcttagtgtccagatctcccaatacagacaaattggtaacttagttataacataaaaaatcagggggccaggctcggtggctcacttctgttaatcccagcactttgggaggctgaggtgggtggatcacgaggtcaggagattgagaccatcctggctaacacggtgaaactccatctttactaaaaatacaaaaaattagctgagcatggtggtacatgcctgtagtcccagctactcaggaggctgaggcaggagaatcactggaaccaggaggtagaggctgcagtgagccaagatcacccactgcactccagcctgtgtgacagagcaagactccatctcaaaaaaaaaaaaaaaaattcggggtggatgcaatataatttgtaacaaaggatcaggggtccagggacccagagtccatctgtgtctgacccaggagaggtgatgctgcagaggccacctggtcactccattcctctgagctcctactatgtgcagattctggatgtgttcttggtgctcagggtacagcgtggataagacaggatggtccctgtcctccaggaactgatgctatttaggggaaaacagaacacatcagtaaatgtatcaataagaatatgacatgttttaggaaaatgaagagaggtgtgttttggtgaggtggggtgagcagacttagaggagttgatgacaaagatgcagcgactgattaaggttgtaaaattcacctgctgcaacataaagtgaactaagaggaagtgagggtccaggcagggccatatgaggctctggttttgacacaaacattaggctgtggagtcctggacatgggcggaacacgcaaacggtgaaaggtcatgtctgcatggttcagaagtgggaggtgctgaggaatggagtgtggggagacagggaccacagctgggatctcaggacctgtgaggggtataggtgagctgcagctaagtgagaaaacattaaggaccctgtgtagttgacacaagattattgacatcttaagtcttcaataaatacaatcagcgctgacaaatgtggccgtgcctcagaagagctagaaatgtttatgtctaggtaactctcatgttctgtagaacttcacttgtatttttttggttttaaaggattattataagagcagacgtttatgaatatactccattcttttatcctcaatattgcccatctcttaaaatcctttggctttacacacacctacaacaaactgatcttcaaaaattgataaaaataaacgatgtgtaaaggataccctattcaataaatgatgctgagaaaactggcctacaatgcagaaaagtaaaactggacccctacctcttaccatataaaaaattaattccagatgaatgaagacttaaatgtaagacctccaactattaaaatcttagaagaaaagttggaaaatactcttgtggacattggtgtgggcaaataatgtatgtctaatcatcaaaagaaattgcaacaaaaaacttgacaatcaggaccaaataaaactaaggagctcctgcatggcaaaagaaactctcatcagagtaaacagacagcctacgcaatgggaaaaatatttgcaaactatgcatctaacaaaggactaatatccagaatctataagaaagctaagtcaacaaaaaaatttaactccattaaaaagtggacaaaggacatggtcacttctcaaaagaagacaaaaaagcagccagcaaacatgaaaacatgcagaacttcacttatcagagaggtgcaaatcaaaaccacatgggatatcatctcataccagtgagaatgggtattattaaaaagtctaaaaataacagatgctggcaagaatacagaaaaaaaggaatgcttatacattgttggtggggatgtaaattagtacagcttctgtggaaagcagtttggagatttctcaaaaaaaaaaaaaaaaaaaaaaaactaccactggacccaggaatctaggtgtgtacacagaagaatataaataattctaccaaaaagatatctgaactcattcgtttgttgcagcagtattcacaatagcaataacatggaatcaactcaagtgctcattagtagtggatcgagtaaaaataaaatgtgtgatacgcattcaccatggaatactatgcagccattgtgaacaacaaaaccatgttctttgcaaaatatggatgtagctgaaagctactttgcttccagatggctctcttctcactgtgtcctcacgtggtcactctcaggtctgtgtgttgtttttgtacagattgcttatgaagtcattagtcctcttggattagagactcattcttatgacctcattgtatcttaattatcttagtgtccagatctcccaatacagataaattgttaattcagttataacgtgaaaattcagggtgaacacaatataatttgtaacaaaggatcagggatctctttggcttctcgatggatcacctgccaaggggcaagggtgtaatttttacaatgataggcgcatagctcttaacacaagacagaattaccctgttgaatgcttcattcaaatgatatgttagggaggaggccagttggatgataaagctttgggaatgaacatttaacagcacaggatctaaaatgcagaagaaaagaacctctgatgcaaactttctgagtggagataaactgtctgatatcctgcagattaataaaaccagaaacttcatctgccccctctaatagaaatctacacattaacacaatttcactatatgaagtttccagaagatgatgtggagcttgcaggtgagcttcattttacactttccgcctattcatttctgtgggaggacttactttccctctttcaattttctcatgtgctgttcatgtcacaccctctaattcaaggctccagcccacctttcctgccaacaccaacactctctgtagatgaaaacccaccagtcagcagcctccttggcctgagagaggtcatcttcctgggtttctaagactctggtcctgccgagattctccttcctcaatcctaatcccgtggtctctggcagccccttcacatggacctcatcgctcgtctctgtgttcctccagctatatccacgtcagaaactgctcttcatctgcactagaaataaagaattatcctctcaactcttaaatgtttgctctgattctctcctcttctttgagctcaggcacaccaccccctctcagattcctgagtgtggcagtgtcccctctccagtctccctaccacctccaatggtgaaggcgaagaaaggatgtccctgcatgtatcacatcctcatccttcccttcagggtcagctccctgggtagggaaaacactgttcccttgaggctcacatacccactgtcaaaaagcacccagcacatggtaggcactcaataaacctttaccaaatgcagacctgcctctcaccacactggacacattgtagtgagctcaggatggggctaaactgggagtattagctgtaaacttgctcctctctctgtccccagcctgagagctgagggggcacccacgagggagagcacctaggggcagggaggggtcacaggcagcctcatcctctgtgtgagacactgctcagactgggggatccctcttcattcagatgggaagaaaagggaaacaaaattcggtaggaacttctatgcatccacacagaggaggcaatgacaagaaaacacaggatgcaagcacagtggtaataatgtatttctacctaatattgaataaaactcaatattgcctgtattctgtaaacaataactatttacaaaactgactgtaaattatgattttaaaaaccacagcttatgaagaagagaaacctcaaacaatgacacccctgaattgcaaatctaagacatggcacacatttattttcagttccatatgtggcctggatttatttacaagacaatattatgatattatatgtcactattccattttagatggtgtatttaaaatctcacagtactgcaactacctagtaatctactcatcagtataaacatcaatgtgacaatcctgctatccttctctacccctgcataaccccagcaaaaattcattatgaattcacagaatgtaatatcagaactgttgtagccacatacacagtttgtttcattttatgttttgataaagtaatcttttttgtttaagcttattgttttttaaaaaatatattacatactagatgtcattacaaatcagagattaataatttctcttatgcttatactactcccacagcactcattactgaatgtaaaccatatttatattttctttctttttttttttttgagacagggactcactctatcacccaggctggagtgcagtcgcacaatctcggctcattgtaacctccacctcccaagtttaattgattctcctgcctcagcattctgagtagctggcattacaggcacccgccaccatgcccagctaatttttgtatttttagtagcgatggggtttcaccatgttggccaggctggtctcgaactcctgacctcaagtgatctgcctgcctcagcctcccaaagtgctgagattacaggcttgagccacctgcctggctccatatttatattttctaaacatcctacttggagtggctgatcctaccagctaccatgtttccacctcacctgggatcaaacactgacaattggtaattttatctcttgcagtcttcaaatattgagcaaatttgccatttttgctattcaataaaaatgctggaaagttatttgccatgccactgactctgttcagtgcttggaggacagactcctaggagtgagaagttgaccacagcatctgaatagctattaccccaagtctgtggaaattagagaacaaaattttaccagaaatgccccccagagcttctccccataacctcaccacccttagagaagagagctcctgttctcctcagcgctgcagggtccacagaggaggaagagctctggccagcagggaggagccacagaagaaaggacctggtgtctcccgtgaccagggtagtgagtcatgggaaccagtcactgctctggacttgacctgacctaagaggacttggtatagagtcaccacttcagtcctcaccaaggaacatccaaaaagccctggacagattcacccttaaggagaccagtaaagcatgaactgccctgagttaatgagaaggtcacaaaaagggtctgtctggcctggtgctgagcctgggggcagtgatcagagcagggggaatgcacagctggctctggggacatctggtcatcatgtcacaggagagtgtgtctggatgtggacacctggggacatgaagggctcattaccaagtgatctaggggagatcagagctgcgatcagctaactgcctgcatggtgccctctgctcagtgatcacagtggtgagctcctgatgccccggaacacacagtttcacccttgcctgtatccctgatatccacgagaggggcctgacccaaggccagcgtgtcatcagaaggctggggggctctaatttgcatggatggaccctcattctcagagaatgaagaggggaagggagagatttggggaagctctgtctcagctgtgggcacagaaggaaggcaggactcaggacaatctccagcatggtctggtttcctctcctcctcactctccttgcacactgcacaggtgactagatataaggccatggctaaagccctaggaagcccatgggccctgctttctccttttgtctctcaacccagaatcaccatgactgtttctctcccacttccaggatcctgggctcagtctgtgctgactcagccaccctcagtgtcttgggccacaaggcagaggctcactgtctcctgcactggaagcagctccaacactgggactggctataacgtaaactgttggcagtagctcccaagaactgaccccaaactcctcaggcatggtgataagaattgggcctcctgggtatctgaccaattctctggttccaagtctggcagcttggcctccctgggcaccactgggctctgggctgaggacaagactgattatcactgccagtcccgtgacatctgctgagtgcttgtacagtgctccaggcttgcaggggagtgagacaagaacccccttcctcctttcccaggagggtgagtgcccagcagctactgcacaggcctggcctgtggcttctgcagttgctgtttccccagtgggcctgggagcatccagggccccacctgggagtagatgcttctcctcccctccgtcctcagagtcacccacagcagtccctttctaggaaaagggcctccagaaaacagaatgtcctgtaccctgcaacttgggacacagggtctctgctctaaagtccaggggctggagtgacaaatccagcagtgaaatctcagatctacatctgatggggaacctgcatctccatcatccttttgctatttccaggagttttcaaagcagtgtcttcctctcactggtcctcagtgtgttttcctgttctttttgtttcagcctatttttttttttttttttgagatggagtctcgctctgtcgcccaggctggagcgcagtggcgcgatcttggctcactgcaaactccgcctcccgggttcacgccattctcctgcctcagcctcccgagtagctgggactacaggcgcccgccaccatgcccggctaattttttgtatttttagtagggatggggtttcaccattcacaggattgtctcgatctcctgaccttaagtgatccgcccacctcggcctcccaaagtgctgggattacaggcgtgagccaccatgccgggtctgtttcagcctattttttatgtgtctttttattgaggaataattaacaaaataaacccctgatatttaaagtgcccaattttgtgtgttttaagatatttatacacccttggataatcaccacaatgaatcagtgattccatcagaagaaatcggtgactggttctggcagaatccagggaaccctatctaatatctcgtgaacttctacttggactcaagtaagaaacagggctctgaggctcccagccacatcttgggatctaaagatgcgtcggcctgtgcaaggattttgcacgttgctgtgctgcagcctgagaatgggtctgtctcggggtctgcacaggggcagtggatttcacagtggctctgaggcttacacagggctccaggcccatgggaaagtgagacacaaatcttccctctgctctctaggcctggtgcagtgatcctggctggaggctctgataaatctagctcagaatgtaacttctgttgtgaacatctgattttccttggacaaatagttctgacaatatcttatttcagttcgactagtatatcgatccattgctcatacttctcattccattcttgctttcgcaatcggtggaccctgtcctgtgcccacagttctctgcatctctccctgctagtccagcctcctgcaaaggttcagctcccagaagagactcctacatccactgccctggaagaagcaacactatgagtagaatggcaagattttgtcacatcagcactggggataactcatcactactctgggcccattgaagcaatcacatactctctgaacctcagttttcatttttggcagcatgtaaccctacctcagcagctcttgctttcaacatggggatgagctgaagaagaggcttgtaaatgacaagtatcagtcactgttcaccgtgcaggggtgtctgtgtccttctgtgtcaggctttgtgccagcagggctgtgccccgcaaactcttccaaggtcctccatgcagtctgtgttccctcatctggccacattgtctggaagttaaggtcacctcctcatgcactggaacaagcagcagagtcgagtggacagcgtggcctggcaccgccagctcctacgggagccccagatggtaatgcctgctggtctccagcttgcagggttctgattttgggctcttgctctaggtctggccacttgggcttctgcaatactctgggatcctgtatgaggatgagggtgatgatcagtgttcaggatgtggaaagagccccaggttaacccaggacacctgtctcatggggacatgaggcacaagcctcccatctgatcccacagcctggcctatagactcactttaattttgtgtgactgtcacctgactcaggacattcctgcagtcattttttcctccaggactgatggaatgaggccattccctgggtctgtcgcctcatatgcagtcgacctatatactgggctttcaggataaaacattcccagcctgggcattgcaatacagacaggcaggtagctcagacagaaaatactcttgttgattccagatttctgggcacatggacttggtgtgtgtttgtgtccatgactaaggtcaggtttggggttgggagtgagagtggtcaccacatggtccaggaagaatgtgttgtcaaagataaaattcgtacaccttcctgcccttccctgtacctgaggcagcttcctgaagcctgcaggtttctgagattctccataaatggagaggaaacatcccatagaatggatgggttttttttgtcccagacaaaaagacaagacaggacgagggtacagatgtcagcaagggttaaacagcaagtatgcacttgatcatgccaaagaatactgaaatagctttgagggtaattcagtgtccttgagaattaaaaacaaattggagattgagggcttcaaacccccattaggtccttgtgcaaacagatgctgaattccaacccacattaagaaagaggctaaaaagatgagacaaaatctctgaaagacaggtggaggggatttctgcagtttcttggtgcttaagagacagggacctgccaggcactcacctgagaaatcctgcagggtcacagcacagggaagggaatgtgtcgggtacataagatgactttgatgttgaaaacaccacctctaccactgataatggttttcatcattcatacttaggtgcatgtacaacctctagcaaccataattaccacaaaggacaggcattgtgtaaacttttatgaggttctgtgttataaaataattacacaaaatgtataaataatgtgggcactaataaggtgaggttatatgttgcaatatctggggttcctattgaatttatagactgtaaaactaaataggtgctaatgtaaaatgatacagttagaaatacttgattcatgaaaaataaaaagtgagcgaaaagaaataaagcaaaaagcccaaataaaataaagagaaaggtaaactcacacacaatatcagcaattatattcaatgtaaatgtgttgatgaaccagataaaaataatttccttaaaataaagttacttgtgtgttatattttaaaggatgctaaaaatacactatgcaaacatttacctgcagaaagctcttgtggttatctcggtatcagaccagataatttcaatgaaaattatttacatcaggaaatgtgggacattttatgtatataaaatgaaatatttgacaagaacacataacaattataaaatacacatcagtccatgcatggtggctcacgcctgtaatcccagccctttgggaggccaaggtgggtggattgcttgagctcaggagttctagaccagcctgggcagcatggcaaaatttcatctctaaaaagtacagaaaaaaaaattagccaggcacggtggcatatgtgtctgtagtcccagatacttgggagcctgaggtaggaggatcccttgagcctgagaggtggaggttgcagtgagccaagatagcgccactgcactcctgccagggtgacagagtgagatcccatctcaaacaacaacaaacaaacaaacgaacaaaacaaaccaaaaaagcacacacaaataaacaaaccaaaaaacatgtccctaataatataatctatataaaatataaattagcaggactaaggaagagaaaagaatcaattcccaattatagttataaataatagcacacacttctattaactgagtgaatcagcagaaaaaaaattgcacataacaatatgtgaacaacctgaaaaaccaaattcacccactgacgccaggagcccaaacctgaggagtagttggctaatgaatatgtattactgaaacgattgaataagtgctagaagaaataaatgaggcattcattatttttacccgatttgatgcttctcctctctgtcctgtgagcagggggcactcccatgtctattcctagtcccattcttatcccctcgtctctctccccaagactgagctgcattctgcagggtggctcccgtccccctggagtaaatgactgacgtgaggagccctgccttccagtgctgctgttttcatcgtgctctggtttgaatgtctcccttccaaaaggatttatacttaattgccagtgtgatagtactaagaggtaggccttcaaaaggtgatatagtcttgaacacggagacctcacggttgggatcaggtctcttatataaaggctggaggtagcggtgtgctctgtctctcttcttgccatgtgaggacacagaaaaaaggcacttatcagatgacagtgccttgatcctgaacttcccagcctcaaaaactgtgagaaggccaggtgcggtggctcatgcctgtaatccaagcactttgggaggccaaagcaggtgaatcccttgagtccaggagttcgagaccagcctgagcaacatggtaaaaccccatttctataaaaaatacaaaaattagccagatgcagtgacaggcacttgtagtcctacctaatcaggaggctgaggtgggaggatcacctgagcctgggaggtcgaggctgcagtgagttgtgattgtgccactgtactccagcctggatgacagagcgggagactgtctcaaaaaattaaaaaataaataaataaaaaataaaacagtgggcgagataaagaaaatgtgttacttatataccacggaacactatgcagccataaaagaaagttatgttcttggcagcaacgtggatggagctggaggccattatcataagtgaactaagccccgaacagaaaaccaaatgctgcatgatctcacttataagtgggagctaaactatgaatatacccgaacatacggaaaggaacaacagacactgggaatgactaccagaccaaaaaaaaaaaaaaaaaaaaagaggatccaccctgtggatcctctgcccactgcctgggtcatgaggttgttgggaccccaagcctccgtgtcatgcaatcaacagatgtaactaacctgcatgtgtaccctttaaactagaatagtaagagtaaagagcattgaaagaaaaagtcaagatcagaagcgaagaaaataataaatgaaaaaacacaatctatagttatccaaacaatccatgactgtcacaaacacagaacaaggacccagtggacagaatgaggcagccaaatactcaacccaacatgatacatagggaacacatttttcaaaacaccaaaaagacacaatgggaaagggagagtctggttcaagaagtgattttgagaaaactgaatatgcacatgcaaaacactgaaataagacctttgcattgcacgatacacaaaatcaacacaaaataaattaaagacctaaactcaatcttgaaactgcaaaggtcttataagaaaacataggttgggtgtatattttaggaagcctgtatctatgcacacaggctgcaaaaggtgaaaaataatcataacactaaagggaaaattaggggaactacatgcacagacaatgcaatggcttggctatatatgtgtgtgtgtatgtgtgtgtgttttgtagggtggaggtttggatacaaaaattacagctaacatgcaaatataaacaaagacactagtgacactttagaacttctacagggggaaagaaacaatgaaataaacaaacaaacaaaatgcatcctaaagactaggagagaattatggaaagtcctacctctgaaagagattgttatctaacacctacaataaactcactctactaaatgaaaaacaacaaaaacaacaacaacaaatacccaagctaagaggatctgaatagacatgtgtgtaaagaagacaggaaattgactcacaggttaacagtttctcaatatcactaatcctcacaaaaaagtgaatcaaaaccatactcaggtaccatataattccagttaaaatgaatattgcaaaagataaaaataaaaattgttggaggtgatggctggtgtagaattgcaggaaggaaaactgttgtacgctctttgtgggaatgtaaattagtatacacactatgcaaaactgttggaggttccttaaaaaagtaaaaggtcaaagtacaaccaccactccaggttaacaatcccaccactgggtacacatttagaggaaacaaaatccctgcattgaagaggtatctgccttcccatgtgtcctgaagcactagtcacaatagtcaagatatggaatcaacctaactgtccatccacagatgaagagataaaggaactggatatatacatgatggaaagcatttcagccataacagtttgggaaatcattgatctgcagccatgtggagaaacctggaagacaattaggggaaatgaaatgagcctgttagagagagacccatactgcatgacattaggcaaatggaatccaaaaaacactgtcttctagaagcagaactttcaataggggttactagaagctggagagaggagggggcctgggcagggattggtaatgggtacagagtaacactcagaggagaggaatccattctgatgttctattccacagcagggtgaccagggtcaacaatgtctaggggaatttttcaaaaacagctggaaaggatggttctgaatgttctctccacagggaaataataagaagccagacaccatgatttgatcatgacactacgtatacatatatcaaaatgtcccttgcaccctctggttatatacatacactctatagtaatgaaactgccatcaaatgttggtagtattcattctaactggagtgacatagaatctgagtgtggttttcaatcatgttttggtgtgaatcggccatgttgataatcttatcttttacctgtgcatcaacctcatgtcttcaggtcctctgcccacttttacacatcaaattcaaaacaaattaacaataacatggcaaatataactaatcacacacacacagaaaatgaaaaccaccactcagattccatctcactctagatggaatggatactacaaaaaaaaagttgaaaaatattaaaagacaaaaaaacgatggtgtggatttccagagggggaacttgtctccgcagttcgtaggaacataaactagtacacacactaaagaaaccacttggaggtccctccaaaccttaaaaccacaactaccatttcatccagcaatctactactagtcgtatatacagagtacatgaaatcaagccatggaagagattatctgcgttcccaggtggaatccagcactatgcagaatggccaagatgagaaatcagccgacctgtccatctgcagatgaagggataaggaaactgtcccatgcgtagacactggaatactcttcagccagaaaaatacaatgaattcccatcacgggagccacacggttgcacctggaggacatgatggtaaatgaaatgagccaggcagagacagacaaactttgcatcctctcactcatgcagaagctgagaaactttatctcaaagacctagaaagcataatcatggttaccagaggttggggggaagaaggggaaggggcaaggattggaaaggggtagaaagttccacacagatgagaggaaggaaattctgtttttctattccacagcagggtgactagggttaatagcatcattacatcttcaaaacagcttgaaaggaggatactgaagcttctcgccacaaaagaataaacagtggtacgaaataacagaaaaaataaataccctgatttcgtcattccacaatgtatgcaaagaccaaaatgtcgcactctaccctctcattgcattcctttactattcagcaaatttgtttaaagaaatataaatacatgatgctagaattcacatgggaccatgaatcaccctgaatttcttccaaagcaatcctgagacattcagactacatcagatgcatctcacccaccgatttcaaatttcatggaaaaactgggtacctgcttccacacagagcagtggaacacaagagagggcccagaagtaaactcacacaccaaaaaccatctgatccttgacagaatccacaacaataagcaagggggaaaggatgccctattcaaacaatggtgctgggataagtggttagccatatgcggaagagtaacactgggccccgacctctaaccagacacaaaaagaaactccagatgaatgaaagatttaaatggaagacctcaaactattaaaatcctgcaagaaaacatacaaaatacctttctccacacaggttttggcaaagaatctatttggctatgtccccaaaggaaatgacaacaaaaatggacaagccatgcttaatactctaaagagccaccacacagcaaaataaattagcaacagagtaagagacagcatacagagtgggagaacatgttcccaaactgcatctgatcaaggtctaatatccagaatcttcaaggatcttatgccaatcattcaacaaaaaacaacaaaaaaatcccattagtgtatgggcaagggatgtgaacacacacttctcataggacaatgtgcaagtgaccaacaaagagggaaacatgctcaaactcactcatcaacagagaaatgccaatcaagagcaggtcgagataccatcccacaccactcagagcggcgatgactatgcagacaaagaaagaaagaaagatactggcgaggcagctgaggagaggaaaggctgatatggtcttggtgggggaagcaagctagtacagacactgtggaaagaagtttggagatttctcaaagaacttagaactaccatccaaccccacaatccctctcctgaagatctacccaaggaaaatatatccttctatccaaaagacacaggcacttgtatgctcacggccgtgttattcacaatggtaaagaaacggaatcaacctaggcatccatcaacagtggataagataaagaaaatatggtatgtatacaccacaaaacactacacagcccccaaaaatcacatttttggcagcaacatggatggagctgcaggtcattatcctaagtgaactcaaggccagaacagaaatccaaatgccacacattctcacttataagtgggaactaaactatgaatgcacctgaacgtaaagaagggaatgattacattaggaataactaccagaccaaaaagaaaatgcaaatgggagggagggggcgttgcgtcctgaagacccaccttgtgcgtcctctgctcactgcccgggtcatggagttgttgggagcccaagcctcagtattatgcaaccaacagatataattaacctgtgtgtgtactctttcatctataataaaagtagaaactattacacacacacacacacacacacacacacacacgaagaagcttaagagctacataaacaaaaaaataagtaaaatctatagttatccaaacaatccctcactggcaaacacacagaaacactaacctatggacaaaatgagaaagccaaaaatgcagcccaaaattacatatggtgaatgcatttttcaagagaacaccaaatatcacaacagtgaagagagaagtctgctaattgtctttgagtaaaatgaatttctacctgcaaaacactgaaatggatcctcatgttacataagacaaaaaaatcaatgcaaaatacagtaaagatctccacccaaaactgaaaacacagggtgttttcacaccctagaagaaaacacagggtgagcgtttacttcagtgaaactttaatctatgtacacagattgccaaaaggaaagaaaacaaaagggaaaagtaggaggaagaaacccacagacaatgcgatcttttttcctttttttttgtgacgggacaccaaagtcaccacatgcacatgcaaatagaaacacgcaggactatggaaagctttagagatgttccacaggaatgaaaccaatgaaccgaaagagaaggtgtcctacagatttggagacagatctgaaaaactgtatctctgaaagcggttgttatctaacatgtccaagaaactaacaccactgtgtttggaagcaacaacaacaacaaaaaagacaaaacaaaacaaaaacacaacaacacatatgctgaagcaaaactgggcaaaggcccttaatagacatttctgaaaagatgacatgaattgactaatgagtcaaaaagaagttgctcaactttatcatttctcccgcaaaggtaagtccaaaccacagattctctgggattctggagaatgtgaattctgactcagtaggtctggagtgagcctgagattctgcgtttctaaaaggttcatttccccacaaatccacattatgtgtattaatattaccaagtaaataagaaaggtcaaaaataaaatggcaagccattagtagataaccttagtcttcctcctcatcctcctcctccactgcatgggttaggatggtccccagcatcctgatcccccaggtcactgacatcagctcccaaactcatgccaggaatgtccttccctcttcttccttcaggccataatgggtatctatttttccagcatctttctcccaatctgtgctgatttagccaccctctgtatctgcctccctgggacaaagggtcaaactcaccagcactctgagcaagagctacagcagctgccacatagactatccccagcagagctcagtgatggacaccaggttcacaatgccagtgggcagtggtgctgtttactgcatccagtggggatggagtggttgtccaggcacagacagatggacaatcacacagcaggaacaaatgtacattctgaaatttaacaaagacagaataagggactcttggggaatagaggtctcaattgcagacatagtgagtgcctcaaaaattagagaactggggccatctctgtcatggcccggattcctctctccttcatcctcctcagtcatcaaagagattccattagggggcaatcaaaggatgctggggcctgctactagctcccaaaaaacaccacaagcatttcagcagggagaaaagaaaatgctcacaaggatggggttagatttagttataaaccagattgtgtggcaggagggaggacatatcccccatcctttggccactccaaaattgggagagctaatctggggaaaggcaccaacacctattcattagtgtctcggtcctgtgtgatcatgggtctgtgtgagttctcagcagctgcctctctcaaggtctccccacaggacagcagggtgaaacctggggcaggaagagaggggaagctgatttgcataaagaactttttttatcctattgggtctggggaggcatgaaaaggccctgaggaaaacaaaccccagctgggaagcctgagaacacttagccttcatgagtgtccccaccatggcctggatgatgcttctcctcggactccttgcttatggatcaggtcaggggaagggactctatccctgggggaccacagaaaacagggtccaggttactctcatcctcatgatcataactgtgtctctcctgttcgttttaggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttccacagtgatttaaacctatgaggaagtgcaactaaaacctctttatatactgagaacagttcagcccttacagacaggagggaaagtgagagggtggaaatggtcaacacggtgagtgaggagtctcctcgccccagtctctgacgcaggggttcactgccaggtgcctcacccagtctctccccgggtgtgtccaccttcccagtgtggcttttccatggctgtgcttcgtctccactgagaataatgtggagggagaattatctacaaaatatataagctcacagtgagtcacagacaccccagtgctccaggaagacgcttcttattcaaagagaattaacaggcatatgctcactcattaatttgaccatggaggctgactgaatattttatttatcactgaagtgggagcattttcaaggggcttgttaaaaatgtaattctctaacctaaacctactaagtcagaaacttgtgttggtgacagatagcctgtatttaacaagctgtacatgagatttttattagcgttaatgtttgggaagaacctacttttattatcataaaattattcataaggatctccatttataatgatgtcaggttaatattccataatcctactctcctaaattcccattcaaagcccccaaatactcagaaacagattttaaatctcaagccatagcaaaaattataacttgatttatgcagacagagtagggaggaatttctaaaaccgtaagttcctaggtgccaggtgtgctgactcatgcttataatcacaatactttgggaggttgagacaagaggactgcttcaagccaggagattgagaccagtgtcttccacatagcgagagtctatcaccacgaaagaaaaaaaaaagatataagtcccttcaggaatttccaaaaacttgtttccttagggtatatttagtggtccatatgaacatctgttactgaaaaccatcccgtagaggactggcttccagaatcccttctccctcccactgagctcacctacctgtggctctggctctcagggtctttataggacacagggctcagcctcttatcaccgattgttccacaggatcatggttccactgagatcctctcagcatagatacgtacctgtcctgaacagtgtcttttaacataatgttggcaagatgggaaggactaaggggtgacggagccttggagccaccagaagatggcagtaacctcactgctgagctttgctaggccagactcaggctcccaccctcctcccttcctctgactctttcttctggccacccggggtccaggagctttttccactcaatctgggctcaggggtcacctcagagaacctctcaagacaaaggaggtgcttcaggggatctaacacaagtgagggcagattttaagactgtccatgcacagaaaatcctgtgaaaagaaacaaaccagccctacttgtgtctgcgcacctgagtccttaggactgttttctcctgatctcctggctgagtaaagattgcaaatgtgcggttcattatccagatccagagaaatccatgagagtttatgaagacaaagacgacaactaccctatctacttgtcacacaatgaagacactggccttagatctgtcagtgccctggaacattctggaagaagagggtgaaggttacttggcatacgttgggactcaaacatgaggatctcatgatgacccagagggataaaggtgggatcagttgtgagggtggaaaatgtggatttcttaaggccattttgttaatccttttctcattgcaaaggatttaaactgaaatgaacacgatttttctaataaatgcttatgaggctttccattaaatttaatcatatttcctgcctttatgaaaataaatatagaaataaaatatacttccataatgcattactgattgtgtatctttaaactagagggaaccattacttctaaagaaaaattactaggattgtttgcattttaatctgggatcctacatgatggctacagatacagctgttgttcaaggttttagcctggaatctctgccaattcaataacggaggcaataaaaatagacactagtattataaagacagaattcatttattttgaaagttttgaaagctatgaatatctaccaagaataaaataaattgtactgaaaatatattagaatgaattaaaaaatgccaaattcacaactaataaaatttattataaagttaaaaattcttatatttttctgtctcagtataaaaaataaacatttaatgtatctattagaaaataattagcaattttgtaaatgatatcaaagaaaatttgaacaaatggtgaaatattttcttatctgcggacaccaaattaaaaaaattcaggccaggtgcagtggctcacacctgtaatcccaactactttgggaggccaaggcaggaggatctcttgatccaaggagtttaagaccagcctgggcagggacgggtgcagtggctcatgcctgtaatcccagcattttgggaggctgagacggcagatcatgaggtcaagagatcaagaccatcctggccaacatggtgaaaccctgtctctactaaaaatacaaaaattagctgtacatggtgacgcatgcactcctgtagtcccagctacttgggaggctgaggcaggagaatcacttgaaccggggaggcggaggttgcagtgagccagatcgcaccactgcactccagcctggtgacagagcgagaccccatctcaaaaaaaaattagccaggcatggcttcatgtgcctatagtcctagctactagggaggctgaggtcggaggattgcttgagcctgggaggtcgaggctgctgtgaaccgagattgtgctactggactccagcctgggtgacaaagtgagaccctgtctcaaacaaacaaacaaacaaaaaaccaaaaaaaccccaaaataaaacaaaaattcaacagcatgtagattagtaatgttagtgctttatttttaaaaattattgttaacttatatgggttttcctctgagaaggtgcactggaaggtgtcagcagagcagatagcacaaactcctcagatttcagaagcaggggtttatggtaaatgaaaaatgccagtcacttgtcagcatgcacaggtggctatgcccgccctgtgtcaggctctgtgtcagtagtagggtgctccatgcgtccttttcagagtcctacatgccatctatgctcactcagccaggcctgtcacctggaagtaacaggcaactcctcctgcactggaattagcagcagagtcaggtgaataatgtggcctggccacaccacctctcagcaaatgtccccagtggtgatgcccgatagttcccaatcctccttaagtaattaattcacttcaattgaattaaaaaaatcaatcacttccctatgacacacaaggacattcactctctggctttaactatccttgcctgccttgttattatcattccatgtgcccaatactgtcaaaagatgtatttttgccataccctccacatgcatttcatatgtgtgatttttattttcaaattctatatctcttctaggaatatggtgtgttttatttgtcctgctgcaggactcccctctccactcagattaaattattaaattccagataaaaaattaacttggaatactgttgaatcaatagtagaagtaaccaaaataataaagatatttcaaaatgaagattgatttttaaaagtaaaaatgtcacatactccacctagaagataagagactgtactacaaattcattagaacatccccttcatgtcatgggccagtcatgtccctgaacttaacctctgtcttctcgggtgatgttacaggccaatgcagcatcagctgcccacactcctagtggtggaatctgggagcacaggcaggagtctgcgcctgtggccttggctgggtgaaagatgacatttccaagacttcttgcttggcagccatcctcacgtgcaggtggtctggcagcagcactgcaaaacccaggcaagggatgccccactgcaaggcccagtggtaactgtggtggccattggcattgggggcagatgcagccatgtgagttggtgggctgtggcagccaccctaatgatggtttccacccctcccagctggtggtggctaaaaccacccggtaggagtttcaaaagcagtggcaccattaagcggagctcctggaggaggactggaagcaactgcttgcattgaaggaatgtagctatagtggaattattgaaccacatcatatttgcaaagatgcagaatgtattacagattacgagatatggaagttgaggttaatctggtagagagcagtgaatatgaggaggaagctctctattgggcgggtgctatcatagctgcagaaggtgatggtgcaatgcttctgccagtgagtaaagtcttgtacaaacttaaaccagttacggggtaaaatctgatccaggactacctgagggtcacttatgttggcctgttcaatacacacatttctttccaggagccttaccaaaggtctatagtagtgagttcagtatggaggcagtaatcagatcatatctggaaggaactggcataaactccaatcctgtgggacatcatggacagcaactaaattcgaatcaacagagtagagcccttgacattggacaagttcgtggtgaaagatctgaggctttaggactccgacatttgtgaatgacagcactaaatgaagtctttactggtgaacgtctatccagaataccttatgcttgggctgtggcagtggataatttaagtagacccactctatttatttatttattttgagacggagtcttgctctgttgcccaggctggagtgcagtggcgtgatctaggttcactgcaagctccgcctcccaggttcacgccattctcctgcctcagcctcccaagtaggtgggactataggcacccatcaccacacctggctaattttttgtatttttagtagagacagggtttcaccgtgttagccaggatggtctcgatctcctgacctggtgatccatccgccttggtctcccaaagtgctgggattacaggtgtgagcctctgcgcctggctaagtagacccactctaaaagactggtttcttactgtgagatttcagttggtaatggtccatgggaaaaatggaagacttcagggctcaatttgtgaactggagcaagatcaaaggcaacagggttgcaagtcaggctgtggagcatgattaaaatattgcaaatgacaaggacgttggagtcttgcattcaactgtaaaatgacagaataacaaataaatataatgaatcattgttctagagtccaaaaagggccaaaagtaattttcagtattcaagaactaaaaagcaagcagttttctcgagcacccatgagcattgtttctcctgagagatttgtcctcgttttcattgctggaacacctgcatggttgtagatggaggaatgtcttttgatgttcctatttttatatcagacaagctttaaagcaacaacagttataaaagacaaagaaggaaattttataatgataaaaggatcggtccaacagaacaatatcacaatcctaaatatatatgcacctaatactggagctcccaaatttataaaacaattattactagacctaagaaatgggatagatggcaccacaataatagtaggggacttcaatactccatggacagcactagacaggacatcaaggcagaaagtcaataaagaaaaaattgactttaattatatcctagaacaaatagatttagcagatatttacctaacattctacccaacaacttcagaatataccatattttaatcagcacatagaacgttctccaagataaatcataagataggccacaaaacaagtctcaacaaatttaagaaaattgaaattatgtcaagtaccttttcagaccacaatggaataaaactggaaattaactccaaaaagaacccttaaaactatacaaatacatgaaaattaaataatctgctcctgaatgacctttgggttaacaatgaaatcaagaaggaaatttaaaaattgcttgaactgaacaataatagtgacacaacctattaaaacctctgagatacagcaaaactaagaggacagttcatagcattaaatagtctgaaacagcatgaacagacaatctaaggtgacacctcaaggaactcaagaaacaagaaccaaccaaactcaaacccagaagaaaagaaataacaaagatcagagcagaactaaataaaattgaaacaaaaaatacaaaagataaatgaaacaaaaactggttatttgaagagataaacaaaattgacagaccgttagtgagattaaccaagaaaaaaagggagacgatccaaataagctcaattagaaatgaaatgggaaatattacaaccaataccacagaaatatgaaagatattcaaggctactatgaacacccttatgcacacagactagaaaatctagaagagatggataaattcctggaaaataagttattatttgaaaaagacacttgtatggccgggcacggtggctcatgcctgtaatcccagcactttgggaggataagcgggcggatcatctgaggttaggagttcaagaccagcctggccaacatgttgaaactccatctctactaaaaatacaaaattagctggacatggtggtgcatgcctgtaatccccgctactctggaggctgaggcaggagaatcgcttgaacccaggaggtggaggttgcagtgagccaagattgcaccattgcactccagcctgggcaacaagagcgaaattctgtctcaaaaaaaaaaaaaaaaaaaaaaagaagaaaagaaaaagacacttgcacacatgtttatagcagtacaatttgcaattgcaaaaatatgcaaacagtataaatatacatcaaccaatgagtgaataaagaaaacgttatttttttatttttagacggaatttcgcttttgttgcccaggctggagtgcaatggtatgatctaggtttaccgcaacctctgcctcctgggttcaagtgattctcttgcctcagcctcccgagtagctgggattacaggcatgtaccaccacgtccagctaattttgtatttttagtagagacagggtttctccatgttggtcaggctggtctcgaactcctgacctcagatgatctgcctaccttggcctcccaaagtgctgggattatgggcatcagccactgcacccagccaaaaatgtgattttatatatatatatataatatacaccatgaaatactactcagacctaaaaaggaataaaataatggaatttgcagcaacctggatggagttggcctcgtttactactctgggtttctgtctgaggatgagggtgatgattgctgatcaggatgcggaaggaacccagtgctaacccacagcatctgccccacagggaaataaggcacaagtctcttgtttgatcccacgctatgacctctagacctactcttccctcttgtcaccaaaaccacaatcaggaaaaatttctgcaggcatttcaccatcctggaacaaggatctgagactcttcactgaatttgtgaccttctatccagccaatatttatactgagctattaagattaacatcttagcctggtcattgccacacaggcaggcaaggcagctcaggtggaaaatacttttggtcatcccatgtgtctgggcatatggccttgatgtgagtttatgttcatgctcaggacaagttatgggtcaggggactagtcagcttatgggccaggaaaaggtgctaaggtttgtggagtcaaagagggaattcacacatattaatgctccttgtttccacctaaggcagtttgtgaagtctgtgggttctgtgactgtccacaaatggagcaggaacattccttagaacggatgattgggaccccacaaaggaaaagacaagaggaagcacaggctacacaatgaaaatacacttggtcatgccaaaggctaggtcatgccaaaggctaatgaaagagctttgagtataattcagtgcctttggggttgagtggaaaatacaaaaaccatctttgccctgctctcacaccacaacaatcaacacgtttccatgaccaaatgtgtaggatttctccccaccccctagaaagcaagccattggttttgcagcggacaccacacaggtgccctctcattgaatgcaattctgacactatccacatggagacagggtcagatcttacagtttgagggctacttccccaagactgtgccccactacttacgccaatcccaagcctcagattgctttacctgtgcttctgtccaaatagctgtaagttgaagatttcacaacatctccttggcttctattaatttgctagaatggctcacagagctcagtagacacttacaggtttattaaaaaggatacaaccaagcatatagatgaagacatgcatagcacaaggtatgggaagtggtgcaccaccgtccagtaatcttcatgtgttcagccttccagaagttctcccagcctagctccatttgggttattttatggacgcttcctcaccgaggctttatggagtaaaccactgcccattggtgaataatcggcagcccctctcccctccacagaggttgggagatgaggctgaaagtcccatccctctaacactgccttggtctttcttgtgacctgcccccatcctgaagttacctagggactgtcagccaacagtcatctcattagcatacaaaaagactctggtgattttaagtattttaggagttgtataacaagaaatggggtcaaagaccaaaaccataatttataataacacagggatgaaaaagaaagtagaggttgatgatttcaagcccacactagtcctcattatgacagatgtggatttccaacccataagaggcaggaggctgaagagctgagacgaaacctgtgaaaagcagggacaggggacatttctcaatttcttgttactgaagtgatagagctccaccaggcctcacttggattgacaaactaaattaaaagatacactctttaaataaaaagcacttctgagcatacatccaaaagaatgaaaatcaggatattgcagaaatatttgcacatttttattcatgcagcattaatcacaatttcaaagacatggagacagcataaggtccactaatcattgaatgtttacagaaaatgtggtgtatagctgcaatggatgctgttcaaattcaagaagaattaggccgggcacggtggctcccgcctgtaatcccggcactttgggaggccaaggcgggcggatcacaaggtcaggagttcaagaccagcctgaccaatatggtgaaaccccgcccctactaaaaataccaaaattaactgggtgtggtggcagaagcctgtaattctagatactcaggaggctgaggcaggagaatctcttgaatccgggaggcagaggttgcagtgagctgagattgcgccactgcactccagcctgggtgacagagtgagactctgtctctcaaaaaaaaaagaataattaaattttgccatatgcagcaacagggaaaaccctggaggatattacactgagtgaaataagccaatcttagaaggggaaatgctgcacggcctcatttatatgaggtatctaatttttttttttcgagacagagttttgctcttgtcacccaggttggagtgcaatggcgcgatctcagctcattgcaacctccgcctcccgggttcaagcgattctcctgcctcagcctcctgagtagctggtattacaagtgcctgccaccacacctggctaatttttgtatttttagtagagacacagtttcaccatgttggccaagctggtctcgaactcctgacctcaggtgatccgcctgcctcgacctcccaaagtgctgggattacaggcatgagccaccacgtccggcctataggaggtgtctaatatactcaaccgagcagaaatggagtagaatgctggttgccaggggtagggagagaaggaaatggggagtcactgctcaagggctatgaagctttaggtttgcaaaatgaacaagttctagagatgtgctgtacaacactgtgcttacagctgacaacactgtattatgtacttaaaattttattcagagggtatatcacacattaaacgttcttattaacatgaaaaagggatagaaaataccatgaaaccacttacagaaagcaagtatggcaatcctctgtcctttgtcttgggagaaagttttggccaagagacaatttaggcaaaaaagagaatttactgaagaaaaacagagagcaaatagtttatttagagagacagtgtactctggaagataaggcagagcgggctgctgatagagaatgagccagcggcccgagaaatgtgcactgagtttttatgatattgcactttttcttggagttcccacctctgttttaagtctccacctttttttctttctctagtttttctgcttcagccttaagtccctgccttttccccacatagtttccagcccaggctgtgggaccctcccttaacacacacatgggcccagtgtttgataggaattctacctaatggctgcattgctcattactgccaccccaggaaggttgtatggtggtcaaatctatacttactgtacctgcatctctcttagaaatttctcctttgctctcacccctattatcagcatgcagctagctacattctgacaggttaacttcagagtgagtgaatactgggtgtcttaaggggctttgttctggcataggtatttaccctaatctctgttcgtatctagcatgtgtgctttgggtggtctctggggtgtgagattttccagaactcccttttctcaggggctgcccctcctgcttctgtctagctatctgcctactctaaagttagtattagtatgaaagcttttatgaaaaacatttttttccaagaaaagggaggcattttatactggtgaaataaggtgttcaatgacaacacataacaactgtaaattgtatgcacctaataaaatagctttaaagtatttgaagcaaaactgtctcttttagcagaattaaaaagagaaataatcaatccataatcatatacacagatattaatacaactctcttattaactgagtgaatgacatggagaaaaaagagtatacatacaaatacgtgaaaaccatgattaacaaaatcaatccagtgacaccaggaacccaagcctgaagggtagttgcttgagtatgcattcatggatgaacgcatccaatgaatcatcacaggaacaaacaattgaggccttcgtttatgtatttctaactgatgttaagtttttccttcctattctgtgagtagaggtggatccctgtggaaggagctgcccgggtctttgctccagaagctgtctgcattctcccctcactgtagcctcgtcacattaggccattgttatatttcccatatgtccttcttctagtaatccaggagccctcaatgaaaaggctgtttattaataccagtagctcaggacagagcaggggcatggctcatggatggtttggaccaggcccttagatgactgcactcacatgattcccactgagactgcagtctggccagtgagcagcaggggcactgtgggtctgtctcacggtctgcacagtggctattcatagctgtgccaacccctaaattccccagggctgggcagtggagcctgcactcactgaagccgactcagctgctgcatcttctctgggtgtggttccagcacccacttcctcccaggtcctgccagactctctcatccaccagtccccaggtcttgaataaatgcatagagtggggtgggggcaggcagtgggtgggacacatttgcatccataacccttcctctgtgaggccagtggaggggataagagaggcctagggcagccactccagctctggacctcgggagggctgtgtccaccatggccggggcccctgctcctccctgctgctcccctctcacttatcaggtagggacaggcctcagattcctgggaaagcctcccagtctgagttcttgccccgtgttccactctcacatttcatccctgcttactcacccatgagcatttgtgtttgcaggttccccccacctcggcctgttctgactcagccaccctccctctctgcatctctgggaaattctgaggctcacatttaccctgagctgtggcttcactgctggtggctagcacatatcctgctaccagtagcatctagggagtgctctctagtatctcctgagagatgatatatctccagtgggatagatatctcaagagtgggctcctgataaaaggataaagttcaaccctatttactcattttcacactcttctttgccctttttctctgagataatgcagcagaaagacccttgccagatttcagcatctgcttgtggacttctaaggtcacagaaatctcaaccaaataaacttttagtctcagtaagttacccaatatatggtattctattgtatcagaagaaaatggagaaaatggactaggacagcacgtgtagaacagtctgctaatctgactcaagtaagcaccatggctccagggtccccggtcacttttctaaatctaaagatgcctcagccaatgcagtaattctgcacatctctgggctgcagccagaggatgaggctactacatatctcagcagccatggcacttccacagtgctccagacccccagggaagtgagactaggacctcccctgtgttctctctgcctggtgcaatcaccactgtcctgcctgggaccaactctggctcagggattgattcctgttgttactttttcagccagtgtctaattttcctaggatatatagatgtaaaatgtgtttttttcttaaaatgttaatttgatatatttttcatatcttttccccttatgatgcctacagtggagtaggtcagttcttagagctaagtttccctccaggaagattacagaagaggaaggagatgaataacctacacgtgctgtcctagtccatttcccccattttcttctgatataatagaatatcatatgttgggtaacttactgagactaaaagtttatttggttgagatttccgtggccttagaagtccacaagcagatgctgaaatttggcaagggtctttctgctgcattatctcagggaaaaagggcaaagaagagtgtgaaaatgagtaaatagggttgaactttatccttttatcaggagcccactcttgagatatctatcccattgccaggataagggcactaatccattcatgatggtggaaccctcatgacctaatcacctcttaaaggtcctgcctccaattacttttaccatgataattaaattctaccatgagttttggaggggatattcaaaccatacacatgtcccaaactagggcctagacctgacttagagatgtgtgtggtctgagaacttctgatcagctggttggtccagcatgccccaaccccagctccactgaccagctccaggagtgagtgaggtcaccttcctcacaactgctcattccagcctgtctctgaactgttcactcctcttgaggttcagaggatgcaggtctttgtggttccagggatgttgggcaaacagtcttttccacagtggaatatgactgtgcttgtgacttcgcagtgtgcagaggacactcagcacctgcctctcccccccgactttgtcaggcccatgattatcaccctctccttcatcccaagttcatctgatacgcatgccaagatttcagtgaggctggggacacataaggatgatgatactaaaatgaacaagttccatttcataatagtggcagaagatcagagatctgtaggggagttgtgcccccactctgagtatttaggaagcaactctagggacatcttgctctgcttctcccttctctgcacaggtgaaagaaggagcctgtgcagacaatcgttcattagaagctcctgccttcttcctcttttccaccccctaggactggatggggcctttgtaatggcttcaaattatagtgagagtcaaacaagacaattggtcaatgactccaacatccctctcagggctgcctgacatgagacaggatggattgcatctgatacacccccacccttctttcttatcggtatattaggtttttcttattgatgtgaacacactctatattacacaaaataagttatatttatatttcaaacctgtgatggtgatttttaaattatagtaaaaatatacatataaaatttaccatcttaatcattttaggtgtacagatcataagtattaactatattcacattgctgtgcaacagatctgcagaaattatccatcttgcaaaactgtagctattgaataacagctccccattttcctgcctcttgtggtggttttaaatacaatgcaatacatactagctgaaaatggaaaaaagaagtatatgaaaatgttaaatgcatagcacaaaaaatgaataatagggtcactttggttataactttaaatgagaaaactcaaagtaaaacaacaatctatgatatatcatataaaatgcacaatttaaaatttttaaaatttaatattaacaaaaatatatgtaatacaccacataagtattcaataaaactgaatacaattatgtttaatttttttaaactgtgaaaaagatcctattaacttttgaatatttacgcaaggaaaccaagtacatctcttcttgaaaaagtttgattccaattttttttttctttttttttttttgagacagagtcttgctctatcacccaggctggagtacagtggcgtgatatcagctcactgcaagctccgcctcccgggttcacgccattctcctgcctcagcctcccgagtagctgggactataggcgcccgccactgtgcccagctaattttcttttgtatttttagtagagacggggtttcaccgtggtcttgatctcttgacctcgtgatctgcccgcctcggcctcccaaagtgccaggattacaggcgtgagccaccacgcccagccagtttgattccaattttaacagacaggtgtttttgacaaccagtttattttcttactgaaattttctttttctttttttaaaaaattttaaatctttaatttccgttttcacttattttcttcttgcttccaaaaggaaaggagtgcgtagctctgttgcctgtacatcgtccacagcccctggctcggggcagggtcccctaggccgcccgggggtccacatgcagcccctggggggccggcgcggggtgaggtccggccggttggggccgccgctaggcgcgctggctgggcagctcctgggagatgaagcgacgcaggcgctccaggtactggctgtagagctcgatgtcgttgtgtccggcgccctccacccacagcggctccaccgccttggggcagcgctcgtagagcgccagcccgtgtgagaagtcgatcacctcgtcctctatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgaggcgcgcgcacccttcccaccagcgggcgtccccgggcccagctccggatgcgaccctctagtctccccactcagccaagtcagtgggtcaggcccaggctccacaccagtcccgagggccacccccagcccccaacaccgcggcggtgggcgaggccagcggccccgccccgttccctggcgctgccgttcactggcgtttcctagcaaggatctgcagggatcccgcctacggagtgcccctggggcaggggtaggggaggccctggcgcctgttctcctcctggtcacccctaggtgcacactgggaactgtgtgccccccacatcctgaatgcttcaggcctccctgcccgggttagaaagccgttcctggtgcactggccaggacagcggacactcttccttcctgcagcccttgcccacccccttggccatgaggaattcaggcagctgtgtccccagatgtctccacccaattttggactctcggagtccccacgcccaatgagatgccagtgcaacccaggtcagcatcgaaggtggtggctgcggaggtggcaccccctcccaccagcaccttcccttgggagtggacaagtcctcggccacctcagcaccaccagctcccacccagggccacccccacccccaggtcattggtgtgcggcccttgacccagctgatccagcaccagttacaaggcctcctcgtacccagtcccaaccacgcgggacccacctgccaccctgcccatgccaggaccccacaactctcctcccacacgctccaggctctgatcccaggcagacaccctcttgcaaggcaggagcatgggcaggtgtgcgtcccctctgcctggcattcggactccaccagcagggctgtccccgtccctggcctggaatcccagcctcctggcagcactccacagctcgccactcacccatgccccaaaggatgctgcctggctggtacctgtggccccagctctgcctcggcctccctggcctgctccctggcagccatggtcagtagtgtgctgagccagcccagccctgtcacctgctacaggcaggagcccccagctgccacctggatgtccccactcaaatgaacgggacacatccccagtggaggccctgggcacgctctggcctccccctcacagctctgggcctaggttcctgcaggacaaagtggcagcaggacagatggccgagcagacgagctcagagctggccatggcgggtgtgactctgccagtggcccaggcagtagagacaggaggggccgaggaagtcgcatgaagtggtacttggtgtcagcgccccacactgctgggaggcccccagagccagggtggtgccaggggaccagctcccaggcccacagcagggaccgcctgcaatatcaccaaggcaacgaggaccccacctccccagggcctctgacttctcagagttgtgcctggtcccctgtgggagcaggtcagaccagtgggctgggcagggccaggatgagacagccccagtggatggcgagcaggaaaggccgccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgccttggcagatgggctcccagccacacgtgcacagacccccagaccaccacccactccctcccaccgggtggcatccacgcccctgtgacaagctcagccccttcccgtcctcaggccaggggttccagggagcctggctccacaggccagggtgtgggaggaccgcctggccacacctcagccatgtggaggtggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgtgcagggcctgccaggcggcgtcgatgtcggcatagaggttcctctcggaaggcctgcccgcgctggcaccgtagccggagtagtcgtagaagatgttgcaatggaggcgggagcccaggccaatgtagaagctgctcatctggctcaggtccacggcgttgccgtgcgagaagaagaccgtgtacctggcaccaggcacgcagcgaacatacatgcaggagacgcggttgccgcgggcgctcttggtggggaagacctcgatggtgtccagctcgcgctggctgtactggaagtcggcgcgctccgtcaggtgcagcttccagcgcccaggtgcgcccgaggaggcccgcagggtccccgagggggcggccccggccccaccaggccccggctcaggctcaggcaccaggaaggcgagcttggcagcgatgcggccggggcagggcgggcagcaaaggcagcagagctcactcagcgacagcccattcatggcgggcgccgcccgggccgggcctccaccggggcccccgccaacaacgccgcctggcctggcccggcaggggaagcgtgggggtgctccgagtcgcgggcaggggggagagcgcccccccagctaccgccccagacggcagccccgttaggaggccagggcccagccccatcgcggtccaagccgagccccagggagcctcgcaaccacaggtctccatgtcgtgccctgggaagcccatcccggcccgcgcccccgggccccagggccgcgctccatggctcccggccgcccgcccgtgcatccgtcggtccctctgcgccccggcccggcctcctgcaccgccaccgccgcagctcccccacggacggaagtgagtttactgaaattttcaagccacagaaagaacaaaagaagtaatatccattatattgtccaaaacaatagtacctggaagatctggaggcaaaaatgaagcctgagaatagcaggacatagacatatttcataacatagactcacagcagaataatggttatgttggttcattagggaagaaaacactaaacagctcttgcagatacactcaatatacagtaagatagcttgtgattttaacgagttagcaaagcagaacaatgaggcaaaagcaaacagaaacactaaaagaaatccattccctagaatcatttttaaagactttgctagatttaccaaagaattcagtattgacttattctgtctccattttatttcataatggaacccgtctaattttatgctaaatgtatgctgtaaggacaccttgctactctgaaaaaataagggatcagtggataaaagaccatattttattaaaaaaagagtgtgttttgatgcatgattttgtgactctacatttttaagtaaggatgaagaacttggtgattaattaaatgattcctcagttgctcatcaatgccatcagatgccttgaatatactgtgaggacagcatctggaagaaatggaggagatctgagtaataattcagatggagccaatttccacaatcttattttcccattacctgcagctctgaatttaactaagtctctgtgttaacaacttgtattgtttatctgggtgaatgacctcagaagacaccaggcagctggatgcctgcacttctttcgtgctaatggttcatatagtctcctcacccccaacactttgatacttccttgaaactggattacatatgagatagaaacaaagaatgcaggtggcataatgactctcaggagtcactgaatctgtgttcatgatgcattactgtgccagctgcctccctcttcttgtgaaggcccttctttattccttgagatgtgctcatcatgaaatagctacaagcatatcatctgcttgccttgcccgttatagcaaccatgaaaataaatttgcagcatcatatatagcccaaatattctcgaaagatgatcctaatagctctaataacaaaataagttttctacagagtagctatatgtacatgctctcagcttatgtaaacttgtgtttttattgctcttaaagcaaaatttttcctaaaattgagaaaagaactaaagttctttgtcattatatgaagaaagatacagcatctaatattgtgaacttctctattttgagatgttttcagacatcaagactggataataggctgggcacggtggctcacgcctgtaatcccagcactttgggaggccgaggcaggcggatcacgacgtcaggagattgagaccatcctggttaacatggtgaaaccccgtctctactaaaaatacaaaaaaattagccgggtgtagtggtgggtgcctgtagtcccagctacttgggaggctgaggcaggagaatggcgtcaactcgggaggtggaggttgcagtgagccgagatcacgccactgctctccagcctgggcgacagagcaagactccgtctcaaaaaaaaaaaaaaagactggataataaaattatttaacaattcggaacataaatttagaattgaaaaaagctttatactatactatactatactatactatactatactatactatactactaacacattttgtttgagcatggttgccttataagtttttggtagttcaatgaaaataatggctacttgtgagaaaactgaaatagactaggacatagtagatagagatagaaagaacaggtaaattaactgtctatgccacatggcaaagaaagtttacagtacgtagtcattaaacgtacatgcttataaatatataaccaatgatgaataattttaaatgcaatttagcagaattcagaccgttttatattaaacatatatttctgaatgaaatataaaatctattgaatgagggagacactttatatgtgtaattaatctcataaatagagaagacttttacaatagtttgtacactttagctataaactgtaattcaagagattcagtaagagtagctttttgtaacttaaatattctatattttccctgcatacatttttgcctttgatcatgtattttatttagcctgctaagatggtagagaaggtacagacagtaagcttttcaacctgacacataaattcaggttatttgaaaatggaatggtaaagtgttactgaagaacttttactatggttcgcatttggtaatatttcctaattattctataaacaaaatccaaaaaaaccttgatttcataacataaacttctgaggtctaaattaatcaataaaataaatttgttttaattaattattagattaaattatttatttaaataattatttaaataattatttaaataattaaattaattattagattaaatactagctgaggctcattagaggtaaactagagaattatcatcccattaagataaattttgattcagggaagtaacatcttggaagtttactaaatttaaatttaggaggaatttactaaatcaagtaccaagattttatttctgcaccaaatggaagacatatgtaaaatttaaatacattccattacttaatttactctttactatcatgagaattagtatagacagcatattttacacagagcatacaaagccttatcttcattgaattacaagtaaaatatatgtatgtacatataattatatatgtaatttagatattaaatgacagaatttacttatttacctgtgtgtgatggaatttgattctagtaattattccaggtacagtaactggttgaaaatgggacatgaagtaaactgatatgcttacaagtaattacagcaagcgaattcattgtaatgtctccaagcaaagcaagactacccacatgagataagaaatgagaggctacttattttgaccaagttagctcggtgacttggggaccaaggactacatgcacatggatgcttcttttgtacccctacccctgccaaaaaatatgtttccatggcaatatttgggaacccattatttcccaattgatgcttttactttcatataagacaacagttgatactccaaaatcaacttacattttaattaaccaaatacaatgttcctaaagacaaagagaaacatttcataacaataagagttaagccaacagaaagatagggagtatgaaaaaacagagaaaatcaataaaccaaaattaaatgcttgaaaagacaacacaattggcaaatgtttatttaggctaagcaagaaaaaagcagaagagactcaagtttctaaaatcagcaataaaagagaatccatcactgctagtaatacaaaataaaaataaaagacaatgcaatgaaaatcttatgctaaaaaaattagatagcctagatagaatgaagtcctagaaagacacaaactaaaacagactaaaggactaaggagcaatagaaaatctaaatagacctacaaaaggtaaaaagattggattgtaattttaagaacttataataaaattcccatctcaggtagctatcactctgagaaattaatatcaattgttcaccaactcttgcagaaaataaaaggggagagaacacttcccaattcatcttataaagccaggattactctgacaccaaagctatatcacaaaacaatatataacagtatctttcttttttttttttttcagatggagtctcactctgtcgccaaagctggaatgcagtggcccaatctcggctcactgcaacctgtttcctgggttcaagtgattctcctgcctcagcctcccaagtagctgggattacaggtgtctgccaccacgtccggctaatttttgtatttttagtagagatggggtttcatgttggccagactggtcttgaactcctgacctcaggtgatctgccaatctctgccttccaaagtgcgatataagtgtcagccttatatcacggtgagccactgtgcctggcccattgtttaaataaaattaaaaatcttcaacaaaatactggacaaactgaatccagcaacatataaaatagattatacactatatgcagatgtgatttaccccagcaatgcaacattgatttaatatttgaaaatcaatgcatacaaaaatcgcattaatagaataaaacacaaaaatacatgagcatctcaacagaaagtatttgagaaaatattacacattttcatcataaaacactccagagttatggacaagaagataacttcctgaaactagtggtagttatctatgaaacccacagctatcattatacttaccaaggagagagtgaatgactaatcagaatgaccactcttgcaaattctccctttttcaccttcctgctctcatcaccctcttttgctcctccatcttcccaaaaacattttcccccatcttttcccaaagccttctcccctctcctgctgctcaccaccattttatccccctccacctaccccaaaacttttttctcacacccccaccatcttttcacaatgccttctctccactcctgcttaccaacctcttttccccactcctgcccctctcccatatgccactcttttttcaccctccatctaccccaaaactatttgtcttcccaaccctcctccccctcatgctcgccaccatcttttcctcctccatctacccaaaaacttttctccccactgtctttttgcaaatccttccctccctcccgcttgcccattttccccacctttaccaacctctctttactcctcccacttgccaccctcttttccccctccatctgcccaaaaactttttacccaccatcttttccccaccctgttttcacaaaaccttttctccctcctgctcagccccccgtttttccctctcctatttgccaacctcatttccccctccatctacccaaaaacgtttttttttcccaccgtctttttcctattgcctttttgcaatgccttctcctgcttgccatcctcttttcccgttggtactcaccaccctgttttcctcctccatcgaccccaaaactattttccccctcttaccactccggtcgcactgcagtcgccatctcggccaccacccacagtgaggcgagccgcggtgccgcaggctgcagcctccagcatttggcaggtgtcttccttccccttctcctctgcctttaagttgggcacagaagagctgtgtaggcaaacaggaaagaacccgggatggtctgactcccccacctcagcatactttatatgcggagttatgcaaatgagttctgggactacatgttctgattggatgagagaaaaacctctaggcatacttagattggactttgttatcatgttctgactggatgagagcaagtcttaaaacgaccaatcagaacatgataataaagtccaatcagagtaggcctagaggtttttctctcatccaatcagaacatgcagttcaggaattcatttgcataccctccctgtataaagcatgttgagtgggcagagtcagggtcttccgtatattctccccgcaccatccgtgctcggcttagtgcaggaagaggagaagaacgggaagacaaccgcggcacagcagcttacgtgctgatgttggctgtggtgatggagcctgctaccggagccacagtggcccacagcgggagcatggccagagtggtggaaagacagtggggcaggtatgctatcagagctgcgctgcccgcggtgagggcagattgggggcgctatctggggttgcattgcctaggtgggttctgtgcagtatcggggactacgttacttgcggaggtggaacaggggaagggggtggggtgggggggacactattgaggatgggattaggtgtgctatcgggggccgtgctgatcatcaaggcagcttaggtgtgctatcggggcaggggacacgctgctccgagttgggggatgttacaggggctacactgcctgtggctggcaggggttaggggcactatctggggctgcacagccggtagtgggtggcgtgttagggacgctataagctactgtgttgtctgtgccccagggagggttaggtgtggggttgggtgtgctatcggaggctacagtgctagcagacaggttaggggcactgttgggtgttgcaccgcttgtgccaaggggtatgtttggtgtgctatttggggctacaaggggcaggttgggagcactgtcgggtgctgcactgcccatggcaaggggtgggttgggtgcactatcaggggctacactgcccagggcggggcgggcggggggggcgtgctatcctgggcttcactgcccatggcggggggctggttggggacgctgtcataggttgcattggggtggtagggggcgggttcggtgtggtattgggggctgcattgccagcagtgtgggggggggggtggttgggggcactgtcaggagcttgcgctgtcaagctagtagcaggttaggtgtgctattgggggctgcactgcccgaggtaggggggcggattaggtgcgctattgggggctaaactgcccacagctggcggggtttgggggctctgttggggggttgcagtgtcagaggcgggttaggggcattatcagctgctgcactacccgtggcaggaatcaggttgggggcactatcgggtgctgcaatgcctgtggtggggacgggttgtgggcattatcgggtgctacactgctggcggtggagtggttgggggtgctatcggggtcacactgtcagcggcgggggacaggttaggggtgctatcggatgctacactgtggtggagggcagggggtggggtgttgagagcgctatttgaggactacattgctggcagcggggggcggattaggggcactctcagggctgcactgccggcagcaggcagcagaggtggcagtgacagcagtggtctccacggaaaggacagtccttccctccctggactccaggctttacaaagcgattttctcctgcttaagtacagaggacatacagtgtttccgcaggaatactgagcacggcagggccccccacatctgctgtggtttcctgggttacaccctctcgctctgtgttgtggatactgcctgggacccccaggcaccgagtaacgtgcaccacgtgggggacggtgctctctgggtggaggctcaggaatgagagcccgcacttgggtggggagagctggctgggtctgactttttgctgcttccgttcccctaggaccgcagctctggtgggcccagtggttcctgcggagtggggagccgggcactgtggtgtctccagtccccaccacaggctccgattcatggccagcttgggccgaaaggggagggtgggtgtcagtgccttcgctgaaactggcacctgccacccagtggccagcatgaccaaggtgaggctttaatgctaccactccctgcatctgttctaggtttttctggctttgcctgcccagcagtctgtgcccacctagaggagtaggaggggccaccatgccgcatgctggaggctggagcccgcagcctgcagatggcacagtactacagctcgccttgctgcggttggtggcagtgatggagactgcagctcgaccccagcgatggaggctggaggtaggagggtacctggtggtggccacgtggtaggagccttgtagggtggggctggtgcattgagagcaacagcagcagtggttgtattggcatgggcattagtggtggcagcagcagcaagtctgtgagccgggaagggggtagtaggagccctgcaaggcccagctggcctggggtgggtaagaagcagtgggtgctgcagcatgggcctcggtggcagcagtggaagtgcagccagggcaaggagtcctcccccacctttctgcagtctctggagggcgcccacctcctgctggctcctgagccaggcatgagtggcagcattgtctcattcttaacaaaatttagggaatgactatttgtgtatctttttgcttgttttttgttgtgttaatcttggacttttcgaatttcatgaatcagggagtggataaaaggtatcataataggccttctaactctatcacctgatttttttcctttcttccagtctgttttttcttatcaccatcatcttgttctttattttcttatgctgctgcctatatttctggtttctattcttgtttctctttctggtcctcctgctttttgttttctttatcccaagcaatggccttaacaaactgaaactgagttaaaagtaaactacttgctagtgtgttgtatttttaaaataattggtccattactgtgttttagagatgagaaagtagttgcataatgatttagttacttgaatagctttgctttcgtgatcctgttaatgcgttgtaagtagttatgcaaggaatgaaaaaatgaagcatcaaataaaatactgatagcaaacagtcatttcatctctctcccatatagtctggagataaatgcaagtcagggggttaataagttccaaaaatttatgagatcattaagtgaaccacattcccttcattttatttttctgccacagttttcaagagcgttgtcatttgcatgagcaaaccttgttcaccacatctttgcaacagggaagggaaggggaggatcatatgtacaatgttttaaggcaaaaaaactcacaaccaaaagcaaggctttattaactttcaccttcgagaagctgcagtgttgagccctgttttattcctagtattactgcctttgatacgaactcttaagtgatcactttagaagttaatgcattttattgactgctttcaagaaacagtctatattgtatcatgcatgtttttcaagcccgcagaattgtataaggcctatatatacatagggcctataattttgacactttttaatgatttataaggttacgatcatgtaaaatcctgttgacacgtgagaatatgcctaagtaccgctagatagcttattttgaagagatagttattttgaagagatagaaattggttgcagtttgttaggtgtatttgtcaatgcattgcctcaatgctttaaagcatatagaagtttgaatatgctttaatctcatgtagtcctttgtttatagggtgtttaatatttttaaagactaaagatgtcacagccccctttaaggttcagtaatattaagattggagatttatagggttagaatccaacaaattcagaggaaaattgttaaattatatagctgtagagcaggaaatgaaacccaggttctaagctctaaggggaccatgagctgccataccaagtgcatcagtgactgggcatagagttggcagaattacaggatggttaagagagtgagctgtagagcctcactctatgtgaacatgaattttatataagtatgtatgtatttatttattttgagatggagtctcactctgtcgcccaggctggagtgcagtggtgtgatcttggctcactgcaacctctgtctcccagattcaagcaattctcctacctcagcgtccccagtagctgggaatacaggtgcacaccaccatgtctggctaatttttgtgtttttagtagagttggggtttcaccatgttggccaggctgttctcgaattcctgacctcgtgatccacccacttcagcctcccaaagtgctgggattacaggcagccactatgcccggctgtgaacatgaatttttaaactgcatggtgctttgggtcccagcttctccatctgtacaatggggacagtactaaggttttctttttcttctcagttgactgaattatttccatagtctgtctgtcttgccactcttgttacccacacgaaaggacctaaggtaatttctgacagcctgggactccttgtgcaaaacagaaggtgccacagacctcattttaggagaaacctttgttttcctcttggaaccccaagaactgtaagcagacaggtccatctcaaaatccaaggctctgctctgttttgctttgctttacctgactttttttttgatttgggtgggcatcaaaaattagtaggggagagctaaagaaagttgtggatatgaacatgtatttatggtaaggtaagttatgaaggagagaaatcttaggatcttgtatggcaaattcttgcactaaagtagataatgactaattaggaaagcaggaaatataggacaagtcagaaagtcataagatgggagagaaaagcttacgcctggtagatcctctcctgtctagaagtgtcgtatgtgtgatgtttatatgaaggagctctaattaattggattaaaagataatgaaagctctaaaattgtcagaaaaatagaagctctaatgccttttatttcacgtgacttcagcaatctttgggaaatgagagttttaaaattattggtggtaaaaagtcttcaaaaagtagacatttggtctaaattaagtcagaggttaaattggctaagtgctttaatgtcataaactgcttctttgactttggaaaattgttcagtttacctaatttggaactgttagatttctaggtaaggcctggggagaggtggagttagccatgtctcctagctatgctggaagagttagactttatctgcagttctgtcatgtatcctggactctgcacctggtatgtaattgaaactgcttacattgaaaagaaaaattatgtgtttttggttttaaaaggggtgggaatatggttttttccaaaaagtgagttttggcaaatttagaaagtttaagaattatttttagttgtaggaaaataaagtttaagcaagttatagaaggtttatgaaaattaactttgtaaagaattgtgtgtgtgagcaagttgactaaagggacagtaatgttagatgtaataaatgcaggtacccttccactttatcttctgtttcttaggttataaatattcactacctacgtttctaaaaactctttcactataatattaacacataactccattctccttgtattgcctgctttttcatagtatcctgaaattgcattagtagatttagattcagaagatggtggggaagcatcttatgagtgttttaagtaaatttaaggcaaagggttttctgtacatgggtggttatcacagcatcacttgttgcagcaaaacactgggtaacaacaatgtttatcaatgagaaattgttcggataaatgatgatttgtgccttgcgaggctcaactattcaaaagcaccctcttttcctcacttgctttacctttggttctgggcctggagcctttcagaggttactcaggaaatggactcctgtttcctgtgactaatctggacagcggcttcctatttcattcttcagcatcttccaaaaatttctgaagataatttcttcctttgtgaccacccatactcttggtttactttgcagttaacaatttcatgccttcactagattatctgtgtgaaggtgtggggtgtatgtgttcatactctggagggagcagaggaaaatagccacagccaaaggagtaatcttgcactaaatactcattataagaatgttgatacgttcatagatggtaaatctgtcagtaatttttacttgtatgattcttggttaagactgcactcactggtgataagcgtgctgaagggatcataggtgctatacttatgtgtgggaattgcattcaaaccaccaatgcctgtctactcaagttttgttgccttttgattaaaaactcttgggaatgtttccctggcatgcaaatatgggaactgcagtttgattctaggtagaaactctttggtagttgaaatgccataataagagacacagctgtcaatgggcaacaattcactgttggtaaggaatttacagtgctacttgccatattcttctttatccagactttgtgccaagaaaatgaaattctttttaaaaatttttttctagagtaatcctacaatattgctgttatcaagcctgatgctgtaattagtagaaaatgtctagaaattaaaagaaaagtagtattttccaactatggttaaattaattgcaaaataacttcctcttaattgtcagattggagacaagcttattaagagtgaaataaaacataatgtgttgctggtgctaggtacctctaaagcctttgagcactttcttctttataaaggctcaatctactcatgtgtcctgtaaataatcctgctctaccagcatcctatgtaaattttaaaaattatagttcatatattagattgtaacaaatgttgttcttctttaattatatgcaatgcaatcttgttatagactcacattagcttgccttattccctgtatgtttgctgtaaaatgtatagtccttttcaatatatgatagcttaaagatggacttaatattttgttttagaaccaaaatcttttatcttatatacaggaaaattacattggaattcagagatcagcaaacatttcctgtaaaggatgaaatagtaactattttcaggtttgctcagcatgtggtctctgacaactaaactctgaagtcataccaaggcagcatcagtaatgtttaaatgagtgaatggcgctgtgttccaataaactttatttacagaaacaagtggtgggccacattttgactgcagggtatagtttgtggacccctgaacaatggctttttctgaaacaacacaattgaattgagatttgaaagaatgttgaggcagcattgtttgtctggggtaatacctgaggtttgtcatctcacaccagggaaatcagggatgtggacacacaagaagtgagttcaagagtggatgattaataggtgaaagaaagagaaaagagaacagctctctctcctgcagaaagagagaggggcacctgagtgggtcttccggttttgtggtgaaaagcacaaggttttataaaggagcttgaggaggtggtgtcttgatttacacagggctctagagactggttggaccaggtgtgaacgtttgcatagcacagggagaagctggccattgcaccctaatcttttattatgcagatgggttctttaccttaccaggaccatattgtctgttccttactgtacctgtggttgacagagaaaagggaagatggagccaccatgttgaacatgcctggcccacaggtagccttttcctattggcacagctgctggcattcctatgagagcttatcaatgtctgcagcccaattttacaagatgctctttgttagaaaataaatgatatgggttttttttttcattagtaggaaaactttacactaggacttccttactttcagtatctgcctaaataatttctttttaattcctacatcaatgttgcatgtgcaatagagaaggtgacatgtagggagctgtgtcagcaggggttgcatatttcttgatgagcatcccatgatgcattcttcttcacttgtggcaacattagcattaactaatctacagtaaagtagatgggtccacaggtcatgggacatacactagctctgccaattacatgttgatttaaataatatcattctctaaggacagctttttttcccccagatcctggtatgtatgtggagttggggagagacaccaaactgtaccccatttcctcatacattgcttatacttttagaagtgtttgaaagataatatcacatactagtagtttactgtttcttattcaagttagttttaatagtcgctagggtgaatgttttcaaaattgtatagatattcgggttgaggcaatactataaattatgagttcatctcagtttttttgtgctagcgtaatgacatttcggagacataatgcatatgtgcaaaatacttcacctctctggaaaacagtaaagggctacataataggacagacaaaaataaaggcttggcgtaatggctcacacctatgatcccagcactttgggaggacaaggcgggtggattgcttgagctcaacagttcaagaccagcatgggcaacatggcgaaacccatgtttacaaaaacgataaaaataagccgggcgtggtggcatgtgtttgcagtctgagatacttgggggactgaggcaggagaatcgcttgagcctgggaggtcaagggtatagtgagccgagatcgtgccactgcactccatccagcctggataacagagtgagaccctgtctcaaaataagtaaaaatttataaaacaaagaatgtttctaactgtaataaaggagaagtgatcaagcttaagtgtagcttagatttaatctttgatttccgggtactatattacttaaaaatatgatttggatatttagaagttgttcaaattagaaactcaggagtggggtcactggtcactaaggtgctgaatatttttaataccttagtggatatgtaatcaacaaagccaacggaaccaatagagcatttgctttcataagaatttaagtgttgctgggtactcttaaatcgagctcacattattggtgtcatttaatataattactgaatttctttgaacccagtttccactttttaaaaattatttagctcattaggctgaaaacttctctttgttacattttattacacttcagtgtaatatgtgtaagatgtacattgcttctctctagaaaggtgagacaagttgaagcagggttgggggtgggtgcttccagttcataggtaaataggagacaaacggttgcattcttttgagtttctgattatcctttcactgaatacacaatttacatgcaagatgccatagaggaatagtcacttatgcctgagtctggcttagtgaatctgcatttttacataaaaaactgggcagagaaagccaatcagatacacatttgtctcaggtgaggagagggatgactttgggttctgtcctttgtcccccacctgtaaagataatctatcaattgccaatttatattgccagggtcaaattcaacagaactgttttagtgtaaagatcttgaggcccacaagaaatttcctttctgacaaattatgagggaggtatatagctttcgaaatctttgtagttatttttttattttattatttgggttttttttttctttattgacaaataattgtatatactcacagggacatagtgatgtttcaatacagaaaagttatagtgagcagagcaggataatttcatatcctttgttaaaggaaaataaatctccgggacaccccactaagccaaataatagttatcttatttagaaataaaatgggaggcaggtttgtttgatggagttcctagctgaggtgggagaattgcttgaacctgggaggccgaggttgcagtgagccgagatcgcgccattgcactccagcctgggcaacaagagcgaaactctgtctcaaacaaacaaagactatagaaaagctatttgtgaaaatgctttttgatgtgctgttttatgtcacagaatgcaacctgtgttttgattcagcaagttcaaaacactctttttgtggaatctaagaattgattattttgatcctattgagctttcataagaaaatatgaatatccagttgtaaaaactagaaataagctataagctatctgtggaatgctttgtgaggtgctgttttatatcataaaattgaacttgtgttttgattgaacaagttgaaattactcattttgtagaatctaagaagtaacgttttggaacttcttgagcccttattaaaaaatagaaatattcagtcctaaaaactagaaacaagccatccgtgcaaatgcattgtgatgttctgttttgtatcataaagttgaacctgtgtgttgattaaacaggttctgaacacttttttttgtagaatttatgaagtggcatttctgagcctattgagcccttatacaaacatacagttttaaaagctagaaacaagctatctgtcaaaatgctttgggatgtgctattttatgtcacggaatgaaacctgtgttttaattcaataggttcaacacattcttttggtagaatctgagaagtgacattcccaaacctctgaggcctttaaaagaaaatacgaatattttcctctaaaaactagaaacaagcaatgcgtggaaacgctttctgatctgttagtgtcacagattggaaactttgttttgattgagcaagttcaacgcactctttgtaggatctaagtagtgacatttccaaacctattgagcccttataagaaaatatgaatatttagtcctaacatgctatctgtgaaaatgctttttttttttttttttggcacagagtcttgctgtgttgccaagctggagtgcagtggtgtgatctcggctcactgcaacttctgcctcctgggttcaagcaagtctcctacgttagcctccctagcagctgggactacaggcgtgcaccaccacgcccagctaatttttgtatttttagtagagatgtggtttcaccatgttggccaggatggtcttgatctgttgacctcgtgatccgcctgcctcagcctcccaaagtgctgggattacagacgtgagccaccatgcctgactgaaaatactttttgctatgctgtttcataacacagaattaaacctgtgtttttgtgagacaggttccaaacactctttttgtagaatctaaaaaagtgatgtatccaaaccttttgagccataataagaaaacatgaatatttagccctaactgctggaaacaagctatctgtcaacacactttgtgatgtgatgctttatatcacagaaatgaacttatgttttgatgaaacagattcaaaacactattgtagaatcttaagaagtgacatttctgagcctattgtgaccttataggaacatacaaacatccagtcctaaagtctacaaacaagctatcttggaaaacactttttgacgtgcagttttataacacagaattgaacctgcattttgataaaaacacgttcccaactctctttttgtagaatctaagaagtgacatttcgaatctattgagcatttacagtaacgtatgaatatcttgtaataaaaactagaaacaagctatctgtaaaaacactttgtgatgtgctattttatgtcacagaatggaacctgtgttttgtttcagcaagttctgaactctttgtagaatctaagaagtgacgtttttgaccttattgagcccttataagaaaatacaaatatccagctataaaaactagaaacaagctatcagcgaaaacactttttgctgtttcatatcacaaaattgaacctgtatactgattaaacagtttccaaacactttttttgtagactcttaagaagtgatgtttctaaggcagtgaggccttatgggaacatatacataatccagtcctaaaaactagaaacaagctatctgtgataaccatttgtgatatgctgttttatgtcagagaatggtacctgtgttttgattcaacaactgtgagacactctttttgtataatctaagaagtgatgtcaccaaacctattgagttttataaaaaatatgaataaccctaaaaacgagaaacaagctatctgtcgaaaatgctttgtgatgtatttttttatatcaaataatggaaccagagttttgatgaaacagcttccaaacactctttctgtagaatctaagaagtgacatttccaagtcaattgagttcttacaaaaaaaatgcaaaatccagtcccaaaaaactagaaacaagctacctgtaaaaatgctttgggacatgcagttttatgtcacagaacggttcctgtgttgattcaacaagttcaaaacactcttgatgtagaatctaagaagtgctgtttccaaacctattgaacttttattaaaaaagtaaaaatatccatccccaaaaactagaaacaagttatctctgaagatgctttgtgacgtgatgttttatgtcacaaaatggaaactacgttttgatttagcaagttctaaacactttttctagaatataaaaagtgacatttctgagcttattgagctcttagacgaacatacaagtatccactcctaaaaatgagaagaaaaacctatctctgaaaatgcaatgttatgtgctattttacatcacagaatgaattttcaaacactctttctgtagaatctaagaagtgaaatttccaaacctgttaagcccttataggaacatatggatattcagtcttaaaaactagaaacaagctatatgtgaaaatgcattgtgaagtgctgttttatgtcacagactggtccctgtgttttgattcaccaaagttgaaacactcttttggtagaatgtaagaagtgatgtttccaaacctattgagcttctataagaaaatatgaatatccagccctaaaaactagaaataagatatctgtgaaaacactttgtgatgtgctgttttatgtcacagaatggaacctgtgttttgagttgacaagttccaaacactctttttgtagaatctaacaaagtgacatttccaatcttactgagcccttataggaagatgtgaatatccagtcctaaaaatgagaaaaaaagctatgaaattgcattgtgacatgttgctttatgtcacaaaatggaatctttgtttttattcaacactttcaaaactttttgtagaatgtaagaagtgacattttcaaacctattgagcccttataagaaaatgcaaatatttagtcataaatattagaagctctctgtgaaaatgctttgtgatgtgctgttttatatcacagaattgaacctgcattttgatgaaacagcttccactcacttttttatacaatctaaaaggtgacatttcctagcctcttgagcccttattggagcatatggatatcctgtcttaagaactagaaacaagctagctgagaacatgctttatgacatgctgttttatgtaacagaatggaacctgtgtttttagtcaacaagttccagacactctttttgtagaatcttaggaagtgacattttctatttttattgagcccttataataaaatattaatatttagtcctaaatattaggaaaaaacctacctgtgaaaacgctttgtgatgtggtttcatatcacagaattgaacctgtgttttgacaaagcaactttcaaacactgtagaatctaagaagtgacattactgagcctattgagcttttataggaacatacaaatatccagttccaaaaactagaaacaagctcttggtgaaaacgctttgtgacatgctgttttatgtcataaaaatggaacctgccttttgatgaaacagcttccaaacaggtttttttttagaatctaatagttgacatttctggccctattgagcccttatagaaacatatgaatatccagttctaaaaactagaagcaagccatctgtgaaaatgctttgtgatgtgctgctttttgtcacggaataatacatatgttttgattcaacaagttcaagacactctgtagaatctaaaaagtgaagtttttgaacctattgagacttgattaaaaaatacgaatattcagccctaaaagctagaagcaagcaatctgtgaaaacactttgtggtatgctgttgtatgttatggaatggaacctgcattttgatgaaacagcttccaaaacacttttttgtagaatctaagaagtgacattttggagcctattgaacccttacaggaaaatacgaatatccaatcctaaaaactacaaacaagctatctggtaaaacgctttctgatatgctgttttatgtctcagaatggtactggggtttcaattcagcaagtttgaaactttctttttatggaatctaaaaagtgacatttgagaacctattgagccgttataaaaaattcaaatattagccataaaaattagaaacaagctagctgtgaaaacgctttgtggtgtgctgttttatgtcaaagaataatacctgtgttttgatttggcaagttcaaagcacttttttttctagaacctacgtagtgacatttacaaatctgttgatcttttataagaaaatatgaatatccagccacaaaaactaggaaaaatctgtgaaaatactttgttatttgcattttatgtcacagaatgaaacctgtgttttgatgaaacaacttccaaaccctctttttgtaaaatctaacagtgacacttatgagcctatggagcccttatagaagcactcaaatacccagttttaaaactggaaactgtctcaaaaacactttgtgaggtgcttttttatgtcacagaatgaaacgtgtgttttgagttgaacaacacacaagtttccaacactcttgaatctaagaagtgacattttcaaacttgagcccttatagaaacatacaaatatccagtcctaaaaacaagcaaaggctatctgtgaaaatgctttgtgatatgctgctttgtgtcatggaatggaatctgtgttttgattcaagtttgaaacactctgtagaatctaacaagtgatgttttgaacctattgagtcattataagaaaatgcaaatatttagccataaaaatgagaaacaagctttttgtgaaaatcctttgtgatgtgttttctatcacagaattgaacctttgttttgttgaaatagtttctaaacatacttattgcagaatctatgaagttatatttctgagcatttgagcccttataggtacacatgaatatcagattctaaaaactagaaaggagctatctttgaaaactatttgtgatgtgctgttttatgtcacaaaatgataaccatgttttgattcaaaaagtttgaaacactctgtagaatctaagaagtgacatttctgagcctattgagcccttagtaaaaaaacaaacaaaaaacgaatatccactcctaaaaaccagaaaaaagctatctggtaaaatgctttgtgttgtgctgtttcatgtgacagaatggtgcctgtgttttgattaaacaagtttgaaacactttttttttgtagaatataagtagtgatgttttagaatgaattgagcccttataagaaaatgcaaatatttaaccataaaaataagaaacaaacaacctgtgaaatcactttgtgatatcctttttttatgtcacagaatggtacctgtgttttgatttaacaaatttgaaacacactttttgtagaatctgagatgtgacatttacaaaccaatcttaagccagttagatactctgatgagccagctgtgtgtgtatgtgtgtatgtgtgtgtgatctttgattattaaaactgaaaaaataatcgtatattcatgactagtagacacagtgttttaaaactgattctgaaagatttgagggttaggcttgttttaaaaacaattgcataggtcctggaaacaccaagaattagtggcttctcattcctagtcacatgaaaaatattttactactcttgtgaatggccataaataatatgcagaattttttctgtgtcctaaccttttatataattggttctacagtgtacatcactgtgtgcaactttgttttgtgtgctcagacttacattttccagttttctccactttgatacaattggtctgtgtttcatacattttgtattttctatagcgttcctttatatgactctaccacattttattgagtctcctcatgctgacaggtaagtagatgaattaataaatgaatgaataaataaaaatgagagcaaatttcaaacaggtgattaatttagtgattgtaaccatggactcagcaggttagaaataaaaactgaaagatttagaatgcaagcaggcacatcataccttctaatagccattggaactatgacccacaaaccattagcctagaatgatgggacatatcttgtctctaaaaaaaggtcactgttcagttctcaaagaatggatataaaaatggcagataccattccacattattctacttcctttaacctctacgcataaaacttgagctgcagggaatgttacctcctgttcttaaaaagacttgtagttcagtgaggaactcactcctttcttcattcatgtgttcaaataatatagggaaatgaatggaaaagtgaagagaagttgaagactattatggggatagcacaggattagtcagcctcatggtattattgatctgccttattccacaaatatttaccaagcacctgctacatgcaatttgtatactaggtgctggggatacaggagataacaaagtccctgctgtcaatgaaaggggtcagtcctttgattcatctttagttaattttaagcacacaacaactatctcaaactttcttcacactttccaagctcccgatccttcatgcactcttggtagatgcctgaccttacctcttaccttactagaacctaagaccacctggtataaaatcccttaagcacactcagatttgcgtgattttacaatgatgtctgttcccaaagcatcctcacttctcttggagctgagggtgaagagctcctctttcttcccatccgtgatcttggaacatgtacgactacacttgtgacagtaaatgcttaatacaggcagaaggtttgttccttatttcctccctggggcctccctccagtgaatatctcttctagcattgtcagttgtatccaacagaaaagcagagatctctccattggtccaaaaacctaagatggactctcactgctaaacttctcaaatgaaaattcctccactttagtcctgattaccactcaaacactgttagactgggcaggtcactacccctgcctagttctgtttccccatctacataacagagaaataattgcgccttatctatcctacagaagtgtgaagaggtttgatgtgacagcagtgaaagcaatttaaaaagcacagagtgctatacataagaagacattttcataattattccgctctaacatgatatctgtattcatacgatctcaaagtacttacccaagcatggattctaactcttgtgtatgtaagcaaaggtgtaagtctgtcaccctccatgcaaatagaatctcccctcccttggcccctgcatctcaccatatacaggaattaactcaagatgaatcaaagttttaaatgcaagaccgcaaactatgaaaatcctttaagataacctaggccatacccttcttgacaaaggctttggcaaagcatgtgtatgtctaagtccctaaaagcaatagaaataaaaacaattattgacaagtgagacctaatacatgaaagagtggctgcacagtagaagatattaccaacagagtaaacagacagccttcacaatggaagcaaatgttcccaaactacatctgacaaaggtctaatatgtacgatctaccttaagtccttaaatcagatcaaaaagtccaattaatggttagagacatgaatacacactgctgaaaagatgtaacagccaccagtaaacatgaaaacatgctcaacctcgttaatagagaaatgcaaatcaaaagcacactggtcaaaatggtgattataacacagtccacaagaacagataccagcaggacagaggagggcactggggcaattgatcatgattcttatggatagtcatttagtgttattaatgaatttcataacaaaatgatcaccatacaaaaaatacaaaatgtgttttcttccctgagaaaggaaaataaaaacttggaatgccgattcactatgccaaaaggaaaagttaagctgaaagctgagtcatgcaagaaactgcctttctttttttttcctgagcagacagctactgataaatagttaaatttctccacaggtagctactctatgttcatctcatcttacttaaagtgctgatttactgagcaggagaaaaatatataactgactattcctttacctgtttgttttctcttgcaacatgtggattcagcaacgtgaccatactctccctcttttccccgcagcctgcttttctcttctaaacactgaaaccctaaaatatttttggagaaaggcacagacctctgtcgcccagccatgtctttaaccttggaagaagaaacttctaaattgataagagatctgtctcagacactttttcgtttacatcccgttatctcagaaagcaaaacaggctttgttccaacccaaagtaatttgtgaatattcaagcggtatcattctgatgtaaaatttacataaattcttgggtttaccaaaatgcaaatgggcaagcagatcactatttacagataatggcctaaaaaatggtaagagtaaatgctgtggagctaaatgtttctgagtctgccatttcctagttttgtagtttctctcgggcaagttacccaaagttgctgtatgttattatcttgacatttaaaatagaagtaataactttattataaataatagttaataccatagggtcattaggaaagtgtctggcatatatagtcacaacccagtgaatgccattattgtttttgctattatcagtataataattgatactaattttgatgctgaggtaaaataatatctggcagcttttaatttgctaatgttaaataactgaaaatagctttaaaaagtgaaaatatccaaatcaatgacaatatttgatttatataaaataagcttcattttttttagtttttttgctcctaattattacttcactcatcacactgatatctgagcactttttaaaacatatccacccttctcagttgtactacttattcccttttcttgtaatcccagccttcaaagatcctttctcatttttctaactcatttcacgactccctcaccttgacccccagttatatctctcttgaagtcaattccattgaattgactacttggcccaaacttcaccccaactcagtctctcttcaggaaggaaagtccccacacaaaaaggaatgtgtctttcaactcatgcgccctttttgaagaagctttccagacagcttccttacagtgatctccgttatccatcctttagatcgctgtggagtcctacaggggcgcaatgtggacagtcattcaaatgaagcacacctaagtgcttgcattttctaaaggcccattgattcatgtaactcccgtacttgcacagataagatgttcctgcctgaatgcagcagatggaaatgaaaattgtattctctgtcaaggctgattgtattacagcttaatgatttgcattttaaaacttggaagttctcataaatattaaagtgaaagaacaattggctacattattaggtaggttcggctgttcgtataacctggtgctaactatctaacctgcctgagtgagcctcagtcttcattactgcagcatttgtaagatatcaatgcctgcttgaactcatgtcttactaagattatggccaggattgagtaacatatggatataaaagcacttgacaaatcagagtatttcataaatgtaataataatatgctacatttataacatctatactcttttcctgtgtctatcttcatttaaaccttgcagtttctatcataatcaaagattttgtaatcaggttacaatgagtaggatttaacccataagcaattttcaaatttcctagatatgttttcagttttcacatttatgttggtgacaaaattctgttttcagttttggtgtttgcatcttctaaaacagtgtcttgggtacttgctctttgatgagacactgtgcagacataaagagtgtaagaaaacagaacagtttatctcagctttttgtggtctagataacctgcacactgctttcttggctcactgcaacctcctcttcctgggttcaagtgattctcctgccttggcctcccgagtagctgagactacaggcatgtgccaccacgcccagctaatttttgtatttttagtagagatggggtttcaccatgttggcccggatggtctcgatctcttgaccttgtgatccccctgccttggcctcccaaagtgctgggattacaggtgtgagccaccgtgcccggcctgcacactgctttttaataagctgatctgtcttcttgtttacataggctgtgctatagtcatttaaagttcaaaattactgctaaaaagtaattaatcctttactgaaatattcctgctatttcatgagctgtcttacaatttggaggaatctatttgtcactgatgtttaaaaaagaaagtcacagcagggaggctttagcttcattgaggaacattattataaaataaaatgatcgagggtaatttttttttgtccttgtggtactgtttctgcagatctacattaatctgagcatttaaagtaataataaatttgttatatcctctttattattcacttcaccatggtagcccctagtggtaaaaggagatgtaaattgctcagtgctcacattgcagggaattttttcctcagttgaataaaaaggagttaagcctctttggaaatgagggctatagcctgtcaataactacatatattcctgtttttaagaaatcagaattctggtgtccagtaaatgtagatgccagcattattaaaaagtgattgagcagagaaatgaattgaatttttgacccactctggcttccagctttcatgggagcctatacagggggatgatgaagagggatataagagaataaatgattgctctattaatctactttaattgatactaaaatctgacagcgaattacaagttccaggcagtaaggcttaccaattcattggtaatttcaaggttctactttgctttctttttgccttcagctccttgcaaaggacacctttttttttttttttttttttgagatggagtattgctcttgttgcccaaattggagtgtaatggcccttaacatccgcctcctgggttcaaatgattctcctgcctcagcctcctaagaagctgggattacaggcatacatcaccacgcctggctaattttgtatttttagtagagatggggtttctctatgttggtcaggctggtcttgaactcctgaccccaggtgatttgcctgcctcagcatcccccgcccaaagtgctgggattacaggtaggagccaccacacctggccaaggacagccttttatagttcagtttctcagtttatctttgactattcttaattaagcttgacctggttctccaccactgacgctattggagttgcaaagcattttgctgttataatgatagctcccttgatggctgttcattattaactggttttcaaaagtgctgcttttaactttcattttataaatatttaactcaatttttataaaatgtgcatagactatagaggttctgcttacctgtttaatacagtaaaaaaatcccttttgtaatcttatataatattaagaatgtgtccttaattcatgcttaacataaattcttacacaactagcagtatctcaaaaaataaatgatttaatagtttatgacccttatacatataattaattgtagtaaaatatcttagaaaatagaatgagtattttttataaagataaaaaatcctgatttttttttctggtcttaatataaaattaaatgtgttaaagggaacttataaattacatagtagttcattgctcaggaaaagaaatgacaaagtaattaagagtgtaaaattaaaaggattaatttttcttaaaggccgatgagttaacaacacgcatcaatctctcttccttctccaaacttcagacaaatgatggcaaagtaatttttaagaagtcaatttatagaggcaaaaaacctgaagtacagagagtaggaaagacagtaatagaattgagagcagttgacatccataacattcctattattacctccattttctggataagaatatggagaagaggaatcgttaagcaatttgctgattgtcacatattcagtaagtggcaaagttagtattgaaacccaagtagtcttgttttaaagtcatacactcaatcactgtgccataattcaataaattgtgaaggatgggaagcagatggagaagtgattgatgaagcaggactgagaaagtgctgcctatgtgcccacagtgtgaagaccctacaagacatcagaacatcatccagtgaagctgtgagcagctcaccacttggaaaaactgagtgttttggaaggcagggataaagtgcagttctgaaaagagaaaaatccatcaagttctaaacggtcgcgctctcttaccccacagtgggcaatggtctctccattcatcattttcttttccctgagtcccttgaatcttaaatatactattctgtgaattaaacatggtaaacattagactttgaccagcgctattatcagaagttcacatacctaatcaaaggacctgtaaccttcttcccctccttagtttctacaccaccagtagccaattatactatcccagctcccatcctaaaatccccttctaaaatagaaggcaaaagatcatcagtcatttgagcaaaatttcagcatgacagcatgagtagttgagacctatagtaacaactaaaatggactgggataaaacaaataatgtttggaatcaaagaacaggaaaaatacaaccgatattggagcaagaaaaaataaaaaagaatatgaaaaatagataagaaatagctattggaaaggtacaagaaatacaattttaaaaccagtggaacataagacaaaccacaaaatgagaaaattctattaataaaaggtcgggggtcggggaactgtattctttttttttttttttttttttttaagacagagtttcgttcttgttgcccaggctggagttgcaatggcgcaatctcggctcactgggcaacctccaccttctgggtttaagctattctcctgcctcagcctcccaaatagctgggattacaggcatgcgccaccacgcctggctaatttttgtatttttagtagagattgggtttcaccatgttgatcaggctggatggtcttgaacccctgacctcgggtgatcccaaagtgcagggattatgggtgtgagccaccgtgcccggccactgtatcttttaaaaatgtaattgtcatggaaggcaagaaaggtttaggaggctttccatattgaagaggactgaggagacatggcaactaattgcaatacatgattctagactgcatgcaatactggaggaaaatcatgctataaagaattgactcaattgataaaatcagaatactagcagtagattacatcaaagtatcgtatcaatgttacatttactgaatctgactaccatactatagttaagtaagagaatattcctatttttaggaaatacagaagtgtttagaggtaaagggtcatgatatatacaacttaacaaaagacttagacaaatatggggtatttaaataaaggagaatgacgtgcaatctgagaacaagaagtccaacagagaaaagcaaaaatagggagtcagcgagcaaccagtgagatgggagcagaaggatggaagggtggaggagtgacatctaaacatattaagaactcaaatatgttgattattttgtatatctgaagtttgaaattatcactgacaatcttctaaacttcaggaaaaatgaggatactgtgctacaaatgtaaacttaagaacaatatttacatagtcatcataatgtaattatgaaatactgatttcaccaaaaccaatttgatttaacacatcgagagaacagtgggaatagagtcctgtaattggtgcacctgtcctaattcctatgtaggtattataatagaaagttaataggtaatgtttaaaattgataaatcaagataacaatatcagcatgttaggttaaaaacaaggtaattaccaaaagcaccagataaaagagccaaacattgctttctctattgaacgggactacagcatagagaagtgttaagcaagctgccattattcttttgctcttattataagcctcttaatactatttgattactagctcatgagctcctatttataaaaataaaagcaaattttcgaagtcagaacaattcatgctgctacaaaatccctaaagtcatttcaacaatacagcacactgatgattatatagacatttttcttgtctgagttctttgtctagaaactttttaaaagaaacgtggtcctgtattacatgtagcatgctttggaagaaaaactatctccaatcaaaaagtttttaaaagagcccagatgttatcgtcctttgtatctctaaaagcaattgcttttataaaattaggatctactcttttttgaaatttgaatgctgaagttttgtgggtttcagcaaaagataggcataacatacatctctacattttattaaatatgatggtgcagatgttaaaaatatgtttgaaatgcagtaccttctgttcttgctttcaactcctaccctagagtaaatgaaatgctaatcacctcttgtgttagtgatagaatttgtgagtttccacagataaaatatgtttactgtaatttccaaatagttgatagccagtagcaatatcttgacttcagcaactggtatgtaagggtctatattaaagtgtttatattatgactagtataacagatggtattatttgttacagcaggtcataacactaaaaaataaaactattacacatctacaatttgatcacaaattttagtggcagtgatcacttattttatgaaagagaggcagtaattgccgaagtactgcctaaaaatgtaagacaattctcattacagggtaaggtaaaattattgacttattaaccagaaattcacatctatcccgctacaggaaaaaaagtgtacatttaatatctactacagtcagttgagttttcaaagtaatctgtcatctctaccatgaatatggggaacaggagaataactgctggatttttggcatttgacacctaatatatagaactttaaaggaggttatctattatataaataatctttgaagaagagcaatttatgtttttggacaaccaaaaaattacttgtttagcttcacaggaattttaaagcatgttttcacttattattaaacagtaacattgaatatactgctcttttatcagttctcatttttttcaacattcagtagatgactttaaagaactctcaccttcctggttttctttctaaactgagattatttcttctctcacttatgcacctattttctaatggccatgtctcaaaaaatttttattctagcgtcttttttccttttatcttggttttgctgtagtgctagatagatggttacttgtgagactttcaaatctatataccaggctccaacttctctccctctccctctctttttgagtaagggtttggctccatcacccaggctggaaggtcatggctgattgcagctttggactcctgggctcaagggatcctcccacctcagcttcctgattagctgggactccaggtgtacagcatcatgactagcaattccattgtttttagaaatggggtcttgctctgtcgaccaggctggtctagaactcccagcctcaagcaatcctcctgcctcagcctcctaacgtgctaagattacaggcgtgagccaccacacctggccaacttctaagtttcagtgctgtagttttaaattgtttctcatacttatctaatattttttcccaccatgtcaaacccttaaaaactcagtatggacaaaataaatattaacttttttgagattgataattgtatgatagtgcttattacctcaaaagaattactggggcagcagtataatccagtagatgggggaaatagtggatattaagaccgaaatgggatcataactttttagttgtatttgcccacattaattgttttaaagggggtaaaggcctggaatatgaaaacaggaggatataaaatatatggaggttgtgaaagatgactcagaacttgaaacaattgtttcactgcagtaaatacatgttgaatgcatagaacagagaaaaacagaagaaaagaagaaggaaaaacaaactccatgatttaaaatattgatgaatgtgacaataattgtatctttaaaataactgagaaatggtagaaataaaaattataagcttcaactgtatattacttattcttgacaaagatgatagttgcaagctgaagccaaaatttctaactaggactaatgcaaagatttcaagagaaactttaataaagaattattgatgcaagcgctttcagaaagcaaaggtagggactaaccattagctcttgtttagaaagataaaggtcacaaataaaatttgtgttttaatctatacattttcagcattatgtcatcataaatttgcatgttgtttattacaaatgggaaaaggtttcctgtaatatatcaagatgagttttaatagtttcaaggaccattgatttgtaaacttaagactattatagtgttgtggaaaattaaatataattggtgttttaggaaaagttgttcattgaagtttccattttatgtgccttaacagattaattttgcttattaattctgtgatatttaagcactgctgtaagcttcacagatttggcaatagccactatatacttaatgagtacaaactatggagtatttccatattaaggtagaagaaatatttaaaagcacttctacttgtgatgtcattgggggtgcaacacaatataaagtacgcacattgctggaggagaagcataaaataaagaactcacggggcagaaacttaagacacacctaaatcaaatctttgttttcagcattatctttcattactattctttgttacaaaaaaacattgctatctgtccttttctatatgttctctacattaaaacttattatttgtatacatactgttccctacatctgcagtgccattcccagctcacatatctgccctcttaaatttatatcaaattcaactcccttcaaaaagccttctcagttgctttaacccaagccagtagtctgtcttctagaaaacagttgatgccgatgcctccttttcctttagcaactgaaaataatattatagttatttaatgtgtgtgtgtgtgtgtgtgtgtgcataacatcatactatttagtagtatctatatctatcaagtatctgctacagtggatgatagatgacttaaagacagaaatatgttattcatatctacttctcacaggtctagtgctgttgcaggatattttttaaggaatcagagagactgatggggttcaggaggatatttattatttaggtgcaccagcccagtcggattaacatccaaaggactgagccctgaacaaagagttaagttaccttttaagcattttgtagggtgggaggagatctgtgcagggggaagcatgttagagaagtgagaaacaaagacagttattcaattaattgagaaatgcgttacatcatttcttacttttcaaggaaaaacatgttttgcgacttttgtttatgtgtctagtgactttgcagctgcccagctagggaatcagggtcttcacaatgcctgggaatggaggggagagaaagctcattagccacagaaaaataggccgttagttttttaaaggactctagctctttctctttctcagggggaattggattttcttacatacaactgaggttctgcttacacattctttaatttcttttaattcctgttccagtgcagtgcaatgttcatagtagatgcttaatattttttgaattattgtatctttagtcattgcgagccatcattttgagagtcagtctcattcttttagccctagattatttttattttcttgagatacgtgaataaagggcacaggaaaaaaacacagttgagagttttggataatagtaacctaattcacccagattttacttcatattggttggaactctaagttgggtgcaactaacatgagacttgttttgatttattgtaaacatattcttgaatgactaatgaacagtgcttcatgtgaacaaattttcaccttctgataatttccaatattacactttgaaaaacattcccattgtagtgctctagaaaatataatttcaattgttaaaattcaatattactgtaattgaggatattaaataacttgttgttacatgatgctagctgcagcttaaatttcagatcatgagtgttgttaatattatatagttggaattagttctgagatcaatgaatcaatgctgtcttactgttttgtctttaatttttataccacatttattttgtgagtggatttcataaaaggaagttgctttatgttgccaagctcattatcttgggtttttgtccagagctgaattccctttttcatcaaaggacagagagagcccattataaactattgagtaatgctgatttgatgggtaggccacttacctttaagtggaaaggaggccaggcgcggtggctcacgcctgtaatcccagcactttgggatgctgaggagggcggatcatgaggtcaggagatcgagaccagtctggccaacttggagaaaccctgtctctactaaaaatacaaaaattagccgggcgtggtggcgggtgcctgtagtcccagctactcgggaggccgaggcaggagaatggcgtgaacctgggaggcggagcttgcaatgagtcaagatcacaccgctgaactccagcctgggtgacagagcgagactccttctcaaaaaaaaattacacaaaaatgttagactaataaatattaataaacactaaaggaagaaatttagtggaacatttatcagaggcaacagaccaggaagttatagttaccctgtgaaaaggcatcatctaggattcatagaaaacatttgcaaattggcaacaaccaccaccacaacaaactaaaacaaatgaaagaaatagacatttatacagggaaaatataaatagataataagtgtaataaattttgtgactttccacttgaaaacaaagaaatggaaataaaacctatgtaaagaagtggtggagtgagccgagctggggtgggaggggtgggggcatcccaggcagagggaacagcagatgcaaaggtctggaggctggagcaggctgtgaggggtgagagcagcaagtacatgaagtctagaccacaaatcgatgcttcaccctcaaaaatagcctctcactggccaccactcaggcccagatacatgtgtaaggtgggcagccttcaggaaaagtgaccgcaaaagtgcaccacattgggaattctgaggtgtttgagaaagttatggatgaagggtgaggtagactctagtggggaatgtcctcttgccacttggacttctctgtctatttcatgggctattatcaacttctaaagagccagtggtttgggtgcacatttaggtgtaagtacctcttgcctcaagccttaactctctttccaatgagtcaagtgagctgttgtgtttaagtaacttctctttattgtgaaatctttcctatcactttaagaaccttcttcttcagacccaagtaatcccaaggcacctataatgtccctcctggagaagacaaaagggtgtcttctatttctgtgtggcccgatatttcagggcccctaaccaggttagttcaaggtgctcagcataaccatgaatctgctacccatgtttctcaggtgggtcataggccctggagggattgtggctgtggaccaagcagggggtgctgtgggctgttctgagaaggagggttttggagtgtccaagctgagaacatagaggccccagatgttgtatgagtaaattttcatctgacagaattatattttcctaactgaaaacatgaaacagagatgtaacaactgtgcctctttggctctgtctttgcatgctgtcatcagccactgaacaggagctgagagggaagacataaagaacagaaaacccatgagggggatggtccatgtgggtgtggaagtgagggtgagtggggatttggccaaagaggcctaatccacaggagtagagtctcatgtgtgactttcagaatgagcaggagtgagataggtggagggggagtgttggaacatctcatcagaggtgagaatccatagaaggagacactggtcattacagtcagtgagaaaagtgactttagcctgagcctaaggtcattggatcaaggaaggggccaggaggagctccttgaagggaagctgtgagcttgagaggcaggctgaggcagatcagtagaatgagcccccgagaagggctcacagagtcactgaaggactgtgaggtggcagggacaagctcacatggcctttggtcagtgagtctccagctgtaatgagaatgaaatggggaagatctgggacaggaagacaagctgggggcgctggtaccatcatggggagatgatggtgggtggctctaggttagttagagttggaatgaagagcagaaagcagcttcgtgatacctttatgtcataaaatacatttggcatggagaggacttggactttgtgcatgaaggatatggatgtttctaggctgactcccaaatgtttctaggctgactcccagaaactaggatgtttctaggctgttcctggctgagaatttggatggtaactatagtccaaagaaacaaagaacactgaaatcatatcttattttttttaactcacaaaatagaggcaggtagatatttatatgtgttttgttggctcaatgattttttttagtaataaacatatttacttagaaactactgggtgtctgtatgctctgggatttttttctcctgtcctgatgacatctctttcctttctctgggttcaggagttacttcccaggttgtggtgacacaggaacattcactttccacaactcctggaggggcagtcaccttcacctatggctccaaaattggggctgtcatcagagcatctcgacagctgggcccaacagaacatctggcaatgtccccagggcaatggtgggcacaagcagtcaggtcctgggacccctgcacaatcccctggttctcttcatgaagaaaaagccactctggttataatgaggactagaccaagaatgaggcccagtgttacatgctcggtgtggtgatctgaaatatcaccacagggacaaatacaaaaatacaagtgggaaactacactcaaacccttggatcaagcctcagtcctatgcttctgaagcaaatttcttgtttttggagtctggttttcaaccactgtagactcagatcatttattcttcaggcccccaatgggatcatcacaagcactttttctatcaatcatggcagtcacttgagatcaaaggtgaatttcttcttcctcaagttataagcaacactttggcatatttggtgaacttcaaagaaaatggctaagatagaggatgagagacataagaggcttcaggaatatttcagcagatgcaaagcagactacagggtaactcatttcccatatgatttgattgattgcaaaatgtgaaattaaatgcatacaaaggggaatgtgtgtcatttttcctcttaatgacaaagtaaaaaaaaagcaataaaacaaaaacaagcactatttcatgtgtcttgataaacttgtagaaagtcttataatatccacaatatctaggatacagtaaaataactttccatatgaagaaccagaagaacacaacttaaatgagaaaagacaattgatagacaccaatactgaaataatttaggtgctgatgttatgtaactgagattaattaaggagtaattatacaattccttcagtgagcaattttagacattattttttgaagttttaggttcaggggttcatgtgcaggtatgttacgtaggtaaacttgtgtcagaggggacattcttgaaacaagtggaaaagaagcaaatcccgaaaagaaaaataagtcatagaaacaaaccaaattaaaattagaaaacagaaaaatgcaataaattaaaaagaacagtctggagggactctggaacaggtaacagtgaaattaaagttcaggcattagaggaattatttaccgttaagtagggaagaaagtacaaacaatagccatctaagcccagcagagggagctgtggatcttctcagaggtgagcaaggccggaaatgaactcccggggctctcatttatggctcctgggtccatactcactggcccgaattggggtttagagcaggtgctttctcccaaagggcaaactcagagttcccagcagcccatcctccctgacagagcggctgctgcctggctgagcactcagaacttagggagccggtggttttggtagaggccccatgtttgcataatgtcctaaccaaacacacatctacccggggaggtgacgaggagttagaggaactgtcccagggtccagaagtagccgggggttctggggatccttggaaagtccacaccatagcttggatgtctatcctcccctctctccctcctcactgcccaggttcatgtagatttcaaagacaggactttggagggatctgtctgctgtgattcctcacacataacatgtatctgttttagtttcttggttcagttctcaggctgtggtgactcaggagccctcactgactgtgtcctaaagagagagacttattctcatgtgtggcttcagcaccacagcactgaattcagcagaagcctggtcaagtcctcaggacattgatgtgtaacacagataacaaacacccctggatgcccacttgattctctggctccctcctgggggaaagctgccctgacccctcaaggggcccagcctgaggatgaggctgagtatactgtgggctacaccacagtggtccttagcacagtgagagacccagatggggaagcaggacatgaacgagcttttggctgatccggggtacaaacatgaacgtaggatatcaggatcacgtggccagacacctgagctctcaaggacacctaaattttaactatccgtagagagaaaggtgggtggagaggtgtaaattgattcctgtatctgtttgaattttaaagtggaaaatatttgtgaatcatttgggagatgcagattcccaaaaagaagaatttatgtttatattccaaacagaacagtaatagtgagatcaactctaaagactaaggtcaaacacacttcatccagaaagatggatctcaaaagattttgttgttgttttgcctattaaaagctaagagaggaaattatattaataaagtttatttcatgttctatgttaatagtgtgtatttcatagctttttaagcattaaaaattataaaagtgttaagagggattctcttctctaatgttatataagaaagtatccacctaggaaaatattttgaaggtctaacccccagtacttctaaatgtgaccttatttttaaaatagtgttattgcttatgtaattcttaggatgaagccatcctagagcgaggtggcctcttgatccaatgtgcctggtgtccttataagatgatggtagtaaggagattggaagacacagagagaatgccgtgtgacgacgaaggcagagattgaatttacacagctgcaagataaggagcactaaagattgctggcaaaccaccagcagccagaaagagggaaggaaggatctcccctcaggtatatatggaaacattgccctttctatgaattttgggaggctagcctccagaactgtgagacaatacatttgtgttatcttaaccaaacttgtgtttaatacattctgacagcagttctaggaaaccaatacaccagacaataaattacacaatacttctgaaattgattgtacttctttcattttggcaaccagtttttccatgaatatgattatatctgtgctcatatttctaactttataaatatgcttgtaatttaaggttaagataagaaatccttgtgtcttaaaaatccctaaatatatgagaactgaataataatattaacattatgagatctaatggaaaattgtagcttttacataattccacttgttcactagtatcaagatgtgaaggtgggaagatcaccttgttattaacaaaacactcctggtcatctctgtggatttgagagtgcagggggagacacctacatattgtttgggaagtcacaaatgcagcatgcccagagcatcatgtacaacagtgtgagtttgctggacatgtgggcaggaagcagaacagactggggcatgaggaaccacctatcaccaaacccaccagcgccttcctccctggatcagcccagagctgctcagacttgaatgtgcacatggatcatgtgggatcctggataatgtggattctgatcagtgggtctggactgtggactgaaattctgcgtttctagaaggccccttcttccaaagatccacatacatgttttaatattaccatattcataagaatggtgggaaataagggaagccactttcagacagaaaccaaatagaaatttatctgagagggagctaaaggattatgatcaaagagaaatccccaattccaggcagggagctgatcacagagggcagatgggaagttgggagaggttctatttttttttttttaagaaatagaaatgaatgcaaacacaactcaaacctcctcttgatccaacatccctgctggctcctgcccaatttctgcactggcttcttctccagtcttttcccaagcatggaccctcctcaccctctctgcttccccatctcaaactcacaacttcccttctcagttctcctgtttctctccctttcattccacttccttcttctctgtgacctccttagacaatcaccaaaatatttctagaagaaaagccatgggtatttttcatcttttcttgaaagttgtcactcacattccctcttcgttcttcagcctctcttaccccttactacaaaagatgcctgaggccactgtttctcttttccatcccctcaaatagcttctccttccaacccgtttctctcctcagttactagagcattcagtgaagcactcagtcaggttaaaggatcctcccaaatgctcaccctgctctctatgtgtgatctcctgaagaatcaagtagggagagaaacatggcttcatgagtttgtggggaagtgggtgcatggctgaactgtccttgttctcagcaaatgtactttatttcatgcacagtttgtatatgagacaaccttctcctgcggactccttataaaatgggaagaattatgtgttgtgttttcacagaggaagcccaaatattccatgctcatgggtaggaagaatcaatatcatgaaaatggccatactgcccaaggtaatttatagattcaatgccatccccatcaagctaccaatgactttcttcacagaattggaaaaaactattttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctaagaagaaaacctaggcattaccattcaggacataggcatgggcaaggacttcacgtctaaaacaccaaaagcaatggcaacaaaagccaaaattgacaaatgggatctgattaaactaaagagcttctgcacagcaaaagaaactaccatcagagtgaacaggcaacctacaaaatgggagaaaattttcacaacctactcatctgacaaaggggctaatatccagaatctacaatgaactcaaacaaatttacaagaaaaaaacaaaaaaccccatcaaaaagtgggcgaaggacatgaacagacacttctcagaagaaggcatttatgcagccaaaaaacatacgaaaaaatgctcaccatcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcttcagggagctagaactagaaataccatttgacccagccattccattactgggtatatacccaaaggactataaatcatgctgctataaagacacatgcacacgtatgtttattgtggcactattcacaatagcaaagacttggaaccaacccaaatgtccaacaatgatagactggattaagaaaacgtggcacatatacaccatggaatactatgcagccataaaaaaggatgagttcatgtcctttgtagggacatggatgaaattggaaattatcattctcagtaaactattgcaagaacaaaaaaccaaacaccgcatattctcactcataggtgggaattgaacaatgagaaaacatggacacaggaaggggaacatcacactctggggactgttgtgtggtggggggaggggggagggatagcattgggagatatacctaatgctagatgatgagttagcgggtgcagcacactagcatggcacatgtatacatatgtaactaacctgcacattgtgcacatgtaccctaaaacttaaagtataataataattaaaaaaaaaaaaagagagttaaaggctgagatgaggtaggaggctgccctgaggaagggtctcatcctctggcatctggtcacagacacgatgggcctgggcctgggctgcagagagcacaatggggctgctggtgggggctctgtgcggctctcagctgggaaataaagtccatgaactttgttttgcctcacggctcactggggccagcagctgggtcctctctgggtgcttggggagcttcaggccaagctcagcccaggctgactcctcctagtagtgtcacccagccacagaggctgtacacaggcccagggagagttaggttaagcaggggaagaggagcacatttgcatgaagggcccctccctctcctttgaggctagagggtggataagagagacctgcagcgtggctgcctcagcagagctctggggagtctgcaccatggcctggaccccactcctcctcctcttccctctcctcctccactgcacaggtcaggaggaccctcagcatcctcatgccccagctcactgacaccatctcccaaactcataccagaaatgttgtttgctcttgtccttccttcaggccataatgagcgtctctgttttcagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcacacagtgatacaggcagatgaggaagtgggacaaaatcctcaacctgctgaggctattgttcagtgacaatttttaattttaaaacattttctgtatgtaaaaaatctatctggatgcatcctctgatttagaacaattttactcacaatttcccatttaatgtttcagaagtctcagaagaaattaaaacataaacaagaacataagcctcctgatgacactgagatgtctgcttatccttatgggctgataccaaagtctgtgaagctcaccttttctcttgaaagaaaaaaagaatgagccttcccttgagcaaatcttgctcagagcccaaacttcaagcccacaaatggacagtcccctgcagcatgggctcttgttcttcaaggggtcaatgaggagacctccctttcccaccccaggtgtctgtagtcagggctgcctgatgttccctgcatcctgggactaggcactcaggtgtgtaataccccagaggacaggcctgggagtaattccaaacacagagctggcctgattcactttcaggttcctttattttaagttaaaatgtcaggatagaaagaagttgggtatggggttattcatgaaactgaggccagaagatgtctttgtgggctgtgagagggtgacatggtggctccaccattgctaggggaatgttgagtgagctcctaagaagtttggggaaatcggtcttgtgagtgtggcttcccttcagctcattccactcagaaacatgaggacacccatgggtggatttttctgaactcacaaacactgacttgtgtcctcttttttcttatcccattggagatattcagtaatctactctgtgagatggggtctacaggagatcatggagaagaaactcttcaacctgtgcaagtgaaacttccttgtgtgaagctcttgatgtgtccagattccaaggtcaccttctcctgcacaggggtcagcagaaacattgaatattaccatggaaactggcccaatggctccagagaaatcctgaatttgtgactgagaactgcagtaatcaaccttcagggatctcagcctgattctcctttttcaacttgactttccttgactgtgcagcccgagggtcaggatgactatcactgtcagagctgaatacaacccgatgctgccatgagctcccattccatggggaagtgacataaacatctgtcctccatttcccccatcaaatccgtcactgccctgtccctgcctgtgaccgacacctgctcaggttgtggattctgctgtcacttgtgattccagcaagtctgatgcttttaacttggtgcatcattattagggaagccactccctctaaatcctcagaagatgcccccaaggagttcccggatcccaaggtgcaggatcaacctcccagtaaggaaggctctctgggccccatcactgttcatctgttctactttaatcctaagaaccttgagccttcattatttcccctttctgcttatttggctggaacgttgctggaatgcatctcagttctttggggactagagggataaaaagcacagcccatagaaagctttcacctggttaagtagcatttcctaagagccacgagggcatctgctcactgctcactgctcatccttgcatcataatgggttcctggaccctgggctctcctggctcattgagtttaccaatccctccacactccactcattgctagggctggctagagggaaggatagtaattgtccaatagggagatagttttaggggggattacagaaactactccccataatctttgttgataacatcttcatcttgatgtttgctccccaggatctgattgtgacagtggaagtctgacacttgaagaaatgtaggtttacccttctgaaaggcctggccctggcttggcctagggctggaaggaagaggtgctgagctttgggcaaccaaggcacagctgtcaaggggctgagctctctgcaatgtgggcctcctgcagagacatccctagggaggctgagacctgacgatgatgcagaaaagcaaattgaagtgagcaggggatggtctgtgggggaatcagatgacaggtggggggccagatgtgatacagatggtgcaacatgaagaaaagtgtcttttgtgattgttctgaggagaagggctcagtgctagagcagtgataatgaggcaggagctgggtcctgaagccacaggggaaccaggtcttgggtctttttctgagggtccctagggaagatcacatgacaaccaagtcccatgttatatgtccagtgctcggtatcccagatgctgtccctcccagagcctctgggtgtcctcgtcccactcttccctgtgatctgttttcagctccaggagcaggttcatactctgtgccaagagtggggcttgcatggctgagtggagaacagatttgcaagaagatcccaccttgcagtctggctctgtgtcctgggtgtgggtggtaactgaggagatgtaggcatttgggctccactagagaccacagggagcagagctcacaggggctccccacaacccgggctcctcccttcatcctcctcccattgccttcctcactggggttcgggccaggggagaacccagggctgcttcaagggccctgctctgcaaccatggtctttatccaagtcattgtctccaaactctgtaagggctttctctgaaactgtaggagcattttttttccatatgcccaaggcaggcttacagggtgctgaccccaccccttaaaagtgctaatagtctctcaatgctcaagacaggagggagaattaggaatcaggagcctacccagagcttccctctttcctcactttcaaaattgcactgtgtctagacatagaatttatgcctgggttgggaaatatttatttacttattaatgtattcattcattaatctcactttctgcaatctgtgtaagtgaggggcagaagggaagaggggcacagagggagaggttgaacccaagggcaggtcctggcagtctgggcacaggctctgatcagccagggggaaggaagagggagcagctcctggtgccctggagggaggggatgccctgtccctgctgggcctcccacttcgttgtacccagggaatgcttttcagagaggcagagctcttagcagagtcccgtaaaccatacagtgagttgggcaggtgagtccaggggtaggggctgtgtggagacctgagaccaggtgtggcctggcatggacactgcccagctccattcttttagggaggacaaagtggacagaggaagagacaggagacatgggtgtgtctgagctttgggcagcaggggatgctgtggcctagccctgagggctgtgctgtggatcccagctgggagccaccccctggtcctggcctggagccctctgtcccctgctcactgggactagcagctgtgtcctcacaggtccctgagtacccacagaatagccacacccaggtccacactctcccggggttagctttccaggcagaggtcaagagtcagaacccaaggtggggtttagacagcccaggagaggaggctggtttgcaagtccctcctaacccccttcgccctgaactgctggaaggataggagagacttgaagaatccaggcccacctgagggtcctcaggacacagctgtgtggcgggtccccaccatggcctgggctcgtggcctctttccttttctccttcactgctcagctggctggggccaggcgtcagggctgaggatgaagggaccaggattgctgtgtgtgtccctgtccactaacctgtgtctcttactctttgtctgtcatgatattcagggtcctgggcctgttctgtgctgactcagccaactgcagtgtccaggtctgtgggacagatgaccccagcacctgcactgggagcagcaccaatgatgggagtatgcacgtgttttggtaccagcagtctccaggctgtggtgcctcagaaaccctcctagtcaacaacaccctgcccagcaggagcgggccatgctctgattgcccatctggggtagtgtcagtggggctcagtgagcagctgagctttcaccccaatatcctcaaccaggcgagcatggcagggctagtttgagctggtttatcctcccatccacctatgcctgattttggcagggcccagtcaggaactgaatttcagcccccatccccagcaatgagttgaatgaaatggtacaaggcagagcacaccagccctcagtattccctccctgaacccagactctggtggttatgggggccagggaggaccagagctttgtctcccacctggcaatgagaatactggttggggatggaagtcagtgtcgttggcacacctgctgtccccctccctgccctggtgtcagtgagtcctctttttctcatgaaagtgtcagcagcactggagtactgagagccagcgttctgcctttgctttggcagtgggaagctgaacctacaaacctgtgtccttcaacaactcaacaagaagatcacctgataaaagggagattagtggtgcctagaggctcaaaatacagtatttaaggtgtctagcattcagttcatgaaatcattgtcacatcaagaattaggacattcagaacccaaatgaaagaagacagtgacacgcatggacactgaagcaaactcagatgctaaaatcatatgacggatttttaaagcaacaaccacaaaatcccttcaatgaataattaaaaacactcttgaaacaaatggaaaagaagaaaatctcagaaaagagaagttataaaatcaaaccaactggaaattaaagaacctaataaactagagcacatttaaaaagaaagttaaggcaggactcaagaactggttacatttgagattcagtcactgggtgaggtgttccacacgacataaaaatacagtaaaaataagtaggtaaacacatgaaaatcaatgattctggtttgacttgggaaacattaaagtggaaaatataaagaataaaatagcatttatttattgaaagaaagaactacctttagctttttatcgtttccccattaatactctcttgaagatgttcccaggggacactgtgagtcttctcagaggtgagaaaagcctgaaataaactcccacgaatctcatttaatgggtcctggggcccatgctcactggtctgagttagaggtgatagcaggtgcttcctctcaagtggtgaaattagacctcacagcagcccagcccccctgacagtagagctgctctctcagctgaaaacaacagaagcagatggtgttggtgatggttttggtaaagtgcttattaatgtgtgaaccaaatatatgcccttcatctagggagctgcataggagataaaagaaccatctcagggtccagcagcatcttagagctctgcagatttttggaaagtttacatcatgccctggatgcttctcctccacttccccatcctgttcagtctttgcccaggttcatggagatttcaaagaccagcccatggagagagccctctgttcttccccattcctgtcgtgtctgtttcggtttcagtatccagttcttagggtgtggtgactgaggagccctcactgactctttcctgaggagggacagtcactctcacctgtggctccagcaccagagtggtcaccaacaatttctatccacactggatgcaacagaagtctggccaactttttgagacattgatttatgatgcaagcaacaaacattcctgaatgaccacctgattctcagaccttcctgggagcaaagctgccctgagcctctgggggacccaatccataggctagactgagtactactcaagctacacgacagtgggggttactgcagtgaaagatccagatggggagccaagacgtaaccctgcctctgacagcctggggagaaaatgatcacgtgatatcaggatcacatgaccagaaacctgagctctcaaggcggtctaaatgttgcctatccttaaagaaaaaggtaaacagaagggtctacatcaatatttattcctgtttgtgtccaaaagttgaggaaatccatcaatgaggaggaactgttccagaaaagcggattcctaatattttgtaatccaaaaggaatagtattgcctacatcagatccaaggaataaatttaaatatatttttttgcaggaggaataatcttcaacgatgtactttgccagctaagaacgaaaggaagaaacgttctttggtatattaataacattttttattaggttgtaattaaggtgtattgcacaatttaaaacatattaaaatgattttttgtaagaaattcttttttctatatgttatgtgttgtattggactctaaagaatatatgttaaagccctacaccccagtattcaagcacataaaatcatttgaaaatcggatcattgaagatataatagttaagatgaggtcattctggagtagggaggtctctttatcagtgttcctgggtccttgtaggaagtcaaccatgagaagacagagaggcacagggagaaagtcatgttaatatggaggcatggagtgaagttactcagctacaatacaaggaacaccaaagattactagcaaagaggaagagctgccaggaagaatcccaggaaggttttctctacaggtgtcagagggaacatggccccgccctatggatttggatttctagcttccagaactgtgaaacaataaatgcctttcattttaaatcacatgtgtagggttatttttatggcagctcaaggaaattattacaccaaacagtcattgtaactatttctgagtttgcatgcattctctcatcttgtttctcagttttttcaacaaatgtgaccatgtctgtcttcgtatttcttccttgtataactggcattgaaggttgacgtaagttattctcgctgtcacaaaaattatataaacatgtaaataaggcttaattttattttgttcgtaggtacaaatgcaaaactaattccaattgttttgtaagaaatttttgtaaatatttttctcatgtaaattagaagggtctcttgagttactgaaacacttctggccatttctgtgatcttgtggtgtcaggatgagatggctaccatgttcaatgaaagcttcaaatacattattattttttctaggtttttaaaatttaatacagtctaattaaatagtaacagcagtaactaaatgcactgaaaaacagacaggtgcctgcctatatctggaataaaattacatcaaactagtctccatggtaaaaaaaaaaaaaaaaaaagacaactgctgatatccatggttagacaagtcaaggacaacttggaatttctaaagccatttttctaaaaatcaacagcaacagggacacaactacttcaaggggtaaaatatctatatctacattgttttttattaacgaagattgagttgcacctaaacagcatggcattcttatctttagccttaaaggaaaagtgaaagtattttccatttgcaccagtttgaaatatttctgaaataaggattacttcaaatgaattattacattacttatacacataagagggtctcacatatagtgaaaaggcaaacccaggattttaacgtcaaccttttaaagttgatttgattgcataaaatgagagagaaattctcacacgcataatctgtttaacaaaactcctcggtgaatcaggatgcaaaatataaaatgttctaagggagactctgatgagcaggcatataaaattgaagtgaaacccatgtcagcttcgttcctcccacttctttggtgcttctatgaggagctctttctctactgcaagagcctggacttttgacctaatggagaagaacctcaggaaggcaaggcattctgataaaatgccccttgagaccttttattttttaatttaaagggatcaactggtcttgttcagccttaggaaagaaagcatcactcagataaaagtatttggggaaactttaaatacctggctacctcttgatatatttaaattagattgacttcagctgttcttagaaagcattctgcatagttatccagagcagccactgaagttctggttctccttacatggctgcattcagaggtactccacatgaggcatgtttagaaaaagaaggacccttatacttgggagtttttgttcttccacgtaacctgttagtactgttggtaaaggcagtccccagatggcaccagtgcattttgtcaatggtgagtctagacagtgttgcaggggtgttgctgatgagtagaacagtgagcagataaaggtgagcagtgttgatctaaaggctttggggtccatctgcttatccttgcacacctgaacaaagtcatcagatgtgccacaccatcaaactgttgaagcttggacttgatacatgatagagttccatgccaattgcccatcttcatattcaacttgcagattagttggtccagctgatattttaacagatactgttagtagatcatctgaatgtgaactatctctaaccaagaaatttccttctggtgtctcttttaacttttctttggcttcattaacaatcatccttccccagtgccatcctgtttgagctcctacggggacttcaccagatgcaccacctccagggaaggttcctgtgctgaccctgctcctcactggctctgcatctattccctgccattcccagagggctggagacaccacagggtcatggaagtaaggtcactgaggcaaagacagatggccacccaaactgggtgagaaaggagctttcatttttcctggaagtcagtgggaacccccccaatcaaccctatgggtttctgaaatggtggaagatggggaaggaatgaaaagctgcctgtttttctcaacaggtccaggttgagggatgacaaagttccttgcagatgcatcacccacagatcaccagcaggaggatcctgaggctgcggtcagtgccctggcacaggacacatgggccatgtcccatgcagcaccggtggctccgagtgagagggcttatgctgcaggggaagccaaagattcctgagccacagcggtaagacatgagatgacttaaatatctgtccctcaagtatattattcttaatatttaatgcacaaaatagtgaaagaagagattagcttgcagtgcaaattgaacagattcagtatagcttgaggcatgagaaacaacagctctattaccatttaccaaaaatacaccctgaatggacagggggtgcccgtgagctggagatagggtgccccaattgaggaaatataaatactggttatcagttaaatttgaattcatgtaaacaaccatttaatagatttttatttttagtataattatgtcctatgcaaagttacttatctttaattctaatgtaactggatgtcttgcatcttgtgagataccattcccagcattcccagctgggctctgacatctgagtctatgctatttacctcaaaaacagagttcctgtaacaaagttatccccaagtaagtacttcggttagaaataaatatgtctgggctgggcacagtggctcatgcctgtaatcccagcactttggtaggccaaggcaggcagattacttgaggtcaggagttcaaaaccagcctggccaacatgatgaaaccctgtctctaccaaaaatacaaaaggtagccgggcgtgggggcacctctgcagtcccagctactggagaggctggggtgggagattcacttgaaccgggaggtggagcttgcagtgagccaagattgcaccactgcacttcagcctgggtgacagggcaagtctctgtctcaataaataaataaataaataaatacataaataatttataaataagtgtgtcatcccatccacctcaaggctgtaaaacctagcatgccttatccctcctcactttcttttttttttttttaattatactttaagttctagggtacatatgcacaacatgcaggtttgttacatatgtatacatgtgccatgttggtgtgctgcacccattaactcatcatttatattaggtgtatctcctaatgctatccctcccccctacccccatcccatgacaggccccagtgtgtgatgttccccttcctgtttccaagtgttctcattgttcaattcccacctatgagtgagaatatgcggtgtttggttttttgtccttgcgatagtttgctcagaatgatggtttccagcttcatccatgtccctgcaaaggacatgaactcatccttttttatggctgcatagtattccgtggtatatatgtgccacattttcttaatccagtctatcattgatggacatttgggttggttccaagtctttgctattgtgaatagtgccgcaataaacacaggtgtgcatgtgtctttatagcagcatgatttataatcctttgggtatatatccaataatgggatggctgggtcaaatggtatttctagttctagatccctgaggaatagccacattgtcttccacaatgcttgaactagtctacagtcccaccaacagtgtaaaactgttcccgtttctccacatcctctccagcacctgttgtttcctgactttttaatgattgccattctaactggtgtgagatggtatctcattgtggttttgatttgcatttctctgacagccagtgatgatgagcattttttcacgtgtctgttggctgcacaaatgtcttcttttgagaagtgtctgttcatatccttcacccactttttgatggggttgtttttttcttgtaaatttgtttgagttctttgtagcttctggatattagccctttgtcagatgagtagattgcaaaaattttctcccattctgtaagttaactgttgtacttagttgtactgggtttgatcgtagtttcttttgctgtgcagaagctctttagtttaattagatcccatttgtcaattttggcttttgttgccattgcttttggtgttttagacatgaagtccttgcccatacctatgtcctgaatggtattgcctaggttttcttctagagtttttatggttttaggtctaacatttaagtctttaatccatcttgaattgatttttgtataaggtgtaaggaagggatccagtttcagctttgtacatatggctagccagttttcccagcaccatttattaaatagggaatcctttccccatttcttgtttttgtcaggtttatcaaagatcagatggttgtagatgtgcggtggtatttctgagggctctgttctgttccattggtctatatctctgttttggtattagtactatgctgttttggttactgtagccttgtagtgtagtttgaagtcaggtagcatgatgcctccagctttgttcttttggcttaggattgtcttggcaatgcgggctcttttttggttccatctgaactttaaagtagttttttccaattctgtgaagaaagccattggtagcttgattgggatggcattgaatctataaattaccttggggagtatggccattttcacgatattggttcttcctatccatgagcatggaatgttcttccatttgtttgtgtcctcttttattttgttgagcagtggcttgtagttctccttgaagaggtccttcacatcccttgtaagttggattcctaggtattttattctctttgaagcaattgtgaatgggagttcactcatgatttggctctctgtttgtctgttattggtgtatgagaatgcttgtgatttttgcacattgattttgtatcctgagactttgctgaagttgcttatcaccttgagattttaggctgagaggatggggttttttattttattttattttattttattttattattattatactttaagttttagggtacatgtgcacaatgtgcaggttagttacatatgtatacatgtgacatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatattttactgagaatgatgatttccaatttcatccgtgtccctacaaaggacgtgaactcatcattttttatggctgcatagtattccatggtgtatatgtgccacgttttcttaatgcagtctatcattgttggacatttgggttggtttcaagtctttgatattgtgaatagtgccacaataaacataggtgtgcatgtgtctttatagaagcatgatttatagtcctttgggtatatacccagtaatgggatggctgggtcaaatggtatttctagttctagatccctgaggaatcaccacactgacttccacaatggttgaactagtttacagtcgagacgatggggttttctagatatacaatcatgtcatctgcaaagagggacaatttgacttcctcttttcctaattgaatactctttatttctttctcctgcctgattgccctggccagaacttcgaacactttgttgagtaggagtggtgagagagggcatccctgtcttgtgccagttttgaaagggaatgcttccagtttttgcccattcagtatgatattggctgtgggtttgtcataaatagctcttattattttgagatacatcccatcaatacctaatttattgagagtttttagcatgaagggctgttgaattttgtcaaaggccttttctgcgtctattgagataaccatgtggtttttgtttttagttctgtttatatgctggattatgtttattgatttgcgtatgttgaaccagtcttgcatcccagagatgaagcccacttgatcatggtggataagtttttgatgccctcctcactttcaaacagtacaacagttaacatttcctaaccattggagatattaaagcacagatcttttatatgagattagttaaaatttttatctttaatgcacaagagtttgggaacattaggaatttgtacatatgctaaattatatgtaaatgaaatgatacgatgtttggaatatgttttaaaattagttgagtgtgtggagtgaggggtaaagagggatgtaagatgaataagacaattttatgttgatgatgatttagttgggatgctgggtccaggacatgcaatgggcttttctccatagatgtctgcaacttcaaaaacatccacagtgacaaatgtgtaaaaaaaattctgtgaactcttctgtggtggtgtgtgtattgaggtggataagggaccccctattaagggcctgacttctccccctgaagcacggaaataaaggagaatcttgagtttcttcaagggaaatttcaggtacctcactgtccctgagaagaaaacctgactagcaaaaaggttaaaggagcttaaaacaaccaaggaagttagaggcatgggatgtctgggtccctatagaaactaaaaacaacaacttaacatatgcccctgagttgtttttcaaacactcagaccacctccaaaagtctcggctgtcagtaggcctcagataatgggaaactgaggactgaggtctgactgcccttctttgttctaagtctcttactgaggggccctgaggaaatcacgcccatgagccagagctaacatttctttctgttgaccccaattttttggacaaagctttacgaccttaaccagttgcaaatcaggaaatttctaaatctacttacctttgatctgaaagcccctgcttcaaaatactctactgttttaggccaaatcagtgtataacctctatatattgatttacagttttgactatgacttctgttttctgaagatttcccctgcttttaaacacctttgctttcaggccatcagggagtttgggtcttaagcatgagctgcccgattctccttgcttgatgcctgtgataaatgtctcattctcttgctgcaatcctgatgtcagtgcttagatttgtatacctggtcaatggattcaagtttggtccattaatagtgtgtcttgcttttaacagacactcagagttgccagatggtgtgcctccaccctgacctccagttgaagctcatctcctccccgcacacagaggaggacttggtgagaaggccacagaatggaaaggagctcagggtttcccaggaaagagaagtgagtgatactggaggccccagagcaagaggaagggctgtgaggtaggcaggggccataaagtgaagggcatgctggtggggctgcaaggtccagggtttatgtaaacagcaatgaagaaccacaaaaggagtttaagcccaggagtaagatgaacaggctgaatgagaaggatgtctccagctgcctcgaggagaaaggcctgagggcaccaggggatcctggtcatagattattcactaagagaacctgtgagtctagaagtttgaagactatttgcacagttaaagcagatttgcatctgggatacagtgaagaagtgataatttctgcattaatctgtccagtcattcaacgtttctgcagaaacattaaaaggtcacacttatctttcttagtaagccatgaaaaaaatgtaagtagggaaaattaggtttagaatataaacaaattgtattctatctaaaacaaaattctattgagaagtagatgaaacagataagcagaaaaataaaaaggtaggaagacaaaactcacttcataaaataagaaatgtgttacaccatgaactggtaaatgttatgcctacccaactattattttttcacaaataaaatctagtgagtatcaacatgctaaaatcatggtgtgacttaggaaatgttttctgggccaggtgcggtggctcacgcctgtaatcccagcactttgggaggctgagatgcgcggatcacgaggtcaggagatcgagaccatcctggctaacatgatgaaaccccgtctctactaaaaatacaaaaaaaaaaaaaaaaaaattagccaggcgtggtggcaggtgcctgtagtcccagctactcaggaggctgaggcaggagaatggcatgaacctgggaggcggagcttgcagtgagctgagatcgcaccattgcactctagcttgggcgactgagtgagactccgtctcaaaaaaaaaaaaaaaggaaatgttttctgaattgctggatgttaaatctatcactgaggtgattcctgaaacagtccccttctatgtcattgccttgaacaaccccttcatgccactcaagtcagcacaactgtttcagcatctgtggtggtgccatagtgacgtatgcaggtcacttagctttttctagaatgtactcttggggcactggcaccttaaaaggttataaaatttttaaacagttataaacgaacatatttgctcctctcatagatcaagactacttataggagtgagatactggctaggcatctagtagaccacgtcatcatcacaggatataggattcaggacacagatgtgtatacagaggaatagtgtcctggtgagctgcagagatcagctgggctctctggtctctgagccatggggaggtgagtgtcctgctatcagcaggctgcactgtgggacttgcctgtggtgtctgcacagctgctctttaagaaccattcattccaaggagcctaggtctaggggctgggccttgtgctcattgatggggactcggcagctgtcttctctggtctggcagagtctgctgaacagggacctgtgtatggtctcagcaggtgatatctcctagggcccttccaaggagggaaagcaaatcatcttcctcagtctgcagtgtgagctgggctccagccccagggctcaggaagggactgggcagtccctgcatagaaacacatttgcatgagcagcccctcctctgctgggggttgggaagaaaaggaggcctggggcagctcaggctcactgtggtggtcaggggctgtgtccaccatggccagaacttctctcctcctcctgatcctctttcactgctggcctgaacttctcttctccttatgctcctctctcactgcacaggtaaggacaggcctcggagatcaggactcagttttcagcctgcatcagtccctcaggctcaggaacccatgacaaatttcatcctcatcttaaccctgtctcttatttgtgtctgtgtttacaaattccctctcccagcttgtgctgactcagctgtgtcctcccccctacttcctgtatctctgggagcatcttccagactcacctgcaccctgagcagtggctgcagtgttgacatttatctcatatcccgctgtcagcaaaagccagtgagcccttcccagtatctcctgatctacctctcaaaagtcaagtaaaactagggctctggagtctccagctgcttctctaaatccaaagatgccttggccagtgcaggcaatttgctcatctctggggtccagccagaggacaagactatctgttctatctattactgtcagacctgggatattgatacttcagttacacaggcagatgagaaagtgagacgaaactcagcctactaagaatggaactatggctctttttccaattgtcaaataattttcacatacacaaactattttggaagtagctactgattcacaatggttctctcaatgtcccattcaatgtttctgagtcctcaggcaaactaacaacaaaacaatgataaaacatatgacaaaacatatgataacactgactctttccctgctgaaccacatgtaataaaaccagaggagctggtttaataaaacctgaggagctgacttttcttttaaaagaaaagatgacagtcttttggagtctttttcttggtcaaaatttcctagaccatcccagcaggtggacagtcccctacagaagacacgatcctgggaggaatcccaggtacagagctggcctgcttcacttgtgggtacctgccccttcaattgtgaaatcagggaggggagagtaagcatagggggtaggtgaggatcaggaaaggggcaaggccactacatttcattaaccacctttggactccagtgcaagatagaggctgatgatcccatcacacaggtgactacaacctccttgtcatcaacagctcctgcccatggggaagcgaaatgaaaatctatccccatccctctcttcttacatatccctgtcctgcccctgccggtgaccaacaccagctcaggttgaattttgttttgtcacttgtgctattaaagaaaataactccttctcttactggtctcctagttcagacagaatcagtttgtttccagaaatagaaaacgctgctcacacacatgagtgtaaagtaaggatgacaaaaagaaaaaatccaggctatgtggcccagagacccaggtgccctctgattggcctcatagatgtcccctcctcctggcccaggtttgcttgtcattccttaagctctggaaccttgaactacatgggttctgtcttcatagatacagaagaaaaccctccccaagaaggagatggttcccagaaccagcacatgctcacttttctctgtttaattccacacatctgacttatttttgcttccatgagcctttgttgaagatatctctgaatacctctcatttctgttaggtctacagcctatggacctatctccattatatttgtgcttatttttctaacctttatgactgattatcatttaagcttaatatgagatatgcatctatattaaagatatataaatatgtcatcaatggtcaatattattaaagttataagtagtaatgcaaaattgtagctattatatcatttcacttgttcactaacattaatatgtgaagtgagaagatcactttattaatcacgcactcctggtcatgtgtgcggatgagtaagctcaggggggatgctgccatggtccatgggaagcctcaagaacagcagacctggcacatcaggcacaacatgggacacagggagtgagccatgtcagcagaaagcagaatagactgaggcatcagaaacaacccattgccaaactctccactgccttcctgcatgggtcagaccagagctgctcaaacataacgtgcacacagatcatctgggctcctggaaaatgtggactcaggggtctaggatgaggactgagattctacacttctaaagatcccttctcctacaaatccacatatgtgtttctgtatcacaaaattagtaagaatgggggaaaataagaaggaaagccatttgtagacaggaagcaaagaaacatctttcgcggagagaactacagaattttcatgaagaaagacttccagttgaggcaggcagacaaccagagaggacagccgagaagactgaggaggctcctctttcttcacaaaacaaacaaatgaaagcaaaaagacaccaagcctcccccttacctgccctgccctctggctcctgtccaatctccccaccagcttctccttcagcctcttctaaattgtggaccctcctcaccttcccttcaggagatgccctgagtccactgcttctctttcccaaccccactagcaccttccgctacttcctgggtttctcctcagctaccagagaatgcagtgaaccatccaatccaaataaattatcctgttaaacattgaccagtaggtctcctttgtgcggatctgaggaatcaagcagggagaaagaacctgactttgtgagctgcctgagaaatgagttcatggctgaagtgtcccttttctcagctaacatgttttatttcatgcacagggtgtatacagagacaatcttcccctgaggactccataaaagatggggagaattgtgtgtccagttcccattgaggagacacacacagaaaactaaaggctgaggtgaggtaggaggctgccctgaggacgggccttgccctgcccttggtcagggagtgagcagtgttcaagaccctggtggggacaggaggctctgtcaggaccccggcatctggtcagagacacggtggacctggacttgagcagcaggggatgctgtggccctgctgctgagccctctgtggggctgtcagctgggaaaccagaaccctgtgtggtctgtgctcagagatcactgggccaagtagctggatcctctgtgggctcctggggagcctcaggccaggctggatcctctgtgggctcctggggagcctcaggccaggcccaagttaggcccacccctcccagaaatgacacagccattgccgctgcatacagccccagggaggggtacggttgggcagaagagagacaagtttgcatgaagggcccctctctctcttctgggactaccggatggataagagggacctgcatcatgtcagcctcagcagagctctggggtgtttgcaccatggcctggaccccactcttcctcctcctcaccctcctcctccaccactgcagaggtcaggatggcccttagcaccctgatcctgcagctcactcacactgcctcacaaactcataccaggaatgtccttccctcttatccttacttcaggccataatgggcgtctatgtcttcagggtccctctcccagcctgtgctgactcagtcacccactgcatctgcctccctgtgggagcctcggtcaagcttacctccactctgagcagcaaatacagcacctacattattgagtggcatcagcagtagccagggaaggtcccttggtacttgatgtatgttaccagtgatggaagccacaaaaatgggatccccagttacagttctcaggatccagctatggggctgatcggtaggtcaccatctccaacatccagtttgaggatgaagctgattgtatctgtggtgcagatcatagcattggtgtgacatatgggtaaggcaaagtgaccccagtgaatgaggaagcaggacaaaaactgttttctctgctccactatgaaggctgccacgtggccctgagaaacagtgcctgttttccttactactcaagaaagatagatagatagataggcagatagctagctagatagatagctagctagacagataggcagatagctagctagctagctagctagacagatagataggcagatagctagctagatgctagatagacagatacctagatagctagatagattttttgctttgggttccttaggaacaagtttgctaggccaagctcctaaggagtacacaagtctgtattaatgtggccaatattaaggcagatcctgtcaccccctgcatgtcgatacattgtcaccacatgggaactgcaaggacatttttccctgtggatttaaacactggaactctgctgcatggcacacccctgccacatcaagtttcattttaacaatcacccataagatataacttcttaagaaaattttgaattctaacaaaatgctagaaatcacactgttgatacacagcgatggaaataatgaaaatttatagacagtgaaataaaaagatttaaaatttttggtggtttataaaggttttctcagttgttcagtgcgtgggttttgggattaggagaaaatgaggagaaactgcctccaccacattgaacatgacaactgatttgcaataatctaacaaagaagaaggatataaataatcattaatgtcatcctgacagccctgatcctaaatgtcagaattttatttcttaacttttttctccaaaaaaaaaatgtagcttcagaaaaacttctggaatggtggtatgaggccatcagaaaacctgattcaccatacaagcaatgagaacagcagtaaaaatgatataaatctacttttcagaactctgtacattaccaaaagcttacaaaattctgggaatcataaaaaatagtaataacagccagacatggtggctcatgcctataatcccaacacattgggagctgaagcagagcgattgctttatcactcctgggattttgtgatcagactgggcaacagagtgaggcctcttctctaaaaaacattttaaaaaagtagctatatgtggtggtgtgtgggtgtagttgcagctactggggaggctgaaggtggaggatcacttgagtctgggaggtggaggctgcagtgggctgtgattgtgccactctacttcagcctgagtcataaagcaataccctgtctgaatcaatcaatcaatcaattaaaataatgtggaatctctgtaagaatctgaagctttgtggtgattttatttcttttgctctctcccaagttccacagtagccttaaaaaccaacagcctcaaatctcctggatctagggaaactagaaaaatagcattcactgaagcaaccaaataccagatctggaattttctcaaaagccccattcccgtgcgactgtcattatttgagctttccaaagctcagaaaagcttcacgctctgtacttttctaaatgtgaattgtctcagagctcgcttggtttaaacagcttcatcctcaatacatttatcaaaacaatcagtgagatctgttaaggtcctgagtcagtgatacaagatggggtcaataaaaggctgaccaaaaaccttgagagaaaaaaactgggtgtcagaatctgtagaagattttgatgagctctgccatattcctggaaagacagaagatcactctcatgctcagagttatgtgcatggccaggtaaaaattaggaaagtccttaattttcgacactggctgaaatcaacaaggaaggctaaaatagagttgtaaagtggcggggttttgcagtcatgacccaacccctgcacagagcattcggcaaatgctgaggaatgtgttgttcgaggcgtttaagaacatgtctgtccaataataagctaatgactgatataattgagcagagactgcagtggctgcacaagcaaagaaaacagacttagagaattattccagtaccgtgaaacaataaatcatcatcaacaataacaactacaacaaaaccagaagcaattatgacaaatattttaaggaaagaatctgatttccagaatcgtcacattgtgtgactgagaagctccatttggcaaagtgaaattttgaggcagggacacagcaaagtactgtccatacacagggttaaaaaggaaagcaaagcaaaacataaaaacaaacaaacaacattaaaaataagttgacaaaatgatgtccagagatgcatttggtggttactacataaaaacttcaaattagcttttgtaaatgtggtcaaataaataaataaaacaacgttaacaattgttaaggaaagtacggaaagaatgcctcattacagagagaacattggcggggtgcagtgcctcacacctgcaatcacagaactttgtgaggccaaggcagacagatctcttgagcccaggagtttgaggctagcctgggtaacatggccaaaccatgtctctacaggaaatacaaaaaagctagctgggcatggtggtgcatgccagtagtaccagctactcaggaggctgaggtgggaggatttctggagcttgggaggcagaagttgcaagagcaaagatcatgtcaatgcactccatcctgggggacagagcaagagtctgtctctaataataatataataataataacaatagagaatactaataaagaggtatagaagaaaggatcattgaattaaagacagataaattgataattattctgttccaagaatagaaaaaaatgacaaacagtctgcacaacctgagagacgatgtgacaccaatcaaatgttccaatacacacatagtaagtttcagtccttccaccatgtgagctcgcagtgagaagatggcagtctatgaaccagtaagcacatccttaccaaacaccgaagtatctgcttgtactttgattttggaccttccagcttccagaactaaactctgacctattttttttggacatttgcatagtgtgggcctcagaaggaagctggctggaatttgacatcacagccactagtagtctgtgggttgtaaccccacagcataacatggggcttcagctgagcgtagtgacagaggatggagtccacatccaccctctagctgcagacctggtgggcagagacagcacttaggctatgcagcccttcatggtggctttcttcaaagtcattgtggtccatgtgtgcatcaccaggtcagcctctggctggcgttgacagcagagttgtactcactttacccagtcccactacgtggctcaagtctccagtacttcagattacatcagcagcaaattaaaaacagcctgcaggaagcatgagctatatgtgagcttccaagacctggatggcaggactggttcatcgcacccaagggctatgctgctaattactgtgatgtagaatgctccttcccaatcaatggacatgtgaatgcaatcaaccatgtgatcattcagaccttggttcaccttatagatcctgaatatgtcccaaagctgtgctgtgtgccaactaaactcaatgccattttggttctttacttcaatgacaattccaaaatcaccttgaaaaaaatacagaaatatggttgtaagagcttgtggatattgctaacttgaaaccagatgctggggacacacattctgccttggattccttggtcatagctgccttaaaaaacatacagaagcacagtggaggtggagggataagactttgaaaccatctcatgctgatgccttactgcccgagaaaaattttaacggaccttgctaataatttgctcacttggtaagtaacatgagtagttgttggtctgtactaagctgagtttggttgtctggtaactacagaaacttaaacttaaaaggtaccccccaagcccaccaaatttaattttagctatagttcaagctatttgggttattagtgagtaaatagggaaaataatctcaatggagttaaatgtattcttgggtaaagtatcagctggtttattagtgtctatcaaaggtacattttacagatagtgaaagttggggaagtaggaataactcctctattcacagatttcattcccaggaaggcaaattttatactggatccacagtccaggccatagcccgggctccttggggatgcctctgtctcagtctttgctgttatgagtttgtgctggagttctgttggtgtgaaaatatacttatttcagtcaaaacaaaccatatcattttcacatctcagtcctccatttgctgtattctttgctagtacccaaagtagactgattaaactttgaagtgaggcttagaggagtggaaagcatttgtgacaggctccatggtaactgtgtaacatgtgaaagcaatgctgcacctcttctttattggaatgactttttgaccagcacattaacttgaggactgccgactctaatatctatttcaggaaagcggtgctttgtctttttactacagagcataccacgtgattgggttagaaccaacaaaggaaataaaatgggaaagggtgccccacctttaagaatggctttagggggatgagtgtgccatttatgaatggaaattatgattttctcttgtagaaaggaaggctcagattaaattttagaatatttttaaaatatctttttcaccaacatgtactgggaaagcaatttcatactaaactgattaaatgatagttttataatctataactgcagtaatggttttttgtaaatatgaagtataatttattttatatctgttttgctgtaacattgaaggaaataccagacattttctttaagtgtttatttagaaagtaccaggagatggttccaagatggccaaataggaacagctccagtctacagctcccagcgtgagtgacgcagaagatgggtgatttctgcatttccaactgaggtaccgggttcatctcactggggcttgttggacagtgggtgcaggacagtgggtgcagtgcactgagtgtgagccgaagcaggatgaggcatcgcctcacctgggaagtgcaaggggtcagggaattccctttcctagccaagggaagtggtgacagatggcacctggaaaatcgggtcactctcaccctaatactgcgcttttccaatggtcttagcaaacggcacaccaggagtttatatcccgcacctggctcagagggtcccacgcctacggagcctcactcattgctagcacagcagtctgagatcaaactacaaggtggcagtgaggctgggggaggggcgcccaccattgctgaggcttgagtaggtaaacagagtggccaggaagctcgaactgggtggagcccaccacagctcgagaaggcctgcctgcctctgtagactccacctctgggggcagggcatagccaaacaaaaggcagcagaaacctctgcagacttaaatgtccctgtctgacagctttgaggagagtagtgattctcccagcatgtagcttgagatctgagaatggacagactgcctcaagtgggtccctgacccatgagtagcctaactgggaggcaccccccagtaggggcagactgacacctcacatggccagatacccctctgagatgaaacttccagaggaatgatcagacagcaacatttgctgttcagcaatattcgctgttctgcagcctccgctgctgatgcccaggcaaacagggtctggagtggacctctggcaaactccaacagacctgcagctgaaggtcctgactgttagaaggaaaactaacaaacagaaaggacatccacaccaaaaacccatctgtatgtcaccatcttcaaagaccaaaggtagataaaaccacaaagatggggaaaaaacagggcagaaaaactgaaaattctaaaaatcagagtgcctctcctcctccaaaggaatgcagctcctcaccagcaatggaactaagctggacagaggatgactttgaggagttgagagaagaaggcttcagacaatcaaacttctccgagctaaaggaggaagtttgaacccatcacaaagaagttaaaaaatcttgaaaaaatattagacaaatggctaactagaataaccaatgtagagaagtccttaaaggatctgaaggagctgaaaaccatggcacgagaactacgtgacgaatgcacaagcttctgtagccgatttgatcagctggagaaagggtatcagtgattgaagatcaaatgaatgaaatgaagagagaagagaagtttagagaaaaaagaataaaaagaaatgaacaaagcctccaagaagtatgggactatgtgaaaagagcaaatctacatctgattggtgtacctgaaagtgatggggagaatggaaccaagttggaaaacactctgcatgatattatccaggagaacttccccaacctagcaaggcaggccaacattcaaattcaggaaatacagagaatgccacaaagatactcctcgagaagagcaactccaagacacataattttcaaattcaccagagttgaaatgaaggaaaaaatgttaagggcagccagagagcaaggtcaggttacccacaaaggggagcccatcagactaacagctgatctctcggcagaaactctgcaagccagaagagagtgggggccaaaattcaatattcttaaagaaaagaattttcaacccagaatttcatatccagccaaactaagcttcataagtgaaggagaaataaaatcctttacagacaaacaaatgctgagagattttgtaaccaccaggcctgccctagaagagctcctgaaggaagcactaaacatggaaaggaacaaccggtaccagccactgcaaaaacatgccaaattgtaaagaccatcgaggctaggaagaaactacatcaactaacgagcaaaataacaagctaacatcatgacaggatcaaattcacacataagaatattaaccttaaatgtaaatgggctaaattctccaattaaaagacacagactggcaaattggataaagagtcaagacccatcagtgtgctatattcaggaaacccatctcacgtgcagagacatacataggctcaaaataaagggatggaggaagatctaccaagcaaatggaaagcaaaaaaaggcaggggttgcaatcctagtctttgataaaacagtctttaaaccaacaaagatcaaaagagacaaggctgttacataatggtaaagggagcaattcaacaagaagagctaactatcctaaatatatatgcacccaatacagaagcacccagattcataaagcaagtcatgagtgacctacaaagagacttagactcccacacaataataatggaaggctttaacaccccactgtcgacattagacagatcaacaagacagaaagttaacaaggatatccaggaattgaactcagctctgcaccaagcagacctaatagacatctacagaactctccaacctaaatcaacagaatatacattatcagcaccacatcacacttattctcaaattgaccacatagttggaagtagagcactcctcagcaaatgtaaaagaacagaaattataacaaactatctctcagaccacagtgcaatcaaactagaactcaggattaagaaactcactcaaaactgctcaactacatggaaactgaacaacctgctcctgaatgactactgggtacataaagaaatgaaggtagaaataaagatgttctttgaaaccaatgagaacaaagacacaacataccaaaatctctgggacacatttaaagcagtgtgtagagggaaatttatagcgctaaatgcccacaagagaaagcaggaaagatctaaaattaatacccttacatcacaattaaaagaactagagaagcaagagcaaacacattcaaaagctagcagaaggcaagaaatgactaagatcagagcagaactgaaggagatagagacataaaaaacccttcgaaaaatcaatgaatccatgagccagttttttgaaatgatcaacaaaattgatagactgctagcaagactaataaagaagacaagagagaagaatcaaatagacacaataaaaaatgataaaggggagatcaccactgatcccacagaaatacagactaccgtcagagaatactataaacacctctatgcaaataaactagaaaatctggaagaaatggataaattcctcgacacatacaccctcccaagactaaaccaggaagaagttgaatctctgaatagaccaataacaggatctgaaattgagacaacaattaatagcttaccaaccaaaaaaagtccaggaccagatggattcacagccgaattctaccagaggtagaaggaggagctggtaccattccttctgaaactattccaatcaatagaaaaagagggaatcctctctaactcattttatgaggccagcatcatccttataccaaagcctggcagagacacaacataaaaagagaattttagaccaatatccctgatgaacatctatgcaaaaatcctcaataaaatactagcaaactgaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaatagatacagaaaaggcctttgacaaaattcaacagtccttcatgctaaaaactctcaataaattaggtattgatgagacgtatctcaaaataataagagctatttatgacaaacccacagccaaagtatcatactgaataggcaaaaactggaagcattccctttgaaaactggcacaagacagggatgccctctctcaccactcctgttcaacatagtgttggaagttctggccagggcaatcaggcaggagaaagaaataaagagtattcaattaggaaaagaagaagtcaaattgtccctgtttgcagatgacatgattgtatatttagaaaaccccattatctcagcccaaaatctccttaaggtgataaacaacttcagcaaagtctcaggatacaaaatcaacgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacaaaataaaagaggatacaaacaaatgggagaacattccatgctcatggataggaagaatcaataccgtgaaaatggccatactccccaaggcaatttatagattcaatgccatcccaatcaagctaccaatgactttcttcacagaattggaaaaaactgctttaaagttcatatggaaccaaaaaagagcctgcattgccaagtcaatcctaagccaaaagaacaaagctagaggcatcatgctacctgacttcaaattatactacaaggctatagtaaccaaaacagcatggtactggtaccaaaacagagatataaaccagtggaacagaacagagccctcagaaataataccatgcatctacaactatctgatctttgacaaacctgacaaaaacaagaaatggggaaaggattccatatttaacaaatggtgctgggaaaactggctagccacatgtagaaagctgaaactggatcccttctttacaccttatacaaaaattaattcaagatgggttaaagacttaaacgttagacctaaaaccataaaaactctagaagaaaacctaggcaataccgttcaggacataggcatgggcaaggacttcatgtctaaaacaccaaaagcaatggcaaccaaagccaaaattgacaaatgggatctaattaaactaaagagcttctgcacagcaaaagaaactaccatcagagagaacaggcaacctacagaatgggagaaaatgtttgcaatctactcatctgacaaagggctaatatccagaatctacaaagaactcaaacaaatttacaagaaaaaaacaaccccatcaacaagtgggcgaaggatatgaacagacacttctcaaaagaagacatttgtgcagccaacagacacgtgaaaaaatgctcatcatcactggccgtcagagaaatgcaaatcaaaaccacaatgagataccatcccacaccagttagaatggcgatcattaaaaagtcaggaaacaacaggtgctggagaggatgtggagaaataggaacactgttacactgttggtgggactgtaaactagttcaagcattgtggaagacagtgtggcaattcctcagggatctagaactagaaataccatttgacccagccatcccattactgggtatacacccaaaggattataaatcatgcttctataaagacacatgcacacttatgtttattgcggcactattcacaatagcaaagacttggaaccaacccaaatgtccatcaatgatagactggattaagaaaatgtggcacatatataccacggaatactatgcagccataaaaaaggatgagttcatgtcctttgcagggacatggatgaagctggaaaccatcattctgagcaaactatcgcaaggacagaaaaccaaacaccacatgttatcactcataggtgggaattgaacaatgagaacacttggacacagggtggggaacatcacacactagggcctgtcgtggggtgggggtaggggggagggatagcattaggagatatatctaatgtaaatgacgagttaatgggtgcagcacaccaacatggcacatgtatacgtatgtaacaaacctgcacattgtgcacatgtaccccggaacttaaagtataataataataataaaaagagtcagccccctagcctggcagtgctgctctacaggcaccctcagccctgatcccttcactgcacctaggggacacagtttacaggactgagtcagtgggacaccctgttcctttacattcccagtcatgggctcagattctgcacttgtctcactgctggagggaggagcctgcatcagtcaccctcaaagaagacatgaagttatttcacctgtaaaggcaagaaactgttcgcagcactgggggcaggcttggggaagatgaggtttgtgaggatgttgagaattcatgcagctcatccttcagccctatagctttccagagaagtgtataatgggggtcactaggcatgtgagtaactgatttggtgaaagatgccacttcagatcaaaagtgcatttccccttccccaaggtgtcagcaacactgaaacatatttgactaactttatagaggaagattaagatagaggatgagagagacataaggcctcaggaatatcttagccaatagaaagcctgctggaagatgcatttccaatatgattagactgattgaaaaccttgaaactaaacacttccaaaggagactgggacccatttctcctgagaatgacaacacaaaaaatagtagaggaaaccaacaaaccaaaagcagacactgtttcagatctattgaaaatcctcaagatagtctcataatataatattcaaaatatctaggatacaattcaaagaaacacttgttatatcaagaagtagaaaaattcaccatttgaatgagaaaaggcaatccagacatcaacgctgagatgatttagggctgaaattacctgacagatatattgaaatcagccaccataaaatcctgttgatgagcaatttcaggcattcttgaaacaaatgaaaaaggataaattctcagaaaaaatagaagtcataaaatcaaactaaatataaatacaaataaaataaatgaaaaatttaaaaatacctctctggagagactcaagaacaagtaactatgaaactaaaatccacgcattagagaagacacttaacactgttaactagagaagcacaaaccatagttatcacagcccagcagggcgagcaatcagtctgctcagaagtgagaggcctgaaaaaaaactcctggtgtccctgatggtgaaatctggcccctgatcccagggttcctccctcttcgtgctcagagggctagacctagcagtgaagggttcccaacctcaccctatgcggcccctccagaaggcagagcccattcttgctgatattcccgatctccaataacacaaagtgaaagagaatgtcttaaccagagtactgagtcttggcctatctgaacatatttcaaagtttaaatgtacagtgagcataggatgctgagcagaggccccctggacagtggctggagttgggagcagtgcaggatggaaggacaggtcaggggccctgagcacctgtacctgcacctgcacctgcccagggtggacatgactcccgcatccaccagagggcgttgtggtctaagcaactaatcagagctccccagatcctctgctgttttccctccacctgctggtgtttctgtgccctccagatggtgttgctcctcccccttctatgaccacttttcagccataaccttgtctgaggtcaaaggagggggttgtgcaaccttcagaaagggagaaatttgcatggagccctaccactctgaggatacgcgtgacagataagaagggctggtgggatcagtcctggtggtagctcaggaagcagagcctggagcatctccactatggcctgggctccactacttctcaccctcctcgctcactgcacaggtggctgcctgcaaggaattcagggagcgttcctggatgtcacctgggctgatgatctgttcctcctgcctgggaaccagtcttcatctctcccgactgatctctgtgttgctctcttcttgcaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtagctctcccatctctcctgtctaagtgcttgaggtgaactttgcttatgacttcctcttttccttttcaaaataccaatctgtttttccacaccttgatggctgattttctgatatgtgcacgatcaattgtgggataaatgtagtttataatcgggtctctgagccacaccatgattgatgttctggttggggctgccttgcacagtataagttattgacttgcatctctggcctctacccttagatactattaacaccctcccctcatttgtgacaacaagactgtcttgagacactgccacatgtcccatgcttggggacaaaatcagcccaggttgagatactcagttaaagagcatgtcttcagctactaagaagcttggctttgaaatgtgtttatgccattctgctgagcatgaggctggttttctaatttttgtttctggttcccatctatgagacaaaacaataacaccaaacttcaatgttttgatggttgaatggtttttccaagcaacaagaagtcagagattgtgctacttagaggtgtagaagccctaaccagatcctgtaacacagagtttagctctgactaggacagcacacaatgccttccatcaatctccaacccacagcccgcaggctgcatgcagcccagaaaggctttgaatgtggcccaacacaaatttgtaaactttcataaaacattatgatttttctgcaattttctatagctcaccagctattgatactaacagttagtatcagttttatgtgtgttccgagacaattcttcttccattgtggcccagggaaatcaaaagatgggacacccctgctttgcacttttgtacaatgcacatggaaatataatagagccttcttccttctaaggtcatgtgactcagccattgaaaggtggaagtgctgaaatgagctccatatgaacggaccttgaaaaattatgctcagtgaaaggaacaaatgcaaatatctagaaatgaaatgtctggaaatgactgtatttataacaaatgtccatgatacgtaaattcatggaggctgaaaagatcgagattatcctcaaaccttgtgataatttaggtgaaaaggatgatttcagaattggatagaaagtgatctacttcaaaaataagctggaaatgcctccacgaacagaggcgatgctttgcggaatcctaggtggagaagtgtatcaggtgcagatgaggtctttaagaatacttcttgttttgttttgtaaaattaaatatgaataagaacactgtgggccaggcgcggtggctcacgcctgtaatcccagcactttgggaggctgaggccggtggatcacgagatcaggagatcgagaccatcctggctaacacagtgaaaccctgtctctactaaaaatacaaaaaaattatccaggcgtggtggcaggcacctgtagtcccagctactcgggaggctgaggcaggagaatggcgtgaaccagggaggcggagcttgcagtgagctgagtttgcgccactgcactccagagcctggctgacagagcgagactccatctcaaaaaacaaaacaaaacaaaaaaacactgtgcttgctcgcttacctcctcctcaggtcatttcctgcagtctctaagaacagtccgcctggcttccccatctcctccctgagcgccagcatctggggcgtgaacagcacaatcaaggccacacctgtgagaccctcagtgcgtcagcagagctgtgtcctggtgatgtcaagggacacggggtcagcaggggacctgtgaggctgtctcagggggtgagcatgtctggccctgccagctgggaaggccctcaggaggttgaggggagctgagcacacagtgagctcactgagctgagatgggaagtgactgcagctgtcaggaccttcagggacactcagtctaggatcaggctctctcaccctgtggggcctggttcaggtcaactcctcatcctcctcttcttcctccagacaagagagacattgcctatggctgaggggtcctggaggtgatccgggtgcagggacttatttgaatgtaggaaattctctcccagtgagacctgtagagactaaaagagcgttaggaacattcactgttacggctggagtcttagggtgcagatctcttgagcacctgcaccatggcttggcccctctgctttttgacctcttccctccctgcccagctgaggcacatcctgctctggggagaagggtctatgcggtcctcagcccacctctgctccactccctttctcacagggctcattgttttctctttctctccaccctcctgggtctgtggtccacatggcactgacagcctctttcactgaccaagcctccgggactgacaattacaatcacccaccctggaaacagccataatactgtcaatcaaggcacagcttggattcaggagcacctgggacatgtccccaaacctcagacccagagggggtaacaaccatccctcagggacctcagggaatttcccagccccatgttaggcagtttggcctccctggccatctctgggctccaggctggcgacggtgctgattttcactatttagcacagaatggcagcctcgctgattattctctgattatctggatgctctgtgactccttctgtgcatctctgggatcatcattcagactcacctgcaccctgagcagtaacatcaatgttgtttgctatgacatttactggaaacatgacagggcagggagccttccctccctggtatctactgagattctactgagattcaagcagaaccagggctcagggtccccagcctcttctccgtgtgagtgggtgccgtcgccagtgctgaggctttccatatctttggtctcaagcttgaggatgaggctactcatggcacagtagtgcctctcacagtgccatggatgggatgttctctctaaaatagaagtctttttttttttttagtttggcccctttgataagtagattctataataattaaagaaaaaaagtaatgtcttttttggagagtagaaacactggtgaaagagaaaccgggaaggacttggcatggggggtgggtgggcttcaggccacggctctgacccccacgaaaggagagaaggaagggggattagtaggaactgccccagcccacaggcaggtcagacctcagacaaagcctcagccaactgagtgggttctttcccacgggtgcccattacaagtgccctgcttcctgcaggaagacctgcctggagggaccctggggtccccattgcctggagccagcccacgggcaggggacatgttagtcacttgtggtcctcctgcacgttctcccaaagaggcatctgagtgggacacttccacagccgccaccagcactgctgctgcattccccctcaggacaggggcagtgccttccttccccggctcatctacctgagccccatgtgaagtcaaagcttaggtgtctcagggctttcctccaacaggccctgcagccactgagacccttatataccctgagctgcatgctgtggagagagggtctgtggaagaccttggctcttagccatcgactcctctggggaacaccatgaaatcctcagactggggatgtcctctggagccatctttatcctcttcttcttcccagtatctcctgctccatgatctgggtcctgtccctggccctgttgcatctccagtgtctgatccatgccagcccttccttaaatatgtgttgaacccatttcccatttgcccaagaaatgagtgctggcaatgagctgcactttttttttttctaaatgggaaatgggtcaataaatgaatgaatgaatgaataacaacgcaacctgagtctcctgtcacatggttattttaagacctgcgtttttctttacccaggaggaaaatgagtacctgcagccgttattgcctctgaattgagctaacttgtttctacactgtcatgccatggtcacagtgggacagatgtacaccaagcctaccatagctttcagccctgcccttccacccgccccacctgtggcagtgatggcatcaaggcttccctcagagtcggcctctacccaccacacactctgggccatctcctgctctccaacagcctggggttcagtgatccctgtccatgtgttctacctcagagacacctgccactcctccccttccctaatttctctgccatcctgtttctccagcctcccaggaatgtcccctgcccaatctcatgtctcaggttctagaacttgtcctggaacttccccagagctgagtctctaataggagagctgatgacaggcacagccgtggtcaagccctctagccagcagatggaggagaatcagcctgagggccctgtgcatcctccctgctgcacacctgggcccatagccccctccaccctccatatgctcctgcagcccccacctcagtgtctgcctcagtgtctcctcccagcaccttcctcaggaagggcctgagatcttgcatggtgtgtttccccttggtgaactcctagtcacagcagcatcccgagtaagagcctcctggtgaagagatcgtcttggtgctccaccctggcattgtgtcctcagctccagggcaggtcacacgctttcctggaccaagattacatgcaggccacccctgctggcccctgccccacagagggaggcccggggtcaggggtggcaccaagaccacagctccattgatccctgtaggaattcttcctgcatgtttgaaagacaagagttacagaaacaaagcagagggaagattctgggtcattgcaaaaggagaaatttgcctgcagaccagcaggggacgcggtgagaccttctctgtgtatttctgcaggacaggtgctcacagctggggagccctcaactgacagaggcccagggctgctccttcatttcctcctgggactctgcagccttgtcccatctgtgcctggcagagtcctctacacatgaccctgtgtgtggtcccagcagctgctgctttctctggtcccacccgtggggcaaactcttgcttcatgccagcctccctgtccaagggcctggtccctgcgagtgcacctgggggagaggcaatggggaaacacatttgcatggtcagcccctcctctgtgagcccagtgacgctgggataagagaggcctggggcagcccacccctaggtctgtggcctcagaggcagctgtgtccactatggccctgactcctctcctcctcctgctcctctctcactgcacaggtagggacagggctcagagcccagggtggtccccagcctgatctgtccctcatggctcagatccctcagcagctgcgccctgaccctgctcctcactgtgctgtgtctgtgtctgcaggttccctctcccggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaatcacagtgagacagatgaggaagtcggacaaaaaccaaggttttaagcttgtcatttttactgaactggttaagaacttcagtggttaataaaatcacattaaatacaggattgttgttaaaaatggtggcacattataactctctcccatttttttcacataatgcccatagtgactctaagcagctaaaatcaaaacacaaaaacttataccaatactaagaaatactaacattactaaccaatttccactagtaaaagagttgtgaaacagctgaaatacatccagatggcataatacataataccactatatacaagagttgtataaaattatgtatcatgtatatataaaattatgtatcatgtatatgtataatatatgaaataaaatgtcagcagacattaccgtcttcccaccagtagccagcaattctgccctgcctctagaataaatggttaccacgggttgaataggcgaacagccctggcagctctgcaggatgactctcactgtttgttattgttttatttttaagattgcttttctttcctattttttttgaggcagagtcttgctgtcagccaggctggagtgcagtggagtgagctcggctcactgcaacctaagcctccctggttcaaacgattctcctgcctcagcctcctgagtagctgggattacaggcgtgcgccaccatgcctggctaaagtttttgtattttttagtagagacagggtttcaccatgttggtcaggctggtctggaactcctgacttcgggatccgccgtcctcggcctcccaaagtgctgggattacaggcgtgaaccaccgtgcccgacctcttttttttttttttttagtttggttttgttagtttagttttgttttatctctttaacttgacagtcagagatgatccatgtggatctctgcatgggtctgggagctgcaaggctcctggtgcatggcccggtcccgcctgccttggcagggctcctccacctggctcctggaggagcagctgcgcccgactaccctgcatggagcccgcggcttagcggcagctcgggaggggcctgatagaaacttccccctgagcaagcagcgccaaacccaggccgccacccaggatggaggctgcatcacccccggggagcccggatcctcgccagggtccaccaggagaagagcacatggcggagatgagcctgcggggctgggagagagagaagacacggcgaagctgcaggtgaagacgctgcactaaggccccacccagaggctgaggttccccgaccagaccagcagcagcgaggctgcccagagcggcgccagcaaggtggttctctccaggtcggatcacaggagaagctagccttgcacctggcccaggcaagaagcaggacatgggcttacgcagaagaatcagcaccgattccacatcattccccatggcaacggcctctacggtgctgtcagcaagacccagtgctagacccgagcctgcaccaggagctgcggagcggagggtgcgccccatcccgatcgtctccaccactttagctccctgggtgagggtgacacggggaagcttattatcgcggctgcccaaaacggggcgtggctgggtaccctgtgtacatagggtagatgctgaatgtgaatagcactgaactactagagggaggctggagaggcccacagtgtctatctaccatgattcattatttgggcccagaggattgcctaaggcctagtatttggctcagttggctcagtaacgggcactaggatgcagtatttgatcactcctatcctaaccaagtacgacaactggtgcaaacagactcaaaagcaaaggcaacgcaatgaataacttgctcactctggggccacatatgctgaataaaatgcctacccttgaaatgtctgaaaaccttacaccctgggaaaattgcatacagaacttgtgcttggagaatgacatgaactctaatcagggtaataacacttgtaaagttcctaacagcttttctttccttttttttttttgtttttgagatggagtttcgcagtgttgcccaggctggagtgcagtggcgcgacctcggctcactgcaagctccgcctcctgggttcacgccattcccctgcctcagcctcccgagtagctgggaccacgggcgcccaccaccacgcccggctaattttttgtatttttagtagagacggggtttcacggtgttagccaggatggtctcaatctcctgacctcgtgatccacccgcctcggcctcctacagcgctgggattacaggcgtgagccaccgcagctggcacttcctaatagcttttctgtgagtgtaacgccataatcatcttttaaaatgttttctcggaactaaaagttgctgggcgcctaaatgatgttgcatgatagttttgggtgattttactgcatctgtaattttctgtttaagtgagcaccgcttaatttgaaagctaatttctcacagtgtaaatctgttcattcctggtagtctattttctacaaaagtgtatttttacacaacattaaaaaatggtgtaccttcatctatgacagtacattacttttgacaagcagctttcaggcagaaattaagagaagtgttttatataaaatttattattttgaacagagtttgtgatttggtagttacgctgttgaaatttgaattttacaattcttagaaacttatattgatgcattcttgttaccaaatgattggcccattacattttgatacaaatagatttgttgttttggaaccattatttgtttagaaatggtcaatcttttagagagaaatacttaacaaaggattgtgggaagttttttttttcttcttctttaacggattgtaccaggtcttacttgaatgaaagtctgatgcttgctgatggcagagtgactaatctgcactagattgatgtttagagcagaatgttgggtgatctcaattgtttttatttatgtttgtgattttgttttaaggtaatcttaacatggtataagactctgtgacaagctaaacctactgcaatatagcatgttggagtcccctaagagttttaaaagctaatggcataaatgcctggagccaacctcggcagttatttcatagcagaagataccgtcttaatattccttttaaattcttttaaaaggcaaaataggatcatcctattttataatgtacaaatgtctgcagagattgtatggtttgttgtgttaatgtttcccacctaaaatctatcatattgccactttgcctaattgtagtcacatttattaagtaatgcagtttgtactttttattttgtaacattctgtgatttttgtacaacattgtatttgtacaatacagcaattcccagttgattgaatgaataaataaaatgtaaaatcatactttataaaaagatctatgtggctgatagaattctgacattcccctccaaatggaaagtgatgtgtttctttaaagtaaaggtagaggagtcttaaatataggtgttcctgcccctattgagaggttttcaaaacatgctcttaatttaacgtttaaatataccagagtcttagaatgtgagaataatgaaattggtttgttttaattttgtgataatattaaatctactggaaagaatattctcctttgaaaagattctcagctcagtgatcatagaacctgtacttgcgtttaattcaatgaggaaagacatagaaatgccacgttaatatcctcatttaggtggtttctcccttcactgatcagcctatgaatgtgtcaatgcagtactccccagtttaggcttaggtacttattgaaaggatgctgcctgagcatttttaataattgctatttcaagatcacattttggccatgaggcaggctgccactcactttaggctctgcctaggcaggaatgggtcctggaagacacatgttctctctctctctctctctctttcacacacacacacacacacacacacacacacacacacacacacacccctctcttctctctgggtacacattattctggacatcttcagtttccaggattctctatgtctccagctagaagtcagggcttagcctgtggtgatccagccaccctcaggttgaatctcgatgaagtcacaggaaccaccagtggcatggagggtaagggatcctgctatcaggttcagccaggaaatgctctggacacctgctggtggaagagtttaatgctgggcaatcacaagtcaggtcccttcttccagtcggcagttcagcctccctgactttctctgggttccagtcagtgcatgaggatgatggtgacatttattcaggggcagcacagcagcctcagtcaccaccaacagtcactgtcatatgagaaaattagatagaaattggccttccaactcttctgtcagatccatctttgccctttttctgcctgcttgagtgaatacgaccaagaccagctcaggtttttgctgatgctatcacacgtgctcctaaaaccagaaggcttaatggtattttctgtttatctttacggattcaatgaaaagacaccttttcttactggtctcccaatgaaaacataatcactatgtccacagtaacaaagatagccctcgttgttgtctgctgggatgagaagagcagcagaagtttggcaggtatggccctcatgggcttcacatgtccctacatctggccctggctttgctgatcaccctttgggctctgaacccacagggaagttaggtttctctttcttttgagattgcctctggaagagctgctctgttcccaggtgcagggcagcccctccgcagtaaggacccagctctcagagccatgaaggcctcaagcctccaggttgactccacatttctagtgcttgtctctggttctttggttggaaagatgttggatgaatagaagttctctgagacctaggctttgtgaatccaacccccattaaatccagggatctttttaacgaataaaatgaatcagggcccagtgatggtggggaaatgggacgtgagggttcctcaggccagtagtatggggagaacatccaaaaagaaaggaggggttccacttttgagaattgtctttttatatccatccacatattgacgaaaattataaaattagactaaaataccttaaatatataacatggtcaaaagaaaagaggtattaccaggataatattaaatagtaaaagaagtcagaggcgaaacagagcaagagacactttttttctgacagcatcattcttatgggctataatgccaaggcttgtgcagtaggagctgaaggaatctcacaggcgaccctcacgacaataatgacaataacaaaataagtcaacctctaaaagaagcccatgtagaattatccccaggtatgaaccacctggaggctcagcagaacattaagccttagattgggttcaagatgaccacagactggtgatgaccacaggcccctgggagcaacacactcacacgcctggtgatgctgatatctggtaaatcatcactgtgcatcctgaaacacattctgtgattagctctttgcagaccataactaacatgaaagaaataatgcctcagctgtaaacactgcagagaggacccactcattctactcccttaggtcatgagttgaaagatccatttgcaatggtcaggatgtccttccagaagagctgggtctgttctgaggggccacccgacttgggatcggagcccagcagggggtgctgttggactgttcctgagagggcagggctctgggccaggccacataggaaaatactggttctcatacacttgagcaagcagtgtcctcactgaagtatgacttcctgcacctgcaccaccgagcaggagccacttcctgcacctcaggagccactgagcactagactcacacgccaatgcttcctattttatcctccgccctcatggagtccttgtccaagcctgcccttcaagcagagacaaatcacacagcaggaacaaatttgctcaaaggaacttgaactacaatgtttcctgggcacagaatgagaaacacttggaattggggaagttcccatcctaacaacttagactcaggaagaagaaccctggagcttctccagcatggccagaatctcagtccacttcaaaatcctcagtctttagatcaggagttcttttagggatgaggtcaaggtttctgggtgcacattaccactgcctttcagtcctatcatctgggcatgaggagcttgttatctcgttctatccattatttctaaacctccttgtagagggctgggttagagagtgctaactgccatttatacagtctggacctttgtataaaattataaacacacacacatacacacacacacacaaacacaaacacacatacttattttgatgttccagcgaaagagtaaaactaaactcaacagaaacagaaacagatttgaataatacaagacaatctcattaatgaacatagaagcaaaactctctcagaatattagcaattagagtccattttatatcaatgaaggattatcttgagcatctgggaggatgtgggttgagacatttgcacagtcattggaagacagtgaacatgatttttgaaaaaacagcatgtttagagatatcaaccagaggtcagatgcttcaatcagagaaagatcctctgagttctcagggctgcttccctgaaaagctacgggagaaggaaatggagtgactggacacaatgccaggggattcattgaccctttggcttcccatgggcagcatgcatcagcatggtcttacaaggatgaaaaagggcatccctcaaaaaagaccgaccatttccccagaaattaataaagaaatatcatggccgggcgtggtggctcacgcctgtaataccagcactttgggaggtgggcggatcaggaggtcaggagatcgagaccatcttggctaacacagtgaaatcccatctctactaaaaatacaaaaaattagctgggtgcggtggcaggcgcctgcaatcccagctactcaggaggctgaggcaggagaatggtgtgaacccaggaggcggagcttgcagtgagcctagatagcaccattgcagtccggcctgggcgaaagagcgagactgtctcaaaaaaaaaaaaaaaaaaaaaaaaatcacagtattttcaccagtgcatttctgtttgagcgaatatgttgggtgaagaaatatataatatatacttttctaaatgaaatttttatctcacaaaattgtagaattaaatttttgttttggataagaaatcaagaaacaatcacacacattcttatgatctcatgaaaaccaggtataggaaaggaagtgacgaccccaaaattcatctaaaaagtgaaggttttggttcaaagataagagggttgtcatgttcaagacaaagtcactaccattcgtggtatttaaagctgttggtacaagtgcctatcattgccgattcccttcaaatttcttgtgtatgtttggatcttaaacatgagcacacacaaaaagagaaacagcaaaactagaaaacagatttacctttttgagtttccaactggaggagaaaatgaacaaagagtaagaatatcacatgataatgggaggaggagtgttaggaaggtgatgaggagcagttcagccttcccagcttggggacagtcttagtggagcagagaaacctccttcctgctgccacctgactctctagagtagatgaagaataaataactaaacataaaaagcccttaggaaaaagattgtcatgatgtcagtgctattaatagttcagttaataattctgtaagaatatgcaaaaacttactggctttttaaaaatttttatttatttatttcttttgagacggagtctcgccctgtcgcccaggttggagtgcagtggcgcgatctcggctcactgcaagttccgcctccagggttcaggccaacttactggcttttatatttggaatcacaacctgaaaggctgcagaacatgaaaggaagaaaactcagattgcagtgttcattctcttttatattatgagtttcctgcaagagctacatctgttattatgcaaaaacaaacagataaggaaacaagaattatccagcctcaagagtggaataaaacatgcactttttttgcttgtaggcataggtgagtaattcagacacggctgctgtgggtgactcatttccccttatgatggagcctcagcaaaaaagcttcacagattggggctgatttggtatgaaggggttggaatcgactgaaggtgacctcattgagagtctgcagtgaagccggccttggctgaatgacctacctgaggcctcccatgtggcctgggtttccaggaagctgggcagtcccagagaattcagagctctgacttggtttataaagtgtcacttccacagaaactgtcagtgccgagagatcactagtgccagatctggttaacagggaggggcctgatctcacccctcaacggaaggtgacgggaaaacaaaggaaaagctgtcttcacatcaacatgggcagataccactttaaagcatattctgtagcagggttcccactccagaagctgtggtacaggatgtgtctcctatggcatgggccaagggagggtaaaggtgagtttgacatctgtctcagtcaccatgaggtttttctgacaactaaatataaatatgtaaggtgtctcacagcacaatcatgtgacaataaatgcagtgcgtgccttcaatattgctctatcaaggaggctttccctccactccaggtgtgagcacgtggcttgcatgtccctccactccaggtgtgagcacgtggcttgcatgtccctccactccaggtgtgagcacgtggcttgcatgcccctccagcttcctgcactgtggtcatactgctgctgcctcattctcagcctgagcatccctacacaggcacaaactctatggctcaggctggtcatcactctgggtccacagtagctggtcagagagaaactgtcttcagccctgcccagcaggagaaaagagcattccagactgatcagctgggttcctgccatccagaagtccttgtctgtctggaggctcaaaacatgactgtgattcctttgaggactcctcccatacccaggctgtgggcttcgctgccctcctcaggacccgtgcagcctgttctatccctgcctcagctgcaggcaaagctgcttgccacaagctccctgctcataggatgccggagtcctcccaagggctgctcttcctggagaagaaggagaaccaggcagtaaggtctacctgagcatcatgggaaggaagtgatccgattctgactccggtgggcgcacacccttggtgctttgtgtctcctgctatcccagccacaggagtgggggaaatgtgtgagttgtagtcctagccgggaataatccataaaaggtgaaggtgagagaaggacactatgcatggtgtcaccttgttttcctcgttgtttcagcggcctgagtcctgtgtttcctgaaagatctgtggctcgaggtgacacgccctatcaggggacaggaatcaaagaggagaatctctgatggaaaaattcacaaaggaagagggagataaaaattgggcaacatgctcagggtgagaacgatggctttttgtccttgtgatagtttgctgagaatgatggttttcagcttcatccatgtccctacaaaggacatgaactcataattttttatgggcaaggacaaacaaccaaacaccgcatgttctcactcataggtgggaatcgaacaatgagaacacatggacacaggaaggaggacatcacacaccggggcctgttgtggggttgggggagtggggagggatagcattaggaaatacacctaatgtaaatgatgagttaatgggtgcagcacaccaacatggcacatgtatacatatgtaacaaacctgcacgttgtgcacgtgtaccctaaaacttaaagtaaaataaaaaaaaaaagacggctttgtgtcaagggctatttatttagtgtctctcgttcccattattaaataatttaacaacaaaaattgccttttctatgaattttcaggaaattctaaccatcattcctttattaaatatctagatatgtacatctacacatatgcatatacatgtgcatatatagacatatattatattatatatatttgtgtgtatgcatgtgtgtatatatttatatatatatacatgcatgtgtatatacacacacaaagacaaattaagaaatatgggaatatagtatacttctttaatttcttaataatgtccatttatatctaaaaaaaagatacccctaaggttgaaccactagaatcattttatttttaatgtggaacaatagaaagcttatggcccataaagatattggataacatatttttctagcaatatgagaaataagcaaaagtgtaaaacatttaaatacaataatttaattcaaaaatatgaaataatttgtattttttagttgctatgtttatctaccaagaaggcattatattattctgatgttcttacacattgttgaattaaagcttgttaaatacaaatgttatcatatgtgcaaatagcatatcaacatttctttttctctcatatattttcagaaatcactttaaaatgtagcagttcataatgttgacaaaatatcaaaatctataaactctgggtttaaaaaacaatgaaatacacagtacacataagaaaatagtgtcaaagctcactactataagagacaatgatcaatattgaaattttctcttacatgaagacgctcaaaacattttagcagtgactagtgaggttgtatccattctcttatgtttatatttatgtttaaaatattgtccttgagaaggagtgtaggtaggtataagcagaggtggctgtgcggatccaagattctagcctgcccccttgatacagcccattaccctagtcccatccaatctcacacatggcccatcatcatcttctgacttgagcggggagagagacggtgggtagagagggaggaaaggagttagttcagagcataggagacgtggtcagagagttggcagagggagggagggaggcacattctgtgggttcacgtggtgctttgacaactgtggatttacttctgaatgaagcatgaagtcattgagagtgtggaacagtaaaatgatattgcaaaataaaataaactaagattccagtgagcatgttgggaatcacaaacactcacagctgggtgaataaacaagtgctgccatctggagaaaagttcctcagcacacaaggagaagtgtgtttgcctctgtcaagcagaagtccacctatacagagacacaaggaaatgtttataaagagatccttattcggagcaaagtattggaagcaacataggtgttcaacacaagtggaatttataacacaaggagaagataaaatgctagccagttggaagtaatacaacttcttatgcgacacgaataaaaatataattatcagttgaaaaacaataacaacaaactcccaccaaattaaacaaaatcaaaagctctcaagaaaaaaacaatgtgccacttattttaaagcagaaacatgcataacgaattcttcaagcttatataacgggctttttggaaagtagactggaggcacattatttcacataaatgggtgtcttaggaagagatggagacacgtataatggctaaaaaatgaaataaatccatagagaggtttttagtgtctagtgataaaagtactaataatattacgtaattaaattccaaaaaattaatacagaaaaatattcttgatttgggggtggtaacagatgattaagtaaagcgagtctacatgagctgctgatgcagtggatgacaagctctctgcagctcattgttagtgagaaggcactgctttgccagaaaccccttttatttagatttctcatggtccctgggtccctctccaacaccatgagcagcttcagaagaggatcaggataaccagtgactctctggctaccatggcccagttgtgtccgagaggtaagaaaggtttgggatcttggacagagtgggacagtgggagaaattcctgagatggccccaaccagcctggaaaccactcagaacctgcattgaagtttagccatcagggtgctcttgagactcggtttgggctgcaacacagacctgtggggacaggggtcaccataagccaggccacctccacccctgggtcagctcatctcctccctctctgcttcagatctttgagtaaccagcacatggaggcccgggaaaagtcagagagcaagatcttatttaaatgctgtgactccacccccatgaaggctttgggagctataaaaaagagacttaggggagcccagtctccaaacagagcttcagcaagcatagtgggaatctgcaccatgccctgggctctgctcctcctgaccctcctcactcactctgcaggtgagagtggaccttacccagggatctgcacccacctctgctccagcttctccactccctggctcagtggactctgatcctgctctcacattcctttctgtcccctctacagtgtcagtggtccaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctcacacagtgcctcaggccagtggggaagtgagataaaaactcaagagctccctcggcctcactgaacaggcctcacagagcactgtttaaactggaccacccaaaagacaagggatgcattcacaatagtgtacactatttaggactgttaaaaataggaacatgaagtgaaattagcaagcctgccttattaacaaatgtgtgtagggaacatcattgtttatatattagtagttacatatatataatactagtgcatgaacatacatatgcactagcaattagtaaaaaagaaacactaggtttaactaaggaaatatttattattccagagttttcttatccattccatttgaagatgctgggatcaagtcaccgagggtgctgctctctggccttgagaatccactcagcagggccaccagcagcccctcccttctgtggcctgctcatgccctgtcttctcattagaatccccttccctgctgtcacagggatccctggactcctccagatccaaatatgtccaatacatttggttgaggcctcctgggccccacattactgtgtaatctcaacacccacacactcaaaacagtgttcccatgcgtattcttctttcgactcatcactgtcctctaacagccatgggcagtgtgtggagagagcaggtgaagttggagctttggggtacagttgacagagatgttgacattttgagaaaaagaaaacacctatatagctgttttcaggataattttccatcaagataaaaatccacgcatgagagcatcactcttccagtgatgaatgcatggaggatccttctcactctattgttgggtagtgacacctgggaaacttactgtgttatttagtgtgcagacagctggtaaaccactcagctgactctagggaagttgaccaaacagtgtccccactgatgtgtgacttttctccacccatgaggccccactaccctgtcacctcctgagtccacctttcccattgcgttgctttagatttgaggcatctctctcttacctctttaaagtctttacccaagtctggttcaggaagtgctgatacacggtgagaacccagggtgcatatggatggagtgattctgtgcctaggagagcctggccaggggatccaacacagcttgtggccatcctccccgcagtggagcttctggagacagagctctgaggtgtccccaccacaccctggggcctttctccctcagttctttataaaagggatatttgtcatgggcttaggggaagaggccgctgaggtcacacaagacctgccttcttgctctggctcacaaggcacaagtgagctgtgaccctggactctgtgtcagtgctgtggtcacttggtcagaactaagggaagctggagaaatgtgggtagctttgatgcagtctggcaccagaagctccatcctgaagcactctgaaggtgctgatggctgttcactgtgctgcaccctgagcaggaggatgatcatcatcgcagacctagggtgacagcctcagagctgaaatattcctcctggccctgagaaaagtgggctaaagttctcccttctgcgtgtgttacccagtggtttgcccccctttcatcacctgtgaccaacatgggctcattggggatatttgtgctgtcatttctggcacaagaacccaaagatctaagaccataaaatgcatttggtctttcatactgtctattcccatcagggcagacatctatccattaatacattttatttaattttcttgtcttatattttcagagcaatgatgagtaatgagtgaggtaaggggtacctttgcatttttttgatctcagggaaaatgtcctccatgcagtaagatgatgactccggaccaagacaggtgtgtgtgtgtgtgtgtgtgtgtgcgcgcgcgcgcgcgtgcgcgtgcacacgtgcacacgcatgtgtgttaccatatcataaacaaatttatctgtttctgtattcttacgtgatttttattagggatagatattaaaatttgccaaacacattaaaaatctattgatacaatatgatctttggttgtgatgtaataatatggtattataccaaaacttttattaatgttgaacccaaccattattttaagtataaatcccacttgacaatggtgtataaatgcgtaaatctggtgttgaaatcagttcgttcctcaaatttcctggttcaagtgatcctcccacctcagctccttgagtagccgggattccaagtgggtgtcaccatgcctggctaattaaaaacaaatcttatttgtctcaacatattgcccagtctggtctcgaactcctgggcacaagcgatcctcctgcctcagcctcccagaatgagttaacattttattttaaaattttgcattaatatgtttattttattttttatttttaaaatttttaacttttattttaaattcaggtggtacatgtgcaggtttgttacaagggtatattgtgtgatgttgaagtatacaattttatctttttaaattgctcttaatacatatttttaatttaaatttcaacttttattttaaatatagcaggtacacgcgcaggtttgttacatgggtgtattgcacccgggttgtgagcattgtacccaacaggtagttttttacaccattccctcctctccctccccctcctagcagtgcccagtgtctattgttctcatgtttatgccatgcgtgctcaatgtttatctcccacttaaaaatgagaacacgtggtatttggctttctgtccctgtgttagttgcctaggattatgtccccctgctgcatccatgttgcttcaaaggacattattttattcctttttatggatgcatagtattccatggggtatataaactatattttctttatccaacccaccactgacgggcacctaggttgatcccatgtctttggtattgtgaatagtgtggtggtgaatatacaagtgcatgtggcctttgggtataatgatctatttgtctttggatagataccctgtaatgggattgctgggtcaaatggtagctctgttttaagttctttgagaagtcttcaaactgctttccacaatgcctgaaatacggtgtatacgtgttttctttactctacagcctcaccatcagctgttgtttttttactctaattatagccattctgactggtgtgacatggcgtctcattgtggttttgatttgcatatcttgatgattagtgatgatgagcatttctccacagttttgttggccactaatatagtgcagttttaagttcatagcaaaatacagaagaaggtagaaagatattccctatcctccctggctccacacatgtccagccttcccccttatcaacgggtcccatcagaaatgtacatgtcctgtaattgatgaaccacattgacaggtcattatcactacaagtcagtattttccttaaggaatttttctcgctgatgcacatcctatggctatgggtttgtgcaaatatataatgacatatatccaccattacagtatcatgcagtgtatttcccttccctacaaatcttctggctttactgattcatctctctctctcccctaacctttggaagtcgatgacttttctacttttttcctttgtttgactgtaatacacttgaaattatttccccctttttggactgtaatatacttggaatcacgtatcatgtcatttgcaggtcagctccttttacttactaataagcatttaagtttcttccatgtcttttcgtggtttgatagtgtgttgtccataaacatgtagaatatattaatataaagtactttggagctgatcacatcactggccattcaggtttttcaattactgtttgttgaatgacagtgaccagtcagatgacaggaagtcttagaccccctgagaacacagaagatggactgaggatgtcagggtcaccgaggactgcactgggtgctctcatggagggctcagtaggggtgtcctctagttccagtgagcctggactgtgatgggcactcagagaagggtcctctctagcctagcagagcccctgctcacaggcctaccagctgtcccagcagctttccctcccaggtccttccgtggggcagacagagtctcactgcctgttagcccttcctacccacaagaccctcagcaaaagatccttattcagtgctcagggagaggtggggcagatagcagctggggccacacctgcatgaccagctcctcctcgctgaggcctacagcaggtaataaactcaatccatcccactggaccaaagggagctgtgtctaccatggcctggacccctctcgtgcttgtcctcactccctgcacatgtagggaaaaggcctagagacctggggcagttcccagcttgtgtcagcccctctggctcagacttgccaacagcttaaccctgacacctgctccaacaatgtaaatgtttgcatttccaggttccctcttccaggctgggctgacccaggtgtcctcactcccagcatcttcatgcagatcaaacactcacctgcactcagagcatatcggctttcatatcggtggcaaaaataccttcttttccctacagaatccagggagccctccaactatgttctgagattatgctcaggctaaaatgagtaccaggcctctggggtccccagacaattctctgggttgagaggctcctccagagtctcaagttatttggtcgtctctggccttcaccttgaggatggagcagatcatctctctcagatgggctgacagggcatggcttacactgtgctctaggccaatgggaaaatcccctctgcttgtgctgcctgggctcccactaggcccctgctgtttgtgacaacagccagcactggtggtgacgcttcagccatgtatgccctacggtgagagtctgcagcccttccacgcaactatcacttgcagaatgtctgcatcattgctaatagcacattctgagcctcctcacgtttctgtgggcaacaatttccttcccaagacgtgcacatgatacaggagatttatttaccaaataagtttattaggaatccaattataattagaagatattcatcagtgatcgggggaaatacctggtataattaaaatagaatttgatgaaaatataaataaagaactaaattatgaaggtgtgggcagagagtctggacaccctaagggagatggaaaaccattcatccttgccaggaatgaatgtctctgggatgcttctctaacaggaggaacctggagtgagaccaggaacctggagaactagcagctgggtgactggaaaggaaaccatctggggtggggttgggtctgcaaggcaggaggtgtctgggcagagaaagcagggctggggcggagggtcctgcctcatcccattctcctgctcactccttcctagatccctgtcagggcagtaaccatgagcaaggcttgaggctacttcttataaactgtggccctgggcacattccttagctcacctgagcctcagtttcttgatgagaaaaaatcgggacaatagcaaccaacctatctcagagggctgctgtgagaccctgagccactgtttctcaaactgcccctgagatcacctacaacagaatggctgtagggtgaagtttgagaaccgcagtataggtgaggtggtgcgtggggcaggccctcccacactgtaaagtgcagtgtggtgcggtaaaagctgatattcccgcaggcatcctcagagtgggcccaattagactcttgagcactgattccattcaaggtctgcggcttagagaggatggcaaagtgaggcaccaccaggagcttgtccctatgggctccaggccaaggacgtgcctggagatgactcctgccttgtggcgctgtcactgcctcactgtccacattccatcacgcctcagatcctggcttccaccctggtgaaaggaatctttcaatatcacccacccagccacagacgcttctctgcttctctggcaaggctgcaccccctggctaggtgggcagggccaggggctccttgagacagtctgcagccactgagctctccagcctccagggcagaggtacagtcccatggagcgtggctgatctgaaggcagttctggcctaaaaggggtcttgtcccttcctcgtcctcattgctcccaaggccaggttggcagcagtagcagcggggttggatgctattggatgggagaaggtgaatggactcggagtgcagaatcaagctgcggaagccaagggccttgaaggagggtcacacacaagggacaactgcagaggaaaataaaggaacactttgtgattagccctgcctgtggctgaaagcgcagtgcagaagcatagtaaggaaggactgggtggtctgggtttaagacctaggaaccgtctctgctcctccaagcctgaatgagccctataacctaagggtcctggaggtcttgaaaccttctgcggagaaggctccaggtccactgggccctgtgggtggaagagcagagtcacagccccgcactggggacctaacaggtgtggccttgctagggccccagaatgggaccagagtgggtgggagggggcagaagctctgagagcaccccctccttcctgaagcctgtgcttctgagacacatcccaggaccctctatgtggttccccatgtctctgtattttcattcagcttcgagtagctctccaaactgtgttccagggaacccccgtgttaacctgtgagggcctccaggaagggggtccaggtggggtatgcttggtgggctctgggtttccttacaggagctctcatataagtcctggtgcagcctgggaatctactactgagttggggcgggggcgggtctgagtccgaaacattcctgacctgcccctcaaagaaaggtcccactgaacagtctggaaagctgttttgctgagctcccgtcatcactcaatgaggcacgggcggagtgtggagggagtttccaacacacagtggatcccgcacaggtgtctctcctcgggtggctggggaggggagcacaagaaggcactgaggtcagagggcagctgccaccagcacctggcaccacagggcagtctggcctacagggtattttctaaacctggcatgtgaatgggttccatggggcacccagctgcctctaagaccataaggccttgttgtgagaatgggaattgcagcaggtcctgggaagctgccagacgcacacgggcaccatgtacagggcttctcagagatgggagcagggagcaggggacggagaagcgtggggtcaagagcgtggccctgagcagggggctgcagcgaagaccaaggggattcataagccagatccagggagggggtctcccagccccacctgctccactaaactcctctcctgccggagccacagctgtcaaggccgccttccttaaggcatcagggccactgcttgtgcacacagctaccatcagcagcacggattgagatggggtgtgagtgcaaactgggtctattccccagggcttcagggttggggcatccctgcccgtactgccagggtgtagggatagcagggagcactctgggcacgtgtatgcaggctgaagggagacgtattgggtttcggagagggaaagagggccccacaggtgcccagggacacggtaacgctctgacatcgctgcaccagcaaaggggccccagctctggataagataaaatgcattttaatagtttgaagtgccatgaggtgtctgcatggcactgcagcctgggtgagggaggacagggtcatcatacaaagtaggcggccagggctgacatcttgtccttgggccgtctggggttgggcttcccagggggcctcctggcccggccccgccctcgaccctgccttctccctggtccaccgcggtgcatggggtggcaggaggccgcatgcttcagctccaccagctcctggaagacggggtcacaaaagacgcagcccatgtgctgcgcctcatcgcccgggagtggggacttggccttgttgaagtccacatcaagcaaggcggcctcacagacactgcaggtgtcggcggacacccgcacgcggtgggcgttctcgaagcagtgcgctaccacgttgcacttgttgcaggccaccttccacttggggcccgaggtggggtccagcaccagcaccccgctctcacattccacgcactggccgatgcccagcatgctcagcgagtgctggcaggaggggtgcgtacactcgttgcagcccatgcctggcgggagaagggagccctgtaaaggcacgcccactgtgcccacctgccctctgctgcctgctcccaatgcctcaagctcctggatccctcgtcccagcagaaggaactcttcttggccttgctcttggggacagccttgctcatgtttcggctcctggctgccattacccctgttttctgcttacctgaaacctcctcaactttcaaggcccctcgctggcgccatcccagtgggtttcagctgactccatcccccctttgctttgctgccagcttgttactggtaatgccacatgaccctcatgtcactgggccacatgggaccaccctgtcagctactctggcggcagcaggagggcagggatggggtctcactcccggggcagcctgggtgcagactgaggcctgagggggctttctgcagagcacacggtgaatgtgggcagatgcctcactcccgctgattcctggtctggctcggtgctctgtcctgcctgcctggacatgcgctccctcctccagtaatgaggacgaggatgaggatggaggacagtggtggacgctgactgggggtgcccgctcaccgggtgggtcccccgactgctgcatcctcttgctgactcagctccagagggagcactgcacacctgcgcccaggtcctgagggtggactagggttgcctgctcgattctgacacagagagagggtggcaccactggctgaggcctaagcagtgccccagctacatccagggtctctcgtctcagtgccaatgagtgcaggaaaggccagggtgaggggtcccctcagagtccagcctggtgcaaggcaggggttggcactgaacagagactgcagctacctgtggacaggagggagcggctgcactcaccttgatgctgctgttcaacaatggattgctgttgcgcctaaccaactttaagacttggtgggcttgacacaacttaccttgtgataggcagatgtgaatgtgtggtcaacaggtatcttatggtcctccgctagggccaacagcactgcagaagttgttttacaaaacacatgcaattcattactgcagactgcacttagccctgctaagtgcagggctggagggcctgtgctgtgattctcccactggagctcactgcaaattccacatggcatcttttcttaccaccgacccctccagtcccctaaattctgccgagtcttatggcccaagcagcagggctgttttcactgcagccttgtcaggcagcagatgacttttctacgccaggctgcattcaaaggtggcagccttctgtagaccaacgacataggccagaagtggaacatgctgttcccaaaacctgaagagttctgccaggcattatgtttggacgatctgacccatcctgccttgaccacttaggcactcaaaactgtactcacgtgacagttccctgaatcttcatacagattatctcctaccctttatagtgcatgtttcttatgaaggcctccaacatgctagccatttcctactaaactaactcaactagcatgatgtcaacaacacagtcaatcaatgggatattttgtggggtgctcagatggcagaatgctcccacatcaataaaactcacccttatctaatcttcatgttctggtccccctctatcacccaccctcatgatccagtcccatgcctagtcccttgactcctgctggtacctgctggttaggtcttatggctcctctggtgtgtagtcccttttcttccccttttaaaaaatgttttgagacagggtcttttctgtcccctagactggagtgcagtgtcatgatcatggctcactgcagctttgacctcctggggtcaagtgatcctcatgtctcagtctcctgagtagctgggactacatgtgtgagccgccaagcctggctaattaaaaaaaattttttttttttttttgtagaagtgaatgttccgctatgttgcccaggttggtctcaaactgctaggctcaagtgatcttcctgccccaaactcttaggctcaagtgatcctcctgattttccttatccccgtgagcctcctgaagtgctggggttacagatgtgaggcacctcacccagccttttctctcttctcaaaatgagcacatctcctgctgtgttgtgctgggacttaaccctagttctaggccaagagggaaattgggcaagatggtgaagaaggcatattttgtcctagtgagagaggcctctgcaaacaaaggagtttagctctgaataggctgagtttagtccacttctgcaggctcaggggattaaggaaaatcagtgacttaagattttagaggcctcaatccaaataactctatcaatatatatgagggtgttggccgggcacggtggctcacgcctgtaatctcagcactttgggaggccgaggtgggtaaatcacttgaggtcaggagtttgagaccagcctggtcaacataaagaaaccccgtctctactaaaaatacaaaaaaagaaaaaaaaaaaaacaaaaaaaaacaaccctggcggggcatggtggcacacacctgtagtcccagctacttgggaggctgagactcaagaatctcttgaacctgggaggaggcagaggctgcagtgagccgagatcgtgccactgtgctccagcctgggcaacagagcaagactctgtctcaaaaacaccaaaaaaaaaaaaaaaaaaagaaaagaaaaaaccctgacttttctccagcagtctggatcaatcaccccaaacagtccagtgacccctgatggttgagcagcagcactagaaccccaaatttctaggggagacccagcttccagtttattaagttccatgcacttaattcttgttctgcttgattttgggtcagcagttacatgaactcacgtgtttctcaaccagtgttctggagatctggctcagtgcagggctgtggtttcaaagttattcaagcaatgccaccaaaagcctgtaccccagaatacctgccataggccatcctgtctatccctggagacagtcccttcttattgaagatgaagcactttggcccgtagctggttgccagagctttcagaaaagcgtcggagtaaaacaaccatctctgatgacaaaagacttaaaatggctgtgaagagctctattaattcctcaaatattcattgctctattttttatctccttttataactcctactgccaggctattggcctttctacttctatcctctccccgacattcccatcttagtaaatgactccacaagtacttcagctcccattcaaggaccttggattacccttgggtcctctctcttactcaacagcccatcctatgccaagtctcaccaattcttctctctctctacacacacacatatacaaacttatttgtaaacaattattttaaaaaatctctcttctgaggttccagctttcttcttcttttatttttttgagactgagtctcgctttgtcacccaggctggaatgcagtgacacgatcttggctcactgcaatctctgcctcctggtttcaagtgattctcatgcctcagcctcctgaggagctgggactacaggcatgcatcaccacgcccagctaatttttttgtatttttagtaaagacaggatttcactatgttggcctggctggtctcaaactcctgacctcagataatctgcccaccttggcctccaaagtgctagtattacacgatgagccactgtccccagcctctctctcttttttttttttttttttttttgagacagggtcttactctgtcgcccaggctagagtgcagtggtatgatcttggcttactgcagccatgatctcccaggctcaggccatcccacctcagcctcctgactagctgggaccacaggcatgctccaccatgcccagctaatttgtgtattttttttgtagatacagggtttcactatgttgcccaggctggtgtcaggctcctaggctccagtgatacccccacctcggcatcccaaagtactgggattacaggggtgagccaccacacccagtcacagctttctttttagagttcaccacagtttgagtgattatttggaatttttaagtggcaaaaattacaacaatatatttgtaaatgaaagagaattgtgaaatgtatttgaaattttaactttaagattttctttaaaatacccatattgaatgaagagtatcaaagtaactattgcttaaaaaatggggcttcatttgggttaaaacacaagaatcatgaacatgatcaaaattcttcaaagtgcttgcttggaatgatacagagaggattagcaaatacaaatagtttttttttgtttgtttgttttttttttttttttttttttttttttttttaagagatgcggtctcactatgttgctcaggctggtttcaaactcctgagctaaagcaatcctcctgtcttggcctccccaagtgctaggattacaggcattgagtcaccactgctggccaagatgctgatctttttgttgttgttgttgttgcctaggctggagtgcagtggcctgatctcagctcaccacaacctccgcctcccagattcaagcaattctcctgcctcagcctcctaagtagctgggattacaggcatgcgccaccacgcccggctactttttgtgtatttagtagagaggggtttctccatgttgcccaggttggtcttgaactcctgacctcaggtgatccacctgcctcaggctcccaaagtgctggtattacaggcatgagccaccgcgcccagtgatgctaatcttatgaaagacaaccaacaacaaattctgaatactaaagtgtgcgaaatgtatttaattcttttcatagcacagatgagttaacccacgatgtgttgtcccaggcactatggagtcatcttgaatttcatgttctaaacaaacacccttggcctggaggaatgcacctgcatatcacgacaggacctagtgtctcagatttagtccggcagctttgaatttggaaatcctctttggagcttcttctgacacagcatcttttctctctgggaaggtaggtgacacctgagaacagaggcatggtgtggcatcagagatggaggtaagaattatttttctaccacaatcccaggaaaagactctcctgttcctggtgagggtgagagctctggctgaggatgtcctctttcttctttcttctccagaggatttttcagtctctctgcaaatggctgcttcacagccagggttcatcgaaacccctggatcgtcatggccagtggtttgcgtctctccagcgccactccatacgagggtctttctgcatcctgctctcatggtggacttctgagggccatgctcctcatttgcagggctcacaaatattctgtaaatatccaccagtgttctgataacggggtgacccaggacaaactgaccgtctccagggttcaggtcccaggcatgtctagctccctctttcctttcactgaaaactaatgtcctgtttttttccgtatctatatggacctttctgggttcagtggtgtgggaaaaatagattgttggtgaagactcatcttcatctcctgaactgccatcattgcagtgttcagagtggggatggtgcttggaatcattcccttgaccttgccttcgaccttgcattagttttgactttaaaatgtccttatgaaaattcccccaagtacggaagcccatagtctcatcagagatcccaccttttccctgttcccctccatttttttttcttttttgaaatggagtctcactctgttgcccaggctggagtgcagtggcgtgatctcggctcactgcaacctccacctcccaggttcaagcgattctcctgcctcagcctcccgagtagctgggactacaggtgcccgccaccatgcccggccaattttttttatttttagtagagacggggtttcaccatattggccaggctggtctcgaaattctgatgttgtgatctgtctgccttggcctcccaaagtgttgggattacaggcatgaggcactgcacccagccccttcccctctgtttgtgaactccatcccaggatcatggttgagttcacccagcaggttttcttgcctctccagttcttccagtcgagcccacagttcctcatttgtaagtaagcatccttggacttgagatcattttcaaaacctgaggttttggattttgaatcaggtttatgtgcaatccagggttttctctttaattcagacttgttttgaacatgttttcttaggtcaacaagatctccatccccatcaccccatccctgcagatctgctgtgaatgcaactttagattcaaagtttctcctggcttttgtaaagtcatgtagtgctttcctcacacactccttcctatgctccactaaccccactgcttgctttgcagagcactggcaaaaccagttgtccccgaggagaagagtgattttgctggtatccacaagccttcctggtatagaaggcaagaggcccagttggcaccatgagctcgtaagacagcctattgggcaaggtttggagtcgctcttggagggtattacagtccccctttaccttttgccagtgtgcaatttcatcttggcacctagagatcatcttttcctgttctccttggggcctcataacctgttgaggatgcagctgtttgaaggtggccgaggaggctgcacggtggggcacacggtggggctccatggctcctggttctgcgtgtgcgctgtggtcggcactgctcaggctgctgcccccagtcatggcgactgcagtgcccaacttcctccagctgagtcctcatgagatccttcctgcaatcagtgctcccagctcctcagtcccttcaaaagataaatcattccggagatgggcggtggtgatgtagcatgacaatgtggctactttcaatgctaccgaactgcataccaaaaaatggttaaaatgctgaattttatgttatgtatattttaccacattaaaaaaatattagctgggtacagtggctcacacttgtagtcccagcactttgggaggctgaggcaggaggattgcttttagtccaggcatttgagatcagcctgggcaacacagtgaaacccccatctctacaaaaaaactcacaaaattagctggccaagttgattgtgtgcctgtaatctcagcatctctggaggtggaggtcgggggattgcttgagcccaggagttcaaggcctcagtgtactgtaatcacaccactgcactccagcctgggtggcagagcgagatccagtctccaaaataataatagtaataaataatagtaataataataaataaataagtgataataaataaaaatatccacttgggataattatcacaagaactttgctgtcatggttgtgattttttggaacaaattctcatggttctaactaaaccaaatcaaatacaacattgatttgaacgcccatgctcacagcagccttattcacaaaaaccacaaggtagaagcaacccaaatgtccatcgacagatgaatggatcaacaagatgtggtctctccacacaattcagccttaaaaaggaaggaaattccaacacatgcgacaacatgcaggaactttgaagactttatatatactaagggtacccaccccctacctcactgtattcatatgttgaaatctcaacccccaagctgatggtattagggtatgggattattagattcaaagtttgggacataattaggtcatgagggtggagctcccatgatgggagttgtgaccttataaaagggattccagaggcccctcttaccccttctgccacgtaacaatacaacaggaagtcagaagtctgtgaatgaaagagggccctcaccagaacccaaccatgctagcccttcatcttggacttccagcctccagagccatgaggtatcaatgtctgttgtttataaaccacccagaccatggtactctgttatggcagcccgacctcactaagacactaatcaaaacaaaccggtccacaaaaggacaaacactgtatgattccacttacatgaggtacctagagtagtcaaattcctacagacagagtagaatggtggtttccaggggctgaggggagagggaaatggagagttgtttaatggcatggagttttagttttgccaaataaaaaagttctggattagttggacaacaatgtgaatgtacttcatgcttctgagctgtacacttaaaaacggttgcctgggcatggtggctcatgcctgtaatcctagcacattgggaggccagggcagaggactgcttgagccgaggagttcaagaccagcctgggcaacatagcaagactctgtctctacaaaacatttttaaaaaaattcaccaggtgtggtggtgcacacctgtagtcccagctacttgggagtctcaggtgggaggactgcttgagtctggatgttcgaggctgcagtgagctgtgatcacaccactgcactccagcctgggcaacacatagtgaagccgtatctttaaaaaaaacaatggtgagactgggtgcgttggctcacacctataatcccagcaccatgggaggctgaggtgggtggattgtttgagcccaggagtttgagaccagcctgggcaatgtagcaagaccctgtctccacaaaaagttagctgggcatgatggtgcatgtctgtggtcccagctacttgggaggctgaggtgaaaggattacttgagcctaaaagattgaggctgcagtgagctgtgattatgccactatactccagcctaggtggcagagtgagaccttgtctcaaaaaaaaaaaaaaatggataaggtggtaagttttatgttatgtgtattttatgttttttttattttttaaagaaacagggtcttgctatgttgcccaggctagagtgcaatggctattcacatgtgtgatcagagtgtactacagcttccaactcctcagctggagttgaggtgattctgcctcagcctcccgagtagctgagaccacaggtgtgcacagctttgcctggctccattttactacactacagtgtctctctttttacatggttgttgcagtaaaagaaaattcagtgtatatagaaacatcacaagcaattgttttaagattatatgtaaagtggaaataagttgtagactcatatagttgtcaataggttttctaacataagaactttgggtggggcacttgagaactgattcagatggaagatggctctaggctggtggaacagtgttgagaattcctgaatgtgtagtattcctagacctctgtccaccaaattaaagcaggtcccccatcaccatgatcctacagggggcatcccccttagtaacccatggaatctggcccggcctctttctctagcctaaattgagacattctcctccttgtttctctaggcctcagccacactggccttcttctatttccaaacacacaccaagctctctcctgaaacacagccttcccacacaccgcatctctgcctagttcatacactgccggcaaattgtgtattggggctgggcccttcccactgttcagctgtcatcctatttttttcctttgtcaggggtcctttgaaaactacgtattccagaccaggtgcctggacattctctcttatgacacttattaaaacatgttgttggctgggtgcggtggctcacgcctgtaatcccagcactttgggaggccgaggcaggtggattgcctgagctcaggagtttgagaccagctgggcaacatggtgaaaccccgtctctattaaaatataaaaaatcagccgggcatggcagtgtgtgcctgtagtcccagctactcgggaggctgaggcaggagaattgcttgaacctgggaggcggaggttgcagtgagctgagattgcaccactgcactgaagcctgggagactctgtctccaaaaaaaacaacaacaaaaccaaacaaaaccaaaacaaaagaataaaaaaaaatgttgttgtcattattttcccgctagactcccacaagattccccactagactctaagcttcatgggaggaggggctatgcacattcacagtgtctgctcttaccagagagtctcacagagcagccctaacaggttagaccaaagaacaggtcatataaaaacccaagttccaatttctcctgagatgtttttctcctaaaaaccaagttaagaactctaggcctctactgggaagctgcctccccattcagacagggtctccccattaccacaatcccttctagtcctctcttctacttgcctccctaggtgatcattgcaggcatctgagtttgtaaacccgagtttacaaaaggggattagagaaatgcccacatcaaatgatctcattcacccatttctcagattctaggtcctgatggttggcacatgttgcaatgagttggatggggggagtccagccaggacctcagggtagccacagacttcttcaatttccaccctctaaggtttggtcctcagattggaattatgtttcctcaattctctgcagacaggaagtgttgagatctgactcttagtagtaatttaaatgagagaaagagaggaggagggaggtatttttatatcctatttgtatctaaataccagaaaaggtagggagtgggggcttacacctgtaatcccgacactttgggaggccaagacgggagaatctcttgagcccaagagtttgagaatagcttgggcaacgtggcatgaccctatctctacaaaaaatacaaaaattagttggacatggtggcatgtggctgtagtcccagctatttgggaggctgacatgggaggattgttttagcctaggaggtcaaggctgcagttaactgtgattgtaccactgcactccagcctgggcgacagagcaagactgtctcaaaacaaacaaacaaataaacaaacaaacagaaaaacaaacaacccgggaaaatggtactttgggaacaaggaccttggtcaacccaattccttattgaaggaaataacgtatacagtggtccatttcttttttttttttttttgagacggagtctttctctgtcgccaggcttgagtgctgtggcgtgatctcggctcactgcaaccaccgactccctggttcaagcgattctcctgcctcagcctcccaagtagctgggattacaggcatgcaccaccatgcccagaacatttttgtatttttagtagagatggggtttcacaatgctggccaggatggtctcaaactcctgacctcgtgattcacctgcctcgacctcccaaagtgcgtgctgggattacaggtgtgagccactgcacccagcctacagtggtccgtttctaagacaaaatgctttgaattggcttaggtcagcaacctacagaagaaacatgatacactaggtccctgcttggatagccagccaatgcctgcttgtcagcctcccccttccccaccttcgccccttagttgccttcacctgaaccaaagtagtttagtctaagatgaaagtttactagcctgcaaaatagcttgttttgtctgttcttagcctgcccagctacttaggtcataagtctaacacttgaagagcccctaagctaactaagattacaatgcattgtgggctgcaacaaaatgcagcaaaacgaccctaaaataaacaaaaaacaaaaaactcctggcgctcccacccaacaatcaacaggcgagaagtttatgaccccgtagtactcagcctatgaggaactgggggagggacctgtgcactaggggataaactgcttgttgaaagtgtgctgggtgtgcctgtcagacacctgatcttgcaagactgtcattaaaagtctcactttcactgttctccgggtctccgagtccattctttgggttgggatgggcgagactgtttctcacattatgaaaagctgaaggttaagtgaacttggggaatactgcctcctgctggctggatgtcatggaagcctggcccatcagcagagaatgataagctggagttctggagggtctgatttccaaggaatcacccccttggaagctcctctaatacaccctgatgagattaacctgattaggtccattgtttgataaaaagaggaggaagtttaatcacttccacattctttgcccacgactaaccctgattggatttggggctatggttcaaatgtatgaccgattgatttttttcacttcttctgttggacttttgaaaaaaagttctctgaaaaggaatttagaggaaagagacttattccagtgaacagttacagtttgcaaacccaacagacacaacttttggtacaaaaggaagttacattccagagaacaaggggaggctttgtcttttctagagaaaattcccgctcagaatcccactcaggtctgcttatgcaaatgaaagattcaaactttttagttctgattacttggctctagctgggttctgattagtcaaagcaggtcacagtctactggtggcgtaaacaggaacaggcagctatgtaagtcccaaagtttttccagaaactcaaagtatgtgtgtgacctctggtcagcaaataaccacttgtctcaaatttaaattcaggcccaggattcatcttgaggaattggctctttcagggttcagagaccaatcaaaatgtctatcagaatggatgtgttaaaaggcaaataatgggcagggcatggtggctcaagcctgtaatcccagtactttgggaggccgaggcaggtggatcacctgagctcaggagttcgagaccagcctcgccaacgtgatgaaaccccgtctctactaaaaatacaaaaaaaattagctgggcgtggtggtgtgcgcctgtaatcccagctacttgggaagctgaggcagaagaatctcttgaaccctgggggcggaggttgcagtgagccaagatcatgccactgcactccagcctgggtgataagagcaagactctgtctaaaaaaaaaaaaaacagcaaataacgttgtcctgtgccatgagccacatactcaaatatttacacaggtccaggggaagtaaagagtaaatatggccaccaggcgcggtggctcacgcctgtaatcccagcactttggcggctgaggcgggtggatcacgaggtcaggagatcgagaccatcctggctaacacggtgaaaccccgtctctactaaaaaatacaaaaaaattagccaggcgtggtggcgggcacctgtagtcccagctacttgggaagctgaggcaggagaatggtgtgaacccgggaggcggagcttgcagtgagccgagataatgccactgcactctagcctgggcgacagggtgagactgtctcaaaaaaaaaaaaaaaagagtaaatatggcctgatgtgaaaaaaaattataaccaccagaatttcctaaaatgtattttattgatctatagtgttattgcacaacatccacaaatatctatgatgacaattgtttaaaattcaagttaaaatacaaaatttaaaaaagtttacctacttttacgttgttaatttatgactctttgggtttgaaatgagatttgatgtcattgtatttatagatattccttgacttcttgtgttatgtaccaataagcacattgttaagttgaaaacatcataaataaaaaatgtgtagctgggccaggagctatggctcatgcctataatcccaacactttgggatgccgaggcaggaggatcacttgagctcaagagttcaagaccagcctgggcgacaaagcaagacccccatctccacaaaaaattaaaaaattagccagttgtggtgctgcatgcctggggtcccagctacttgggaggctgaggcaggaggatcatttgaacccaggatgtcgaggctgaagtgagctatgacggtgtcactatgctccagtctgggtaacataatgagaccttatttttaaaagaacacacaatgagtagctgagtagggctgcggctcactgccactgccagtgtttgaagaacagttcccactgaatgcatctcaattttgcactgtaatcaagtagaaaaactgtaagtccaatcattgtaagtctgggaccatcttgtccatagtcttatgacagaatactgtttaaaagtgtagatctatccgaatgttgatgaatttattgtgaaatgcttccccttgtgttgcttctatgtgatctatgtgcagcagtggacattttttttttaagtgaaaaacaaatcatgcccctcccttcattctctcccccgtgatgtttcccttagagaacattcctcccttcccttcccagtccccacctcagagatggggcaactcctccctttttatcacacttcttccactctgaggctctaggcaatcagttctcggtcactcccacccatgtgaaggtttttttttttttttttttttttgagttggagtctcgctctgtcgcctaggctggagtgcagtggtgcaatctcggctcactgcaagctccgcctcccgggttcacgccattctcctgcctcagcctcccgagtagctaggactacaggcacctgccaccacgcctggctaatttttttgtatttttagtagagatggggtttcaccatgttagccaggatggtctcgatctcctgacctcgtgatccgcctgccttggcctcccaaagtgctgggattataggcgtgagccatcgcgcctggccccgtatgaaggtttttgatgatgcttgctagaatggacccagataattttcgtgtggacagaaggtagatttttagtagctcttgttagaggtcatgtaggagattgtctcagcttgagctgctattgcaaataccgatactgtagactgggtggcttgaaaacaccagaaatgcattcctcagagttgtggaggctggatgtccaagataggacaggtctgagatcagggtgccagcatgcttcagttctggtaggaatcctcttccaggctacagactgccaacttctcgtgtcttcgtgtggcagaaaaagggctaaaaagatctctgggattttttttttttttttttgagacagagtctcactctgttgcccaggctggagtgtagtggtgtgagtggcatgatcttggtatactgcagtctccacctcccgggttcaggcaattttcgtgtctcagcctcccgagtagctgggactataggcgtgtgtgaccatgcccgactaattttggtatttttagtagagactgggtttcaccatgtttgccaggctggtcttgaactcttggcctgaagtcatgtgtctgccttggcctcccaaagtgctggggttgcaggcacgagccaccgtgcccagcagggcctcttttgtaaaggcactaatcccattcgtgaggttctgccctcatgacctaattacctcctacaggtcccatgtctgagcaccatcacactggcatttaggatttcagcttatgaattttgggaggacacaaacattcagttcataacagcattgtgttgtcacccacttttttttttttggtaggaacagtgtgtcgaactctggtctcaagtgatcctgctgcgtcagcctcccaaagctttgggattacaggcacgcactgccaaggccagccacatccatattcttaatctccaccatggcctcatgagcctggtcccctgtcagtgggctagggcctcgacatgggtaatacgcatattagctgaggttcaggaacccaactgacttgtgtaagaatttccagctggccccgcagaacaagaggctaaagagtggggagcagtgctagtgttgccactgctacagctctcgggcagtattcactaccctcatcctgtatgtgtgcccaggtgctgggtgagcatttcactccacacgagaggcatcatgcattccttcattcgttcgttcatgccgttatactatagtgaacaataaactcttgaggaatgtcgggtttaggggagccagtcccctgttcagttgaaaatctgcctggctatgtataaattttgactcccccaaaacttaactactaatagcctgctgttgactcgaagccttactgatgatatcaacagtcaattaacacatactttgaattttatacgtattatgtactgtatgcatttttttttctttgagatggagtctcactttgtggccctggttggagtgcagtggcaccatctctgctcactgcaacctcccagatttaagtgattctcctgcctcagcctcccaagtagctgggattacaggcatgtgccaccaagcctggttaatttttgtatttttagtagagatggggtttcaccatgttggccaggctagtctcaaactcctgacctcaagtgatccacctgcttcggcctcccaaagtgctgggattacaggcgtgagccactgcacccttcctgtactgtattcttataataaagtaagctagagaaaagaaaacgttattaagataatcttaaggaagataaaatctatttactattcattaggtagaaacagatggattatcctacaggaggaggaggaagaggagggggttggttttacagtctcaggggcgaaagaggcataagaaaatctgcaaataagtggacccacgaagttcaaattcctgttgttcacagttagtggtacacaggagacactaggtaagctaaaggttgggctgggcatggtggctcacacctgtaatctcagcactgtgggaggtcaaggcgggaggatcgcttgaggccaggagtttgagaccagcctggccaacatggtgaaatgctgtctctactaaaaatacaaaaagtagctgggcattgtggcatgtgcctgtaatcccagctacttgggaggctgaggcacaagaatcacttgaacctggaaggcagaggttgcagtgagccaaaatagtgccacttcactccagcctgggtgacagagtgagactgtctcaaaaaaaaacaaacaaaccaaaaagattagctaaaggttgaactttcagtgatgaactaaacagaaacaatctcatagagattgtggacaggagaagaaacaagcacaggtgcagttaaaacccgtgataaatgccccggcagaaacaagtgttaggccaggcgtgatggctcatgtctgtaatcccaacactgtgggaggccaagacaggaggactgcttgaggccgggggtttcaagcctgcagtgagctatgattacaccactgctctcctgcctgggcggtagagaccctgcttaaggaaaaaaaaaagaaaggctgggcgccgtggctcacgcctgtaatcccagcactttgggaggccgaggtgggcggattacgaggtcaggagatcgagacgatcctggctaacacagtgaaaccccgtctctactaaaaatacaaaaaaaattagcagggcgcggtggcaggcgcctgtagtcccagctactcgggaggctgaagcaggagaatggcgtgaacttgggaggtggagcttgcagtgagctgagattgcgccactgcactccagcctcggcgacagagcaagactctgtctcaaaaaacgaacaaacaaaaaaacaaaacaaaacaaaacaaaaacctaaaccaaaaccaaaacgcagcatagtccatgagagaggaagagcagggcaggcctactcacctggggctgtcggggaggctgcccaggaagggactctgaagtgagcacctggaggaaggaggttagttctgagggactggaattcatcctggcattgggatcacgggcaaaggtcctgtggtgacaaggagactggtgcgagcctggcttagcaccatgtgagagcagaggggtggaaaggcactaggtaagcatgccttcggatgtgaaatgagggagacggggactgggggaccctgacatgagggaggaggaaaggagatgggaagaatgggtgaccagagggaccactagaccaccgagggtgagagcttgctaatatcagagccatgtgtaggagaatgaagtgcaatcttggatagacctccagtgcaggtggtccagccatcaatgaccataaccacatgcatgattgtaggtggaaccagaagaaccacccaggcaactcacagaactggggaactaatcaagtcttgttttaaatgactacattacgggtggtttgccacgtagcagtggatcgctgaaacagtttaaaatatctattcagccgggcgtgcggtgggtagctcacacctgtaatcccagcattttaggaagctgaggcaggaggatctctcgaacgcaggaatttgagaccagccttgagcaaaatggcaagaccctgtctccacaaaaagtaaaaaaaattagctgggtgtggtagcatgtgcttgtagtcccagctacttgggaggctgggacaggagaattgtttgagcccaggagttcggaggctgcagtgagctgtgactgcaccgctacactccagcctggacaacagagtgaaaccttgtctctaaaaaaaaaaaaaaaatctacaaaccaggcaggagcactgaatagctcctgtctcccctgagacccttgtagaccttgaggtctgttacagagctcaccaaccttctcttggtctagaattatctaaaaagagttgagtgcagccagaaaggactgaatacatggtgttcttcaatcccatcaaactgctgtgccctgcagatgatccctgagtccaggtgttggtgggttgaggacaaggctgagggaacagaggtgggaacagtggcccaggaccaggagaatgcagagttcagagtgcatgacctgcatctaactctagatgctccaggggtctgagaccatctccagcagggtctggaaggcccagtcattccccagcacgcacagtcaccactggatactatcttgctctgtgagtgatgcaaaggtcctgggtcagtgaagcctgtgaaacaaagttgggaccagagtgtctctacggttgagggctgggcttatttgctctctaagtataattgtaagagcaaatagaaacacctatcctctctgagcttaaaaggatcaaaaagctctgacagtgtcagtggtagggctagttcaggggctgcagtagtgctggtgcccacaggtggaaccttctcctgccctgattcccaaggactggtgctctcggaggggtctgggaggtatatttctctttcacaaatacgtgcacaacacatgaatgagctactggatgagggaataaatgaatgaatgagtgaaaaaagcttcctttctcctctccaggagttagcaatcactggttagttccccactgcccaccagcctgtgcagaggagggaggagcaacaggtcatagatgtggttgcagctgttactggacagagtggtcaagacatcctgtgtctgcagaggccctccccagccctcacctggacagtggagctgttggccagagaggcagtgggaagaagggtggggctcccagagtcgacccagcgggctgaaactggtgcagtctgcgcctcaccaggcagagaatggatgtggggcagcttgacaccgagcaggggctcatctgagcctcaggggtggttgctctatcaaagtgtttgcaagtaaacagtcccagtgcacacccagctgctcagtgccacctcgtgcacccagggccacttcagccttgatcacaggcctgcacaggttccaggggaggagacactccagctttttgagggagggtgagcatgtgggatcagagactttaagtccaaatttccccttaatttttttttaaatcttgcaggtagtatgcaaacatacatttaatgtattatttttattctcatttatttttttgaggcagggtctccctctgttggccaggctggagggcagtggcgagatcttggcttgctgcagcctcaactcaacctcccaagctcaagtgattttcccacctcagcctcccaagtagttgggactgcaggtgcctgtccgccatgaccagctaatttttaaattttttttgtagagatggggttttgccatgttgctcaggctagactcgaactcctgagctcaagtgatcctcccaccttggcctcccaaagtgctgggattataggtgtgagacactgcatccggctcccaaatttcccctttttataaggacaccagttgtactgaccggggccccacctctatgacctcatctaaccttcattaactccttaaaggccctatctccaaatacaggcacactgggggttagggcttcaacctatggatttgggggatgcaattcagtctatcacagtgccaagctgcacctgctcggtgagccagaacaggggtggggaaggcaccaggccctggtgcttctttcccatgcctgagtcactctacttggttctaggagggagaggagcatgggctgaaggcagtgctgcaacatggaaggggcagaacatcccaacccgctctgggcccccagtgtcttctgctgtacaaagcaggtgttttcaccccccgaggatgtgtcctcccttcctggctcaccaagcatttaaatgtagacagaaaatttatttatctggggtgcggtttcctcagggggaagttgaggtcacgacccctgaggtaccttaacccaaaggcctccagggcactggccccagagtctccagcaggtgcttcctccctgaatgcttccatatggcaagatcagagccacaaatgctgccccgacactgttccggtaaccgacgttgcagacccaagaaagtctgggatggtagtggccaggaacggggtgtgccacggccccacctctcagagcagggaggaggatgctgggccagcccttggggaccccaggcaccgtggccacaggagtcagagctctgcatgtctgcaccatgtcctgggctcctgtcctgctcatgctgtttgtctactgcacaggtgagggaacccccagatcccaaagactcctgccccttccttcatcctgccctgcccccacggcccacatgcatctgtgtcaccaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcagaggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctgagtttggtctgactgttgtgcgacttcgtagtaccagccttgggcaaaggcccggggccccgggagactggcagatcactgtggtgagcactcacctgagtccttacttttgtgggccatgggaggcaaggggttgaccgaagcaccctggaggggcatccatgcccaggacaggaccctctggtgtcatctgattctgcccagcggttacagggcaaacaagcttagaaagcacctggtctgggcctccagggagaacaggagccaggtaataggcctagagtgggttctccaccttggtcctatcgacgttttgggctggacagttcttggttgtggggctgtcctgcggattgttgaatggtgagtggttatctgtggcctctacccaccagatgccccttcccagttgtgacaaacaaaaatgtctccagacattgccaaatgtccccaggtggtaaactcacactgattgtgaaccactggtctagatgagcaagtaaatgcatttacttatttgtacaagagagtggcaggtgtcggcaaacatgttctttttttcctttttttagggataaagtcttgctctgtggtccaggctggagtgcagtggtgcaatcatagctcaccgcagcttcaaactcccaggctcaagtgattgtcctgtctcagcctcctgagcagctgagactacaggcgtgcatcaccatgcttggctatttatttagttttatttttggagagatgaatgtctcactatgttgctcaagctgatctcaaactcctgagctcgagtgatccccctgcttgggcctcctaaagtgctgggattagaggcgtgagccactgcacccagcccattttctataaagagccaggtggtaaatatttttggctttgtgggctatgcgatctctgtcacaactgttcaattctgtcctagtagcaagaaagcagccacagacaaacatgtcaacaaagaggcgtggctgtgttcttataaagctgtatttacagaaacagatggggctacactgggctgggtatggcgcccaggctgtagtttgctgagccctgctcgggagcactccagctcctgtctccaggttttaagcaagccatgcttggtgggataatcagagtcccccctcaacttatcttgcctgtgaccccaggcagaagcctctggacccatggagatacctagaggcatgaaggacgtggtctcactgagactgtgttggactgtctgggtgaagtagcaatggggagctccctgcagccccggcccacagcaaggccccctgagcccgtgggtggtgggtctgagtgtgccttgcagagagggactctctacactgggtgtccacacaacctgtagacatgcctcactcagagaggtgccgggcaaaccatctcccttgtaaccccaacttgcctgggaacgtgcattcaccccagctaaaaagatcctgaggcatctccccagagaggtggacacatgtcagtatcagcgttccatgtgtggtcatgagtccctctcttgttaaacagtggtctccagcactttgggaggccgaggcgggtggatcacctgaggtcaggagttagagaccagcctacccaacatggtgaaatctcatctctactaaaaatacaaaaattagctgggtgtgttggcacatgcccgtaatcccagctacttgggaggctgaggcaggagaattgcttgaacccaggaggcagaggttgcagtgagccgagatcatgccactgcactccagcctgggtgacagagcgagactccatctcacaaaaaaaaaaaaaaaaaaaaaagagacagtgatctcagcttatgccatactctatgcactgggttcttcctgcgtcaggcttttacccctgggccaggcccacattttaaaacattattatttacttgtttattattttattttagagataggatcttgctatgctgcccaggctggactgctgtggctattcacaggttcaattcatgatgctctacagccttgaactcctgggctccagcgatcctcctgtctcagcctgctgagtggctgaactacacgtgtgagtcactgcacctggccatggcccacagttttaaagaccagctagatggttccagaggaactctgtcttctgcttgtaacccgtccctctcttgcctccatccttcatgattctgggattccatgctatgagaagagatctagaaagccgggagctgagttggactcctgtatcatcctcatgcccccaccccaccagctcaatggaaaatgagacctggaactcaggcttgaggccagactgagtgtgagtcttagctctggaggagtcacttaaaatctaagccaacatttccaatgttgcatgtaaaggggataatcatagaactgattaacttatataaaaagtttttatctggccaggcgtggtggctcatgcctgtaatcccagcactttgggaggccgaggcgggcagatcacctaaggtcaggagtttgaggccatcctgggcaacatggtgaaaccccgtctctaccaaaaatacaaaaattagctgggcatggtggcgggtgcctctgatcccagctacttgggaggctaaggcagaagaattgcttgaacctgggaggcggaggttgtagtgaaccgaaatcgcaccacatcactccagcctgggtgacagagcaagactgtctctcaaaaacaaacaaacaaacaaacaaaaaggttttatccatcatgagtgctcaacaaaataatagtatcatgatttccccatcagtcacctgcctggccttccctgttgtcaaatcctttcctttagtctgagtcatttctcaccttgaccattatctggtctccttcccatccatcctcctgctgcatgcagtctatacccaccactcctcatctttgttgctcctagatccagccttgcatgcattcctcctctctaaccctttattgtctcccacactctaaagaacatatgcaagccacatctgtaatttccaattttctagtggctacattatttttaaacagtaaaaacaaatagatgaaatgattttttaatgatatattctatttaacataataaatccccaatattaccaattcaacctataatcaatataaaaattagttactagatagtttaaacttgtttttcttttgtattcacacttcaaaatctggtatgtattttatattcatgtcttggataatttgctcaagtggataatctggtcagccaagtggtcaagagctacatatgccttgtgaagagaccactttggttgaggggatgcaattcagcctccttcccatgacacagcctttgaaggctggctcaggcttggtcccaagtcccatttcttgtgcaccctctctccctgtttctgccatgttaagccaactgcaactgatcaaacacccgagtctcttggttgcttctaaacctttgcccaagctgtttactgccaggacttcctgtccctttgttgtggcctccatctggctgcactgactcggggctccacaactgtctcaaatctcactccttgggcaagacttccccgagctcttcatgcagttattaacttcctccactgtgcaaacagcatgttttcctaactatatttagcttctactgcacagttataaatttatttagcaaagctccctcccctactaatctgcagattctcagtgggcaggatctactcaacccattgatgtgcctgataaacacttggcaattagacagttgaatgaacaaatgaatgaatgtgtaactgaatgaattttcgggttccaaggaccctgacattctgggatcccattaggtggctggggtcaccaccttagagaattgtgattccctaagaagggagaaccagcccagaccttctcgatcatattagtgactggccacatttcctctcctttctgattctctctctcccccacacccttactgcatgacagtgatgagaaaatccacttgatcaaccaaactacaactttcggcctcatccctatccctcccttgccttctgaccagggccacagtcaccctgtgggttcttccttttgagtgtctctcactcccttcctcctccatatctctgagaccagcctccagccctgctggcctgctctgctgccttctggctctttgttgaacccaagaccagggtttatatatgttaaatataaatatatttttccatatgaaatgtaaacatattttaaacattaaatataaatatacatcttagatatggcctgtgttggaatgtgtaatagattgagtatataatgtctattcaatataaaatttatatttatatatgcagtaatgattcaggttgattgtagttaagaaaaacaagctccaaattcgagagaaatatgtaagaagagagacaggaagaaaaaataatgaggcaggtaaatgcaacagacaattcgagacccacaagtgcagagcaggcttcccagacccggataatgtctcctgggctgataggaagccctcaaccccccaagtccttctcagccataaaccgcctgagcacagagccacagggaccgtgttggggctgggcctctcgactttagttcctctcattctgtgcaaaaggaaaaacaattcagaatctacagaggtttagatgtgtgtagatgtggacagagaagtcctggcacggtggttcactgcccaagaagacagtgagtccctggagggatagaagaatatacatcatgctaatatatgtcatcccagtactttgggaggccgaggcgggtggatcacttgaggtcaagagttcgagaccagcctggccaacatggtgaatccccgtctctactaaaaatacagaaattagttggctgtgggggtcgatgcctgtgatcccagatactcgggagacagaggcaggacgaactgcttgaacctgggaggaggaggttgcagtgagctgagatcatgccattgtactccagcctgggggacagagcaagatcccatctcaaagaaaaaagaaaaagaagttgtgagtgctaagttctctctggattttcaggaggccagttctccagtccacagtggcctgggaggacaggggttcctgagggtgaacagagcctgtgcccggtcaggtaggatcgcatgtccctgaggttcagaacccaggagcatggggagggtccagggggttcctgctgcatggagggaagaccctctttccacaggggccccggagagcgagaggaaggaggagggcaggtcagtgagtgtgacggggtcacagtggagagggaagcagaaagaagtgtccccacaacaagacacacacagtgtctacgctgaagctacagagagggcctctccacctgtgtctgccgcaaagcagtggggcgtcttctggcagcccagagtcacctccagatcccacctgcaccatgcttcctgcagggactgcctgtcttcctaatacactgtcttctgaccagagtcttccagacaaatcactggttgctatatatatatatatatatatttttaatagctaatatcttacactgatatatttatattatatataaatatttttgtactttatgtttaggctatattacagatgtagttagttagctatttatgttatatataatataaacatgatgtagattcttatatttctctggggactcactgtcttcttaatacactgtcttctgaccaaattcttccagacaaatcagctgttgctatatatatatatatatgtgctatatatatatgtgctatatatatatgtgctatatattttattgcatagaatatattatatattaattatataatatacattatacattacatattatatataatatattatattattatgctatatcttatatattatatatgttatatatgtatatatattatatatacacatacatacactcatgtatattttaatagctaatatcttacactggtatatttatattacatatgtttatatacaaatatttttgtactttatgtttatgctatatatacagatgtaattagttgtttatgttatatgtaatataaacatgatgtatattcttattttcctgtgaggacccactgtcttcttaatacactgtcttctgaccaatgtcttccacacaaatcagctgttactatatatatatataatatttatatacacatatacacatacatacacacatatgtatattttaatagctaatatcttacactgatatatttatattacatatagttatatactaatatttttgtactttatgtttatactatatatacagatgtcgttaggtatttatgttatatataatatattaacatgatgtatattcttatattcttctggggactcactgtcttcttaatacactgtcttctgaccagaatattccagacaaatcactggttgctatatatatatttttaatagctaatatcttacactgatgtatttatattacatatagttatatacaaatatttttgtacttttgtttatactatatatacagatgtagttagctatttatgttatatataatatatcaacatgatgtatattcttatattcctctggggactcacagtcttcttaatacactgtcttctgaccaaactcttccagacaaatcagctgttgcaatatatatatatatatatatatttattttttaatagctagtatcttacactgtggctcatgcctgtaatcccagcactttgggagaccaaggcaggtggatcacctgaggtcaggagtttgagaccatcctggctaacacagtgaaactgcatctctactaaaaatacaaaaattgattgggtgtggtggtgcatgcctgtaatcccagctactcgggaggctgaggcaggagaatcgcttgaacccaggaggcagacgttgcagtgagccaagatcgtgtcgctgcactccagcctgggcaacagagtgagactccatctcacacacacaaaacatcttacactgatgtatttacattacgtgtagctgtatataaatatttttgtacttacattctgtgtacttatattctatatattataaaacattatataaaattatacatgtataataaaatgttacataaaaattttaatataataccattttactacatatatttctaaatttaatataatgaaattttatatataataatgtataacatttctaaacttattataatacaatgatatataattattttctcatattataattatacataaggtaatttattgtaaataaaattttatataatctacgtttattataataaaattttattacatataacacatttctaaatttaatacaataaaatactatgtataataatttataacatttcaaaatttattatataattttattatacaattattttatacataattatatatagtatataattgtatttatagaaatataattatgcatatacaatatgtaattttatttttacatagtatatatacataattatgtattaacaaatataataatatcaatttatatacttatttacattaagttatatattatataaatgatgttatatgttatatgttacatatatttttgcttaatatattaaatttaatctataaaattatgtattacaaataaaagtgtattttacatatacactacatataactttatttatataaaaatataaaagtcatatggttaagttaataaaatatatttatatcaatctattcatataaaatatacacaatgcatatttatataaatacaaagtatataaaacttttaccagtaggatgcaaagagttgctgaccgtctgcagaaatcctgaacctctggaagcagaataaaatcttacctcccagtctgctttgaaaggaacagtaaagcagtcccgaaccccaaacccatcctaaggggagatgggggagttgggatggacgcgttgaccagtgaggactttcctttgctggttttgaggtgtcttagcccagaagctaagacgggaagtgattctggagcaggtgagctgatcacaagcctgagccaagaatccatggagctcataaatagcagaagccgggaccctgtgcaaatccttctgaaatatcccccgtttactgggctcctaggggtggggaagaaaaattccctgacatttcggcctcagggaaagagagagagaccccactggccggaagcctctgctatttttcagaagacagctggggcatcactctttcccaaatgacggtgattttcagagtggttcactttttggagagacatttctgccctggagatccatacatattgaacccaaacgaatattttttaattaaaaaaaattaaacattagaaagttcaatattgaggcagctacgagtttgaattcctcatttttcctagatgcatgttgtcaaaatctgtattgcatttagtaactacttatgtgtctaatgtatataaggttacacaatgtttttttctgctcctcagggtcagaatttgaaataaaagttttggaaagaaaaaacactcttgtctgtttgtgcaaaaataaaagaacccatattttaagaatattttaaaataaatacaaattttgtgtgggagggttgcttataagaattcttcatatcctaaatcaaagacagatcttgttattaaccagaaaacaaaatgtgtgtgtataaatgtacaacactcttacactcacacaaacacaggcacacacacacattcacgcactcactgatgtactcacacaaacacaggcattcatgtataaatacacacataagcgtgtatttatagaaatataattacacacatacaatatataattttatttttacatagtatatacacatcattatgtattaacaaatataataagatcaattttattatatacttatttacataaagttatatattatataaatgatgttatatggcatgtatatatcacatataactttgcttagtatataaaatttaatctataaaattatgtattacaaataaaagtatattttacatataaactatatataactttatttatatgaactataaaaatcatatgtttataataaaatatatttatttatatcaatatattaatataaagtatacacaatgtatatttatacaaaaatttttaattaaaaaatattcatttgggttcaatatgtatggatcgccagggcagaaacgtctcttcaaaaggtgagccgttctcaaaatcaccgtcacttgggaaagagtgatgccccacctgttttctgagaaacagcagaggccagtggggtgtctctctctttctctgaggccgaaatgtcagggaatttttcttccccaccactaggagctctgtaaaccggggatatttcagaaggatttgcacagggtcccggcttctgttgtaaatgagctccatggattctcggctcaggcttgtgatcagctcacctgctccagaatcactgacacaaatgcaaccacacacttacacaaacacacatcaacaccaagacagacagaagcacaaaacacactcatagaaacacatggacacacaaagacatgcacactcacacaaacgcagggacacacacacaaacacaattacaaaaatgtggggtttttttgcacacgtgggtgcacatgcacattgacatgctcacaaagcacacaaacacgtatacatacaaagacactcataaacagaatcatgaaaacactctcatataaacacgtggatggctactcacccacatagacactcacatatgtcacacgcactcatacacacactcagaatcacacaagcacacacaaacacacaaatacagtcacacactcatgcaaacacagtcacaaaaagactcacataatcatgtggacacacaaacataaaaattcacacactggggccgggcaaggtggctcacgcctgtactcccagaactttgggaggccgaggcgggcagataacttgaggtcgggagttccagaccagcctggccaacatggtgaaaccccgtctctactcaaaaatacaaaaattagccagatgtggtggcgtatacctgtaatcccagctactcaggaggctgaggcaggagaatcatttgaacccgggaggcagaggttgcagtgagccaagatcacgccactgcactccagcctgggcgacagagcgagactccgtatcaaaaaagaaaaattagccagatgtggtggtgggtgcctgtaatcccagttactcaggaggctgaggcagaagaatcttttgaacctgggaggcggaggttgctttgagctgagattgtgcctttgcactccagtatgggtgacagagcgagactccatctcaaaaaaacaaaaaaaaagaatttatacattgccatacagattcacagacatacactcatattcacaaacacacaaatacgataaacgcaggggcacacacaaacaccatcacaaaaacacacttccataaaacacaggaatgcacgctcacacagaaacacgcatggaaacacacgttatcttacagattcacagacacactcatcatcacataaacaggcacacacacacagccacacaagcacacacccacacccacatcaacacacacactcccacacggcacccacgcgctcacgcacataggtagaacaggcctgcattacctgataacgcagttagatcagacgtgatgctgcctgccgaggagacctggaggcttcccatgaatgggctttcggatgagaggtctctgggtgcatttggtgacaccccaggcagtgggggagacgtccaggctggaaggccagccacagccagctctgcccaaggatgccacgtccatttgcttcagtaggatatgcaccctggaaacccaggttcctgcctctccaggaaaccccactgaggtcagcacatcccccaaggtttagaaggggtctctgggtgcatttggtgacaccccaggcagtgggggggacatccagcctggaaggccagccacagccagctctgcccatggatgccacgtccagttgcttcagtaggatctgcatcctgtaaaccctggttcctgcctctccaggacacgccattaaggtaagcacactccccaggtttagaaggggtctctcggtgaaatgtggtgacaccccaggcagaaggggggacgccacagccagttctgcccacggatgtcacgtccatttgcttcagtaggatctgcaccttggaaacccaggttcctgcctctccaggacaccccactgacgttaacacaccctccaggtttacaagcggtctctgggtacatttggtgacaccgcaggcagaggggggacgccacagccagctctgcccgcggatgccgcgtccatttgcttcagtaggatctgcaccctgtaaaccctggttcctccctctctaggacaccccactgaggtcagcagcccccaccccccacccccaggtttgtccagcttcgctgtctggggagagacacagaaagaccacattcggtggaattctggctataaccttttgtagccggcaagaaggatcaccaagctgtcccgttaccttgctggagcgatcactggtttcacgcttggcccccgtgcagttagtgcctgggccaggctcgattcctggagctcaggtgaaatttgggcttggagctcacgcctgcaccatccagaaagcagaaggcagccggcccgggctgtacggttcgtagaatcagagagaacactgcttgccttcatgtctgtaccacaataaatctgccaactgcggtcaaagtctctggattcctgccccctcattttattttgtctattacggagtggaaggagtgagaaagattttgcttcctattttgttttgcaaagcgcttctaagaaaaacaacccgtgttctgaaaacgagattctgagtgtcccctgggcgcgatgaaaacaaactttgggaatccaagggcctgagaggcagagtgaatgtcatttgcatttccctgcgaatgacaaagtcactttttatttattattattattatagattcaggggatccacgggcagctttgtgacctggggatattgtatgatgctgaggtttggggtatgaatcatcccgtcacccaggcactgagcattgtacattcctgaggtatataatgtgtactaaaaataaaatgtatatttatatatgcactaatgattcaacttgattcctcgtaattaagaaaaacaaaccccaaattctagaggagttctagaaatatataagaagagggccaggcgcagtggctcatgcctgtaatcctagcactttgggaggccgaggcagacagatcacctgaggtcaggagttcgagaccagcctggccaacatggtgaaaccccgtctctgctaaaaatacaaaaattagccaggcgtggtggcaagtgcctgtagtcccagctacttgggaggctgaggtagaagaattgcttgaatccaggaggcagaagttgcagggagccgagactgcaccactgcactccagcctgggtcacagagcgagactccatctcaaaaaaaaaaaaaaaaaaaaaaaaaaaaaaaaaaaaagagagagagagaaaacaaacaagcaagaaaatgcaacagaaaaatccgtgacccaaagctctctccagttgctgctttctgccggaaattcaaagaacctcagggtagtttttcaacccttgtacccccgcccctgcttcctgctctattagtcctgagggtctgtggtgccgctccatcatgtccaggtgcaggcaatgtttagctcccacctataagcgagaacatgtggtatttgattttctgttcctggcattaattcactaagcatagtgccctttggcttcatccatgttgatgcaaagggcatgattttattcttgttcatggctctgtagtattccatgatgcggaaggaccacatttgttttatctaattgagaacatgtggtatttgattttctgtttctggcattaattctctaaacataatgcccttcggcttcatccatgttgatgcaaagggcgtgattttattcttgttcatggctgtgtagtattccatgatgtggaaggaccacattttctttatctagtggagaacatgcggtatttgattttctgttcctcgtattgattcactaagcataatgccctctggctgcatccatgtggctgcaaagacatgattttatttttttcatcactgtgtagtattccgtggtgtaggagggccacatttgctttatccagttgagaacatgtagtatttcattttctgttcctggcattaattcactacgcataatgtccttcagctgcatccatgtggctgcaaaggacatgatattattctttttcatggctgtgtagtattccatgatgcagaaagaccacatttgctttatctagtggagaacatgtggtattcgattttcttttcctggcgttaattcactaagcataattcccttcagctgtgtccatgtggctgcaaagatgtgattttattctttttcatggctgtgcagtattccatggcatagaagggccacaattgctttatccagtcaagaacatgtggtatttgattttctgttcttgtgttaattcattaagcataatgccctccagctacatccatgtggctgcaaaggacatgattttattctttttcatggctgtgtagtattcgatgctgtagaagaaccacttttgctttatccggtaccccactgatgggcaactaggttgattccatgactttcctattgtaagtcgtgctgtgatgaaccttacagggctgggcactgtaatcccagcactctggagggccgaggtgggcagatcacctgaggtcaggagttcgagaccagcctggtcaacatggtgaaaccccatctctactaaaaatacaaaaattagccaggcatggtggcgcatgcctgtaatcccagctgctcaggaggctgaggcaggagaatcacttgaaccaggaggcggaggttgcagtgagccgagattgcgactgcactccagcatgggcaatagagcgagactccgtctcaaaaaacaaaaacaaacaaacaaaaaaaaaaaggaagtttaccatgcatgtgtctttttggtagaatgacttcttttcctttgggtagatgcccagtcttggaattgctggcgcaaatggtggagcagtttagattcaggaggtacatgtacaggtttcttacatgggtacgatgtgtgatgctgaggtctggggtatgagtgatcccatcacccaagtagtgagcataataccccacagttggttttttcaactcttgtccttctaccttcctctctccccctaactagaccccagtatctcttcccttctctgtgtctacgtatacacaacatttagctcccacttataagtgagaacacgcagcattctgttaatttacttaagataatggcctccacactgttcacaatagcaaagatgtggaaccaacccaaatgctcatcagtgatagattggataaagaaaatgtagcacatagacactgtggaatactatgcagccatgaaaaaggatgagttcatgtcctttgcagggacatggatgaagctggaaaccctcatgttcagcaaagtgacacaggaacagaaaaccaaacactgcatgttctcactcataagtgggaagtgaacaatgagaacacatcgacccagagaggggaacatcacacactggggcctgttgcaggagggggggactggaggagggacagcattatgagaaatatctaatgtagatgatgggttgataggtgcagcaaaccgctatggcacatgtatatctatgtaacaaccctgcatgttctgcacatataccccagaacttaaagtagaatagaaaaaataaaaaataataaaaataattaaaaaagataatggcctccagctacatccgtgttgctgaaaaaaaaaaacaccaaaaacatgattttgttccttttcagggttgtgtagtattccatggtgtagatgtacggcattttctcgagggtggagggtgggaggagggagaagatcagcaaaaacaacctgtggctgggtgtggcagctcacacctgtattctcagcactttgggaggctgaggtgggtggatcacctgaggtcaggagtttgagatcagcctggccaacatggcaaaactctatctctactaaaagtacaaaaattagacaggcacggtggtgcacgcctgtaatcctggctcctctgtaggttgaggcaggaaaatctcttgaacccaagaggcggacattgcagtgagccgagatcatgccactgccctccagcctgggccacagagtgggactccatctcaaaaaataatcataaaaataataataataacctgctaggcttaggacctaggttgattccattacaaaaaaaaaagaaaaaagaaaaaactaactttttaaaagaaggatctccctgttcaaaaacaaaaccaatgccctgtcaggaaagatgttctgtgtttctggtaaagctggaaggaacctacaggaaggagtcaccccataaaactagtggagcagcattgccttttggggtgagggctgcttctgttaggccaccaggatgagtaccttcctggggagtgtggttcatcctataccatccaggaagcaattcctgcccccaaatcacccgccagcttctgccctgtaagtaaaatccccagcaagcgggcagcaaggagctacttgccttggaaggcagccgaagtctctgtccaccacccagactgtgtcctctgggcaaggccagggcttccaattggatggttttcacattagcggctgctgtttagaatcatcaacattggccaggcgcggtggctcacgcctgtcatctcagcactttgggaagctgaggcgggcggatcacaaggtcagggaccagcctggccaacatggtgaaaccctgtctcaactaaaaaaaaaatacaaaaattagcttggtgtggctgggcatggtggctcatccctgtaatcccagcactttgggaggccgaggcgggcggatcatgaggtcaggagatcaacaccatcctggctaacacggtgaaaccccgtctctactaaaaatacaaaaaattagccaggcacggtggcaggcacctgcagtcccagctactcgtgaggctgaggcaggagaatggcgtgaacctgagaggcagggtttgcagtgagcccagattgcaccactgcactccagcctgggtgatatagagtgagactctgtctcaaaaaaaataaaaaaataaaaaattagcctggtgtggtggtcggcacctgtaatcccagctactcaggaggctgaggcaggagaattgcttggaccccggaggcagaggttgcagtgagccgagatcgcgccattgcactccagcctagacaacagagcaagactctgttgcaaaaaaaaaaaaaaaaaaaaagaatcatcaacattgccttggcccaatctcttgtcaaatatttaccactggacctccatgttctagtttcaaagctctgctggccacagtggctcatgtctgtaatcccagcactttgggaggctgaggtaggaggactgcttgaacccaggagcatgaatccatcctaggcaacatagtgataatagtgtcaaatcagagccagtgtctggtaattccccaaatatctgagaattttcttttctttaagtcatagtcatcctggcagaaggctgtaggtccctttggggaagactgggaaaaagataaacaatgtaaatttttggcaatgtagcagcgtacttccccaagatcacccagcctccccttcacttaaggggttgtgggcctgtgaactggctcaagtctgggaattgattgagggttttagatctgtgtttcattaatttgagttagtcttttattcagttgacctagaattcttcattttttaaagaacaactaagactttggtacagcccattagctctccctgtggataccatggattacacaatgccgtgggtgtctgtgagtcaaaccattctgactgctgctttgacactgctttccactgtggtgaccacacccaccttatcttcggtgattaaggacagcccatgttccctgccaccctaggattcaattatcctcattttacttaaagatcccagtccagtggctgcagttcctgctgtaacattttgcctactgagagcacaagctcaaagctcttccaggatactgggctcctctcacaatattctttctcatgatcgtcgtgaggagtatgttctgtagaccctccagtgtgagtgagcaggtctgacataataaatccagtctccgtgagtttttgcatacctttctgtacacataaaccaaggaagttgtggcatctcaactttatgtaccttaggtaaactctgattctgtttcagccaaccaaccaagtcaccaaacaaataagcaaacagccaaccaatcaaccaacaagcaagcaacaaaccaaccaaacaaccaagcaaggaagcaagcaccaagcaagcaagcaaccaaccaaccaagtaaccgatcaaaccaacccttggagccctttctaaagctttgacttacaaccctgagtccagaatctctgtttagtgggccaacattaataaatgtagccgaatccaactttatgttacttccaccatggtgccactcacttaatatccattcccacgtatattctccagatttccttctgtataaattgcgtgtgtgtgtgtgcgggtgtatgtgtgtagaaagagagcatcaactgaaaaatcacaaaattttataaatttagaaaagagagctttatttcttataaaggtttgcagtccgcaaggtggccattatgacaggctgggaagtgtggcctacagccaaggccagaggcaggcatttccagggagggaaggagaggacaggaatttgagccaaatgagttggctacatatacatactcaataggatatcagaggagctacatcattttatgagaatactcataaaagaggtcctaacgcatgcatattcaataaacatgcatgttcattctggggtggagacttgacatttaaatgtattataattaggccctacacatcaaaaagtgaagcagggacataaaggtactcagcctctgtaaaggctcagcctctgtaaaggcacagcctctaaaactggccagaaccagtccatggaggatggtctcttatcaggagaaagttactgaaatcagtcccttgtccagagaaagctgtcgttaaggttagtggggcaggagatcagttactcagcgtctgtgaactgggtgagttgtaattgttttaatcttgcttctctcacagccagtgcttgcttggctgctagagaaaaataaaacccatgtggtagttagaatctagttaattctttaagagtagggtacaagacttaaccctcgcctggcatggccctaggccctgtttataatttgaggtcttattgccacaaagagtctgttctgtcagtctcatgatctctattttaacattaatgctgctcagttgttgggtctaaaccataagagggagggaggtacagggaggtatgtctgacctcctgtcctgtcatggccgagaactgaattttaagatttatttgaggttccgttggccaacagggggtctgttaagtcgggtggggggcttaggattttattttttgttctcaagggagataaaataatttaatccattggcctctgtgactgtgggactaacatggctatgatctgtcggacagacttcaggctggcacccaggcaaaattctatgctgtagtaaatgcatcatgcacatttgtaacaacacgtacataacaatgtcacaaaatactttcacggtgacaactagattagtgttttattgaatagctgatgacataaactgtctcatttggtgccaagactgaccatcaccagcataccaaggtcatcactgatcagaggtctaacccaaggagggggtcatgtgcaggcccagcggtggggaggaaagatgctgcagaggagatggatgcccacagaggcccctgagcggataccatgctcactaagtggtaagtatagactcaacgtaggctgtaagctctccccctgtgtaaatgggaccccgtacacttgagagtcaagggtctgtttgggtggcagggatagccacttctgaaggtagaaaggaaaataagccaccaaattggtacctttctgtgaaatggacatcgtgctcagaatctccattttccccacaacctggaggagtaagtactgtcatctgcattttgtagctgaggaatctgactcaacaaaattaaattactcgcctaagcaattagcaatcaaccaagtctttctgactcagaaacccagctattgcctgttcatatccagcccctgtattggggtcaagatctggcctgttctcaatgcagcaagatccaggcagatcacactggactcccagcactgaatctggctcgaggggacatcaaatttgactgggtcatggggctcaggagcatcactctcaaaaatagcagtacaggaagaggcaatggccctaaacagcatttgcaggcagatcccatgttaatcgtaagggtcaggactctctcacttttctgtctctctctctgtctctcctctagggctgaccccacatcggacaccactgcatccatgtccatcacaacacagctgccttttcttctgcctgcttatgggaaagtcccctcctctcctccgtttccttctcttcctgccctatcacactgtgcacttctccctttccttaaagaaccaccatcaactttaggaggagggaaaggggtggctctgggaggaaaagccagaatcccctctagccagcagagagagaggaatggctgcatgttttctcccccaatccaaggcactaggttttggctaggttgcaggttccaagctgctctcctgctgtgtcggtgagttctggttaacctgcaacctcctgatgtggccactgcagttcatcgagtcttcagggactccccatggcctggagtactttgccttgcttacatgggagaggagaatggatttatagagaacatcatctaaatccaacttgaccattgtgtggccacacttgctagattgctatagtctaaatctagcattgtagaaagacgggggagcttggagctgcacaaacccaggtctggaacgggctccttaccttggaaggtgaatgatcctggtaggactcttagcctccctgggcctcagtttctttatctgtttcatgggaatgaggatctcggctggttggttgggtgatgcgggggctgtgtgaaaacagcttgtcaatacaagctgaaatagaaatatttctccacagagtatgaagatcaaatgagagaatacatttaaattaaatggaaaattaaaatggcaaaaaaggcaaagctgtattgaaagttccgagcttctctataaggagctttttgactatgtaagaatcctgtactcgttccccctaaatataaaaaaaaaatgttgaaggaggcagaagggagagtgatgcacgatgggcgaggacttcacctgctgttgctggctttgaggatggaggaaggaggccacaaacctagaagctggagcccctagaagctagaaaaggcagggacccgattcatcccttgagcctccagaagggacatagccctgccagcaccttgactttagcccagtgagatcctcttaggacttttggcaaccagaactataagacagaaatggaagccactgagtctgtagctgtttgttgcagcagcaatagaaaactaatgcagagcccaagaaatcactggtgatgagatggggaagtgggctcaggaggtctggatctgtgatgagatggggaaagtgggctcaggaggtctggatctgtgatgagatgggggaagtgggctcaggaggtctggatctgagttggggatctggagtggaaggggaattcatttgttcattgtctatccttttgcattaattgaatttttttctatacatacatgtgaattttcacaataaaagttttttccaaaataaaataaaagaaacaaaaggggctttttgcaacccaattcctatctatgtctgagtccacttgtattgaatgagtctttctgctaacgtccttatatttgggtgactatctgaatgtcagtgaccaatcagagcagaggcagaccttggagtgggcagggcatcctgagggccctgattcctgccataaggcataaccctttaggtgccagaccatggggaggtccaggggttgcaggggagggctgtgcatctgcaatggctctcagggggctcccggtggtggcaattggtgaatctgcatggtggtgtttcagtattgtcacaaccctgctgtctctcatgctctcaaaaagcatttctcttacctgtgacagacttcctatacctaacagcttgcaaaaatgttccagattaatgagaataatctctcggagccatacctccctgcttggggtctcagtttccccaaatgtctccagacaagttaggctagaaggcccctgagtctcagcccctctatagccctcctgtcacccagacctgatctgggtcttgcaccctgggtgcagcatgacaggggtgggcaggggctggctctgggccagaggaccctttctgatggacttcagctgttggccttccaggggagactgatcaacctcacaagagtcatatggtgagtagcggtgggcaaatccatccccctcatcttagatttatggggagacagagacaaagaggagacactccaggaagacctgcaggtgggagtaccaggttgaaaccaaggacaccttcctggaggagctgccgtttgagccagctctgagaacaggtggagacaggactggagaggaggaggttgtgccctatgagcaaagactggccaccaccccatctaacacccccacagggcccctgtggcatccctgtccagtccctgtcaccacccagtttttccctctggacccaggaattcaaagtaagcaaggaggtccgctgctccagttggctgcaaataattacaaccttgagcccaagcagcactttgggtcctggtttgggaccatgaagcggctcggtgagactgagaggtaaggccagggcaggaattgggatagtaggattgaactctccctgggggccagcctcagaaagcctgtggccatggcctcttggccaacatcagatcctgtggtctggcaatgcctggggtacccagacctcactctggacaggccctgggagggggccctggtgagattcctggcagcctcacagccactcttctgtccatagctacaacctgtcatgccagctggaggctccatcccagttggctgggagcataaagtccaggaagatagacatcacccaccacaggggccagtcagggcctgaaccagggcgggcagaggttggctgccttgggatatgggtgggctcagggagtcagacagcaagggactagcctcccatcctactgctgagcagccctgtgactggggagagtcaccttacttctctgggcctcagtttccccctctgtggagtgacactaaatgatctctctggagacggggatcaatagggtactggtgattgaccaggcactcagcacatgcctggagcacacagtgcagggctgtggtggggaggtgggctgagttcctagggagtcacccatgtgtgcctgccgttctgaccagccaccaggccctcagggcagagcccactaccagcagcagctcacaccccaagaccagctcagaggcggcccctacctcagcagcagggacatcacagacactttgagctggcactagggtggcttctccagctcccacggggagaggggtcccagctgagtcccactcacgtggagtctcatgcccatgaaagtgccattcaccactggccaggctcatgaggccgcatgagaggggggtcactggggaggagatatcgggggaacagagagggtggttgaatttttgtataataggcagtgcaagtgtttaccgtttggcaggggaaaggtttgttattattagcaatgctacacttcaatattacactaaaatccagtttctctataacctgggagttgctcttttgttctttcttttcccatcttaattaaaatgagatgcagactctcacggtccacagtcgattaagaaatcttgcacggccatcaggttatgtcttggagagcagagtttcagtaccatcagcctggcaaggagctgggcctgctcctcagagctcccgggactgcgagaattggcatgttcacaaggcaccgtcacagcctctgaaacacgctgtctttaaagatgtttgcaggctggacgcggtggctcactcctgtaatcccagcactttgggaggcagaagcgggtggctcacttgaggtcaggagttcgagaccaacatggcaaaaccccatctctactaaaaatacaaaaaattagccaggtgtggtggcaggtgcctgtaattccagctactcaggaggctgaggtaggagaactgcttgaacccaggaggtggaggttgcaatgagcagagatcacaccactgcactccagtctgggcaacaagagcaaaacttcatctcaaaaaaaaaaaaaaaaaaaaaaaacacaaaacacaaagacatttgcaaggaccatgtcctcacccagaatggtgcctgcctttctacagtttttcaggaaaaggaaacattttctgcttctctcgctgaggttttttttaaccacccattaggaacctatagatttcaggatcgaacactgggattccctcagcactaaaggaggacaattgcaaacagagctgaaagtgcaatgtggaaaggtcaggctgaggaaggttcttagccagtagaccaagggcaggaaggacactgcctcctcagtctcccactagggaacttgtgattcttgtcccctgacctcagaattccttgtcatgtttgttttgtctccaagggaagggtttgaattacagaatttaaggctagagtgggcctcgtgcagttaacattaaccctctctctccttcgctggccaaggtgaagtccggaaacatgtagttctgacgtccactctctcgggggatcaccagttcacccatctcacccggcaagctgggacctagtttggcgacaggcatcttccacccacctgggaggcagggttcaacactctgcctctgaccttgtttccttcttctgccacctgcttaggcagccagaaggggttgtccagccagcacctgggctttggcgctcctcaagcaggtggaggaagtttcaggcacctggctcctcaggtgtctgccatccaggtgctcttcaggcctgcccagcagagctctcttgatccagctagaactggccagaactgactcactcaggaatgtgtagactttggcatcaggggctgctttaatttgcacaatttccaaatacctcttttttcttctttttctgatgagtcatcttcctagactttcattttaaagagatagatagttatcaggttccagagaagacatggtagaacatttatatctcaaagacacagagctgagacttcagttttagatactataatttgcctaaaccaaaaaggaaggtgtaggtaaagttctagtcaagacaggatggccaggaaaaacaccttaaaccaagggatggcttgctttgctgatttaagccaatggcttctttatcataagacttcccagtgatttagtcctccctctcttccagtgcacagagacatacccctccttacaaataaaaatgttctttatagatgtaaatttattttacaaaaatgtttcaaaataaccagatgaaaatcatccttatgccagaaagacttgttttttttttcattactagaaatgaaacagtaagtatttgttgtattgacatacttaggcttagacctgtgtttaacaagaaagcctaataatagcactgtggttagactgtagcctatttttccaaaccatcattttattattaaggaaacgaaggaccaaatacctttcattcatctgatatgatcctttaaaacacattccactaacaagtcccatttggaacagctgaaaatcttttaataaaactttttaaagatgagctcatggcttagtgtaaatttcacaagcttaattaggtcaaatggaaggaactcagatgagtagttgcccaatcagagcccattatttgtaagtcatcagacccctccatgaccttaaaactccactctgacctgattattgcaaacctatatacaaaaaagtgaaaggattaattttcattcatcaacctctcaatcccagattttcaaagaaaaaacctatgtaaggaatacttaccaaaaccagacaggaaaattagagcctgcatactttagagtcaaatttgttccactacagccaggtcgcatacaattacatcatttggttcttcatacactctagaactgactaggacagagtttagcatagaagaactgtaagaaataggttctgaaacatagaaattgcaaagttcaaaaggctatgaaaaaaactaatgtaaatgagagactcccctcactttgttttaaagaaatagacccatcagagaaatgcaaatcaaaaccacaatgagataccatctcacaccagttagaatggtgatcattaaaaagtcaggaaacaacaggtgctagagaggatgtggagaaataggaacacttttacactgttggtgggactgtaaactagttcaaccattgtggaagacagtgtggccattcctcagggatctagaactagaaataccatttgacccagccatcccactactgggtatatacccaaaggattataaatcgtgctgctataaagacacatgcacacgtatgtttattgcggcactattcacaatagcaaagacttggaaccaacccaaatgtccaacaatgatagactggatgaagaaaatgtggcacatatacaccatagaatactatgcatccataaaaaatgatgagttcatgtcctttgtagggacacggatgaagttggaaaccatcattctcagcaaactatggcaaggacaaaaaaacaaacaccgcatgttctcactcataggtgggaattgaacaatgagaacacttggacacaggaaagggaaaatcacacaccaggcctgttgtggggtggggggaggggggagggatagcattaggagatatgcctaatataaatgatgagttaatgggtgcagcacaccaacatggcacatgtatacatatgcaacaaacctgcacattgtgcatgtgtaccctagaatttaaagtataataaaaaaaataaaaaaataaaaaaataaatagatgttctgtaaaaatatacacaatttttacagacaaatacatttataagttgtttttatcttaaaaattggggatatttcatatttataactaattattgaaccttaagttttcttggccatttataggctaataaactaagaatcatgtaaactaagccaaagtagaatagacataaaagtcctaacacttcaacttcctatccttcaagaagtatacctcgcaaagctcatttgagagaggaaaagctttcctccaccctctgttttacagcgctgaggtttctcatcacatttctatgacttatagcttaaatccatgttacatggtcactggcattgttagtgcttctcttttaatactgtagaaattaatcaatttggtggcgtatttaattaattctatcactagaggattgtaaaattacatatatgaatacctcactttagagaccacttaattttttttccaaggggatatttgactatatttcacttgtgtcttatttaatgattttataatttaaaccctaaattataaatctagaatttagagagtatatttccccactggattacatttttggaattattatatgtgcacaaatattacaaaatcactgtagacacctgaaaactatattatcttttaaaagcaatatttacattaaactggtataacaaaattgtttggtgcattttttccagtacattttgtatatattacatgtttaacctttttttattcagcaaataatttttgagtatctactaagtgctaggttctgcattactaattgaatttaaagagtgaaataacagacatggtctcagacaataaaaattaacattaggtcacctatttacatattttaaaatggtaattatgaaaactttgagattttaaactagataacattataataatacacttgatgttgttaatatttgccagtgagcaaaaaagaaaataaaaagatggttttattcaatatacactttaaaattgcagaaaatagtcaagtttctctgctttgcagtttaatgtctatgtgtttttctctgcaacttggcttttgtggagtgaaacaattattcttccagcccaataaaggcagaagagtaacaataaatctaatattttaaatgcttatcaaaagatagtaaacatattatttcagaatactgagttcaataagttgacctacaaaaaaagccaaactgacagtattactgaataaggaaaggcccaaagagacaaaatactttttattttgtaacctcggtatgatacaacttaccctaactataaagaccctaaattaccaagatgggtgcttataatatggagagtaaaaaaagtcatttcacttttagcttttttatttctctcagaataaaaagtgtataaggagtttataaagaagttgatactataagttagtactacaaagacagcacttttcaagaaaagacttttttctctcttacaaatatcatgttagcagtatttgttttctccagaaataatgaggaaataaaaacataagtatgtgggtaattagtgtagtttcttaaagaaatgagttaggcaacaggctaataatgtatacttcgctggcttttgaatgccaacaatcatattctttataaggcacagagaagatttttctgaagaataagtatgtgaacctgaaaagtaatcgccacttggtagtgacaatatggatagggtgaagggcgtcatcaagaagcaatgaaaagatacatttgcagttaaatttgaaaaccatgatgtttaatacatatagtaataaagaatactttctcctatttcaaaattattttagaattaagatagaagctaaaatacctagggataatgatatgactatcaaaaattaaaaattaaaggacattttgagtattataagttaagaatgagaacttattacccaaagaacaggggataattcattatgctccatatccattgaattaaaagacaggcccattacctggataatttgaaagtttaattttatttaaaagtcttgtttcattcatcaagctaaaggattagctcccagaaatattctaggattgcatatccccaactctgtaggaagtatagaaagaatgttataagggccaccatctaaacattattatgtaaataatttagtaccattccatttgcctttgtagatttaaaaatgtaaatggctttctcatattaggaaacatcacttttcaaaacccagataaacatagtatattgcaagagaataattattttctttattaaaaaatactggatgctaagtccaaaagacataaattattttatactaataactactaacattttattcattaaaatataaaggtcaaagattttaaaatgatctttaaatgattaataacatgttgatctttttcttctttctgtaaacctttttgagtcttaacaatactaaactatacaagcaatattaaatagtatataaacggattaaaatattcaaatttactagaatgtggacattggaaagaatgaaaataaacagaagcataaagcagcagatataaaattaagaaagcaactaagagtgtttaaagtacatattcatctgtagtctaatgtctaccataaacaatgactcttctcagtaaaacacaaattgttcatgaagggaaaaagcatgttgtattagagaatattcaacataatttttttagtactaacttgtgcctggagtattattggtttttccattatgaacttatgcacttgataatttttttcataaaaattgtatgtacaactccattcaaaagcagtttttggtgggttttttttttttttttgagatgagttttgctcttttcacccaggctggagtgcaatggtgcgaatttggctcacagcaacctagcaacctttgcctcctaggctcaggtgattctcttgcctcagcctctcgagtggttagaactacaagcatgcaccaccatgcctggctaattttgtgtttttagtagagacatggttttgccatgttgaccaggctggtcttgaactcctgacctgaggtaatccgcccaccttggcctcccaaagtgctgggtatgggcaagagccaccatacctggcctcaaaagcagtttttaaaagcaaacacaatataacaccaaagttgaaaaatctatgctcacccaaggatgccaggtttaataaattatttatagaatactgcatcaaaaataagacaataacccaaaatataccattaaagatgtatccactcctacaactagagataattaatctatctggtagcaaatgatacttcaatcagtttcagcatgtctgaaatctttaaggacaaaagtgataaaacatgacttcattcttcattagactcttagaacacttgaaggaaaataatttctgaagcacaaagaggtaaagaggtgtaatctttcaaaaagatattcagtgttcaaaatccaagagtgcaatatcaggctgggtgcggtggcttatgcctgtaatcccagcactttgggaggccatggtgggtggatcacctgaggtcaggagttcgagtccagccaggcatggactctggctgtactaaaaacacaaaaattagccaggcatggtggtgtgcacctgtagtcctagctacttgtggggctgagacaggagaatcgcttgaacctgggaggtggaggttgcagtgaaccgagatcatgccacctcactccagcatcagtaacagaatgagattccatctcaaaaaaagaaaagagtgtaatatcggtatacacagataatatactgaatgaaacaaatagaataatttgaagaggtatcttgatgaacaaggagtcattagaaaggttgtattcatgtctttgaaggaaattgcaatgtgagaaattaatactttgactactatactaaaagtttattgctaacatgtattgagttattaacgtgtgttaggcagagtgccatataatttacaagtgttatctcatttattgcaggtgaaatgtaatttcgaactctggaagtataaatgaattagatagaaaaaaattctatttaaatggccaccagtaaatcggtatctaggaacagggtgatacagtgcccaagttttctattcttactaaatgttgtgtttcattttcaatgttttcttggatattgctcttttttggtgattttgatttttttttattttagaaaactaataaattgactcttcttggtactgactcgggttttatagaagaaaaagtaaattctgtacatttacctttacctcatctttttctcttttaaatttactatattttttattttttttgtaattttattttatttttctatgattattatttttattattattatactttaagttttagggtacatgtgcacattgtgcaggttagttacatatgtatacatgtgccatgctggtgcgctgcacccactaactcgtcatctagcattaggtatatctcccaatgctatccctcccacctccccccaccccacaacagtccccagagtgtgatattccccttcctgtgtccatgtgatctcattgttcaattcccacctatgagtgagaatatgcagtgtttggttttttgttcttgcgatagtttactgagtatgatgatttccaatttcatccacatccctacaaaggacatgaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttccgatttctccacatcctctctagcacctgttgtttcctgactttttaatgattgccattctaactggtgtgagatggtatctcattgtggttttgatttgcatttctctgatggccagtgatggtgagcattttttcgtgtgttttttggctgcataaatgtcttcttttgagaagtgtctgttcatgtccttcgcccactttttgatggggttgtttttttcttgtaactttgttggagttcattgtagattctggatattagccctttgtcagatgagtaggttgcgaacattttctcccattttgtaggttgcctgttcactctgatggcagtttcttttgctgtgcagaagctctttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtgtaaggtgtaaggaagggatccagtttcagctttctacatatggctagccagttttcccagcaccatttattaaatagggaatcttttccccattgcttgtttttctcaggtttgtcaaagatcagatagttgtagatatgtggcgttatttctgagggctctgttctgttccattgatctatatctctgttttggtaccagtaccatactgttttggttactgtagccttgtagtatagtttgaagtcaggtagtgtgatacctccagctttgttcttttggcttaggattgacttggcgatgtgggctattttttggttccatatgaactttaaagtagttttttccaattctgtgaagaaaggcattggtagcttgagggggatggcattgaatctgtaaattaccttggggagtatggccattttcacgatattgattcttcctacccatgagcatggaatgttcttccatttgtttgtatcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttcgtacattgattttgtatcctgagactttgctgaagttgcttatcagcttaaggagattttgggctgagacgatggggttttctagatatacaatcatgtcatctgcaaagagggacaatttgacttcctcttttcctaattgaataccctttatttccttctcctgcctaactgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgcatattgaaccagccttgcatcccagggatgaagcccacttgatcatggtggataagctttttgatgtgctgctggattcattttgccagtattttattgaggatttttgcatcaatgttcatcaaggatattggtctaaaattctctttttttgttgtgtctctgcctggctttggtatcagaatgatgctggcctcataaaaagagttagggaggattccctctttttctattgattggaatagtttcagaaggaatggtaccagctcctccttctacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcctctttatcattttttattgcgtctatttgattcttctcttttttctttattagtcttgctagcggtctatcaattttgttgatcctttcaaaaaaccagctcctggattcactaattttttgaatggtttttttgtgtctctatttccttcagttctgctctgattttaattatttcttgccttctgctagcttttgaatgtgtttgctcttgcttttctagttcttttaattgtgaggttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagtaggttgttcagtttccatgtagttgaatggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctactaggtccgcttggtgcagagctgagttcaattcctgggtatccttgttgactttctgtctcgttgatctgcctaatgttgacagtggggtgttaaagtctgccattattaatgtgtgggagtctaaagtctctttgtaggtcactcaggacttgctttatgaatcttggtgctcctgtagtgggtgcatatatatttaggatagttagctcttcttgttgaattgatccctttaccattatgtaatggccttctttgtctcttttgatctttgttggtttaaagtctgttttatcatagactaggattgcaacccctgcctttttttgttttccatttgcttggtagatgttcctccatccttttattttgagcctatgtgtgtctctgcatgtgagatgggtttcctgaatatagcacactgatgggtcttgactctttatccaattttccagtctgtgtcttttaattggagcatttagtccatttacatttaaagttaatattgttatgtgtgaatttgatcctgtcattatgatgttagctggttattttgcttgttagttgatgcagtttcttcctagtcttgatggtctttacattttggcatgattttgcagtggctggtactggttgttcctttccatgtttagcgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatatgaacgttggcctgccttgctagattggggaagttctcctggataatatcctgcagagtgttttccaacttggttccattctccccatcactttcaggtacaccaatcagacatagatttggtcttttcagatagtcccatatttcttggaggctttgctcattccttttaattctgttttctctaaacttcccttcttgcttcatttcattcgtttcatcttccatcgctgatactctttcttccagttgatcacattagctcctgaggctttgcattcttcacgtagttctggagacttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttctgttgctggtaaggaactgcgttcctttggaggaggagagcgctctgctttttagagtttccagtttttctgttctgttttttccccatgtttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtatcagtgtgcccctgctggggggtgcctcccagttaggctgctctggggtcaggggtcagggacccacttgaggaggcagtctgcccgttctcagatctccagctgcgtgctgggagaacaactgctctcttcaaagctgtcagacagggacatttaagtctgcagagattactgctgtctttttgtctgtgccctgcccccagaggtggagcctacagaggcaggcaggcctccttgagctgtggtgggctccacccagttcgagcttcccggctgctttgtttacctaagcaagcctgggcaatggtgggcgcccctcccccagcctcgctgccgccttgcagtttgatctcagactgctgtgctagcaatcagcgagactccgtgggcgtaggaccctccgagccaggtgcaggatataatctcgtggtgcgccgttttttaagtccatcggaaaagcgcagtattcgggtgggagttacccgattttccaggtgccgtccatcacccctttctttgactcggaaagggaactccctgaccccttgcgcttcccaagtgaggcaattcctcgccctgctttggctcgcgcacggtgcgcgcacccactgacctgtgcccactgtctggcactccctagtgagatgaacccggtacctcagatggaaatgcagaaatcaccgtcttctgtgtcgctcacgctgggagctgtagactggagctgttcctatttggccatcttggctcctcccccttaaatttactttaattgacatataataaatgtacatgttatggggtacagagtgatattttgatatatttatacgatgtgtaaagatcaagtcagagtcattatcatatccattacctaaatcatgtattatttctttgcagtgagaatattcaaaatcttttattttagttatttgaaaacacacaataaattcccattaactacagtcacccaacagtgctgtagagaactagaacttcttccttctctccagctgtaattttgtatgtattaaccacatttttcttatactcttctttctcctactctttccaggatatggtaaccaaaactctactatctacttctacgggattaaaaattttagcttccatacataagtgagaacacgtagttatgtggtgtttatgtttctatgccaggcttatttcacctaacataatgccctccacttgcattcttgttgccacaaataacaggattttgttctttattatgactaaataatattccattatatatgtatgtcacatttctttatccattcatctgttgatggacacttttgttgattccatatcttggctattgtgaatagtactgtaataaacatgggggtgcaggtaactctttgatatactgattttctttcctttggatatatactgaaaaccatatgattaaattaataaacacaataaaagcgtttggcaaaattaaatattcttacatgacaaaaaacctctcaacaatttagtatagaaaatatatgccttaacacagaaggacataaaggacaaatctacagctaagatcatactgagtgtggaaaacgtgaaagattttactgtgaacaagaaaaagattttactggaacaggaaaaggatgcctattctcaccaatcatatttcacatagtgaaagtcttagccaggacaattaggtgagagaaagaaataaaggacatctgaattggaaaggagacagtcaaactgtccctgtttaaagacaatgtgatcttatacacggaaaaaaataagactctaccaaaagcttcttagggtgatacatgaaattaataaagttgcaggatataaatcaacatacaaaaatcagtagcatttctatatattgatagtaaactagctgaaacaagaaattaagaaagcaattccttttacaatagctacaaaaatgtacttagaaataaatttaaccaaggaagtaaaagatttcgacaacaaaaatgacaaatactaatgaaagaaattaaagaaaacacaaaaaaggaaagacatccacgtttatagattgaaataatattcttaaaatgacccactatcctatgtgatttacaaatttagtacaatcactagcttgtatttttaaaagcacctttgctgcatattcttaagatattcaatgacaatgcctggatttaagtttgaggtattattatatctattttatactgggcacaatataatgttatcagaggtaatggttttgattggtcctaggtcatacagtaatatatacattgtgatttatagacatgctatcttttaatactcaggcatttacaaagttcatttagacaaagttataaaaacttgccttcctttccgcctatatcacctaaaaatcctaatttaagaggtaataacattttttgatatacaatttatcaacacaataaaaatctaacaattatcatgtgcagagtgtgaaaatctcatcagattaaggaacacaaagacatctttttcatatttcgaatgtaaaactgttttggaaactgttatttttagaaacagttaaaaacattttttcattagtttttcatgtaaaattgtgacaaccagcatgaaataactgtcatcacagaagcatggtatattcgattccaaaacatattctttgtaagttttaatatatttatgtattatttatacttacattgtaacccataatgtacagatattatttttccttcaactcttaagaatattcttaaataataaaaaattaatgatttataatttttgttggttgggaaaaagaatagacacacacgtgacagtgcatcacttcacctcatcatttcatctcatcattttatctcatcatttcatctcatcattttatctcatcatttcatctcatctcatctcatcccatcatttcatatcatctcatttcatcaaatctcatctcatctcatttccatttcattttcattatttcatttcatcatttcatttcactatttcatttcatttcatctaatttcatttatttcattatgtcatttcatatcatctcatttcatttcatctcatattttttatatcatttttcatatcatttttcatctcatcatttcatctcaattcatttcatctcatcatttcatctcctcatctcatcatttcctcctttcaacatttcatctcatttcttctcatctcatttcaatttcatttcattatttcatctcatttcattatttcacctaatttcattatttcatctcatctcatctcaattcatcatttcatctcatttttcatctcatcatttttcatctcatcatctaatctcatttcacttcatttcatctcatcatttcagctcatcatttcatgtcacatctcatttcatcatttcatttcaacatttcatttcatctcatctttcaatttcatttcaatatcatcatttcttttcatttcatctcatttcattatttcatttcatttcatctcaccatttcatctcatcatttttcatctcatcatctcatctcatcatttcatcatttcatctcatttcttctcatcatttcatctcatcattttatctcatttcatctcatctcatttcaatttcatttcattatttcatttcatttcacttcatttcatctcatcattttatctcatctcatttcatctcatttcttctcatctcatcatttcatcatttcatcttgtttcatctcatttcatctcacctcatctcatcatttcatctcaacatttcatctcttcctttcatttcatctcatcgtttcgtctcatctcatctcatctcacctcagcatttcatcatttcatctcatcatttcttatttcatctcattttatctcatttcatctcatatctcaattcaatttcctttcattatttcatttcatctcattcatttcatctcatttcattacatctcatcatttcctctcatcattacatctcatctcatctcatcatttcatcatttcatctcatcattgcatctcatcatttcaaatccatcattcatctcgtcatttcatctcatcatttccatttcatcatttcatttcatcatttaatttcatcatctcatttaatttcacctcatttcattatttcatttcattttttcatttatgtcatttcatttcatctcattacatttcgtctaatttcatttcatcccatttcatctcatcatttcatctcatcttttcatctcatcatttcatctcatcttttcatctcatcattttatctcatcatctcatcaactcttttcatcttatcatttcatcatttcatctcatctcatatcttctcatctcatttcaatttcatgtcattatttcatttcattatttcatgtcatctcatctcatcatttcatctcatcatttcatcattttatttcatcatctcatcttatcatttcatctcatttcaattttatttcaatttcattatttcatttcatttcatctcatcagttcatctcatcatttcatctcatcatctcatctcatcatttcatctcatcactcatctcatttcatatcatcattttatctcatctcatcatttcatctcatttcatctcatctcatttcatcattacatctcatttcatctcattttatgtcatcatttcatgtcatcatttcatcacatctcatcgtttcatctcatcatttcatcatttcatctcatttcaactcattgcatctcatctcatcatttccatttcattattccatttcatcatttcatttcattatgtcatttcatctcatcatatttcatctcatctcatcatttcatttcatctcatcatttcatctcatcatttcatctcattttatctcatctcatcatttcatcatttcatctcatcatttcttctcatctcatcatttcattatttcatttcatctcatttcattatttcatttgtcatttcatctcattacatttcatctcatcatttcatccatcatttcatttcatcatttcatctcatgatttcatctcatctcatctcgttatcgcatttcatctcattattgcatctcatttcatctcatctcatcatttcatttcatcattacatctcatcatttcaactcatttcaatttcatttcaatttcatcattacatttcataatttcctttcattatttcatttcatttcatctcatttcattatttcatttcatctcatttttcatctcatttcatctcatcatttcatctcatcattcatctcatttcatctcatcattttatctcattatttcatctcatctcatctcatttcaatttcattatttcatatcatttcattatttcatttcatctcatcatttcatctcgtttcatctcatcatttcatccatcatctcatcatttcatctcatttcatctcatctcatctcctttcaatttcttttcaattttgtcatttcgtctcatcatttcatctcatcgtttctactcaccatttcatctcaaaatttcatctcatcatctcatctcatctcatcatttcgtcatttcatctcatctcaagtcatcttatcatttcatctaagtgaaatgatgtaatggaatcatgaaatgaaatggataggatgccctcagtgatgttaaatttaaaaattgtttcttttcatgtatgcatttttatatttatatgtatttatatttatatttacttatatttctttttacttatttttatttatatttttacttatttctttatttatagacaaggtcctgttctgtggcctaggctggaatgcagtggtgcattcacagttcactgcagcctcgagcaaacctcccaccttagcctcccaggtggctgggaccccaggtgcacaccaccacacctggttaatattttattatttgtagagatggagtcttgctattctgcccaggctggtctcaaactcctgggctcaagcaatcctcctgcattggcaacccaaaatgctgggatgacagatatgagccacagtgcccaacctatttatttatttatttatttaataaggacaaggtctcactatgttgcccaggctggtcaactcctggactcaaatgattctccaaacgtggcctctcaaaatgttgggattacaggtatgagccaccatgcctggctaaaaatagtattatatttttgtatcatataattttcaattaggtaatatgaatattctgtacaggaaatacgcccttaattacataggaataaacatttgttacactgagaaaaatctaacagagctaaaaataaaaattaatttggaaaggtcattagatactgacacattcttacgtttatacattctttcatatattcatatattcttttaacagtatcaatggtttggagttatgtgtacaaaaccatgacctatatgtaatacaactaataacaggcacttacaattcaaggcatattatatacaaagctttaacttcttatcaaaatattttgttttttttctttctgttttggcagatactatgaatacaacattcaactcacagacaccatggagcccttactaagcataaagtactgtgaaaggccagggctaggacagaactgagacagggccagggataggacagaaccggggcagggtcatggccagagaaaaaccaggggcagggtcacagccagggacatgagaggaccaaggccagggccagaagcagggcagaaccagggccagggcagggacatggcagggccagggccatggcaggatcagggtcagcagaaggccagggcagggctagggtagcacagggccaaggcagggcagggtcagtgtagagcaaggaacgggccagggtatggcagggcagggacagggaggtccagggccagagtcaggtccagcacatggacagggcagggccagaaacatggcaggaccagaaaggggacagggcaagggcaaggccagagaaggaccatggaaaaaacatggccagggagggtccagggcaagggcaaggccagggcagaaccagagccagggcaggccaaaggcagggccagggcagggcaaggccagggtagggtggggccagggtagggtgagggtagggccagggcgagttcagggccagggcaggactaagatagcacagggccaaggcagggccagggcagggccaaaaggaggggccagggccaagcatggccagtgtcagacctggggattgtcagggccagggtcagggtcaaggctgggccagggacagggccagagcaagggcagggccagggagaaagcagaaccagagaggatccagagcaaggccagggtcagggaagaaccaggaccaggataaggcaaagccaaggccagggcagggcaagaccagggcagggcaagaccagggcagggcaaggccagggtagggccaggccagggtaggagaaggccatgatagggccaaggccaaggcagggcagggctagggtagcacagggcatggccaaaaacagggcagggccatagcagtggcaggactagcaacagggccagggcaagcgctggaccacagcatggtggggacaatacagggccaggacagaggatggcaaggcaggtccagggccatttcatggactcggtaggcctggggtcaggccagggcagggcaaaggcaaggccagggagaaggcaaggccggggccaaggcagtgccagggcagggcaggaccagtgcagggccaacgcagggtgagggcaaggccagggcatggaagggcagggcaggaccaaggggaagggccaggagagggccacggcagggtcacggccagaacaagggtatggctggggtcaggaatatggtaggacgagggctgggcccaggctgggacacgcagggcagagcatggcctgtgcaaggcacggccagagccaggccatagagatgggagggcaacaccaaggcagagtcagggtagatccagggctgagcagagtcagggcaggtccagagtcgaggcagagctagggcccaagcagggccatggtagcaccagggcagaggagggcagggcaatgcaggactgggccatggcagtgcctggtcaactccggggcagggccagaagcaggacagggccagggccaatgctcaggccagggacagggcatgacaggacgtgccagagcagggctgggccaatgttggggcaggacaaatcagaccaggacacctccaagtccagctctggccctgccttggccctggacccttcctggcctgaccttgtccctggccctgccctatccatgccctgtgtgtttgaccactgttttataaccagaatcctacaagaaacttaaattagttctttttgtgcatttttagtagagatggggtttcacaatgttgaccaggctggttccaaactcctgagctcaagccatctgcctgccttggcctcccaaagtgctgggattacaggagtaatctggccaagtatttaacttctttatgcctgtttcctacatttggaaaatggggatgctttaagtacctagcacatagaattattgtgagaatcaatgcctcacatatttacatattgataaaattatactcatagaacactactggaaacaaagacagtattagttaaaatttagtgattactgcaaatattattactattacaaacaacatagtatagacattactactactatagttatcttaaaaatctaaaataaaaattttacataatagcctaatgtaatctctcctgctctgccctggctcagccctagtgctggctctgcccctagtcctactacatccctggccctgacccttccctggtccagccgctgccctggcccttcccatcttcaggccttaccacggccctaccctggtcctgaccctgccctggtctggtcctgaccctggccctaccccacagaaggggtatggcagagccagggaagggccagggcaaataagtgacaggacacatccaaatccaggaaagggccagggctatgacagagccagggcaagtccttggcagggccaggttccaggccagggccaggaaagggtcatggcagggtcactgtatggccaaggtccaggccaaagccaaggcagtggcagggtcagggctgcataagggcaggaccagagccagtgatacggcagggccagggccagggccagggctgtgccaggacagaacaagagcagagcagggcaggaccagagccaggccatagagagagtagggcaaatgccaaggcaaggccagggtagtgccagggctgaggcaaggtcagggaaggtccagggctgagtcaaggctagaaccaagacaggggcaaaggccggggcagatctagggcacaagcagagcaggctagggcagggcaatggcaagaccaggccatggcagggccagcccaggatagaagagggcacaggcagggcagggccagggccacagctggggcaggacaaggaccaggaccggggtccaggccagggcaagggtatggccagggcagaggtaggccagagccagggtctgggcaggaccaaggcaggtctgttgcagggccagggttcagaccagggccagagcagggctgggacagggccagggccagaaccaggaaagggcaatgtcaggacaagggccatggcaggaccagcaacggggctggggccaggacagggtcaggaccagggctgggccagggtatggccttaagtagcgaagggccagggccagggtccatgccagtgccagcgccggtccagggcagacgcagggccatggccaggtctaggacaaggctggggcagggccaaggtctgggtcagggtcagcacaagaccaggacagagccaggggagggacagggccatggtaagaccagattaaatcagggacaagacacctgcaaatccacttcagggccagggtcagggcagggccagttcagggccagggccagggccaagacagggccagggttagggctcccagggtcattggcagggccagggtcagggctgccagggtcattggcagggccagggccatggcaggaccagggtcaggagcaggggtcaatgccaggccaaggccacacataggaccaggtctgtgctagggccagtgtgagggccaaggcggggtcagggcagggccaaagggagggcagggccagggcagggtgatgcaggcccagggtagcacagggttaaggtagggcacgaccaaccagggcaggtctatggctggggccggggcagggccagggccagggcagggccagagccagggcagggccaagacagtggcagctccagggcagggccagggttaggaccacggacatgtccaaggccagtgccagggcaagggcaagggcaggggcagggccaggttcatctaagaaccagggacaaagccaggcccagagatgggccaggacaggtacctggcagggctagggtctgggccagggccacggcagggccagggccacaaccaggtctgtgctatagccaggtccaacacagtgcccaggtaaggctaggtagaaggccaaggtagggccagggcagggtcaaagccaggctagggccaaggcagggccagggctggcaaggcagggccaggaaagcatagggccaaggcagggcagggccaggccagtaccaagacctgggcagggccaggggcagggccaggggcagggccacggccacagcctaggcaggaccaggttcggggcaggagcaaaacaagggtaaggacagtgcaggttcttggcacagccagggtccaggacagtgtcagggcagggccaaggcagggtctgggccttgataagaccagcaacagggctggggctaggccagtgacaggaccagagtcagggcaagggccagagcagtgcaaggccagggtagggccaggcatttcagggtcagggccaggggagaaccagggcaaggtctgaagcagggaagggccagggccaggacaggtccagggcagggccatgacacggccaggggctgcgttagggcaagggcagggccagagcaaggtaagggtcagggccaaggccagggtagggacagggcaagaaatatggcaggaccaggggcaatgccaaggccaaggctgggccagggctgagccagggctgagtcagggcagggcaaggcagggcatggtatggccagtgcaggacaggacaagagccagtccagagagagagcagggctgatgccaagaaagagccaggctagtgccgaggctgaggcagtgtcagagcatgtccagggcagggccggggccagggacagaaccgagccagggcacagccaagacagggtagggcagggaaatagcatggctgggtcagtactgggacagggcagagcagggcaaggcgatggtagcggcagggcagggacaggccaatgcagagccatgtcatgccggggccaggacacctccaagtccacttcaggcccagggctatggcaggacaaagaccagggccaggatcagggccaggtctgtgctagggccagctccagatgagggtctagcgaagactagggtgagggccaaggtaaggccagggcagggtcaaaggcagagtagggccaggtcagggtgatgacacatccagagcacaacagggcagggtgatggcaagaccaggggcagaccactgccagctcagggccaaggaaaggccagtgcagagccaggaaagggtctgggtctgaacaaggcagagcagggccagggccatggcagagtcagggcaggtccttgacaggaccaggttccaggccagggctagggcagcagcaggggcagggcctggataagggcagggccagggatatggcaggaccagggctagggccagggccaggccatagtgagggcagggcaaaagccaaggcagggtcagggcaggtccagggcaggtccagggagcggccagcaccaagcggggccaaggcacaaccagcgcagggtaaggcaggacaatggcaccactgggccatgacagggcaaggtcagcaccaggagagggcagaacaggcaggcccatggtggggccagggcagggatgggccaaagcagggccaggacatgtccaaggccaggtcagggccagaacaggagcaggaccatgaccattggcagggccagtgccatgacaggaccagggtcaggacaaggggcagggccagagccagggccagaaccaaggtcaggccagtgcaggttcagggcagggccagtgccagggcaagaccagggcagggacagggtagcacagggccaagacagggtcaggatgggaccagagcaggacagggccgagagtccaggtaacagtagagcaggtatagggcaaggcagggcagtacagggccagatccatggcaggcgcagggcaaagccaggcccattgccaatgcaccagccctccctacaaggctcctaccacctggccactgctgcagcccgtccatcgctgtaagcctgaaccccaaccctggctgcagccacctgccctcctagtgcggccgctctcctaccgctctggcgcactgcaatctccgtcactgccacccacccgcagcgaggcaagccgtggtgtcgcaggctcaaggtgtctcctcctcctcctggcacggagcagctgggcaggcaaagccagaaaagcctagaggaagatgtgaggggtggaagggttagagcctcaacttgtcatgccagccactgggtggcaggggccagtttcagcaaaggcactcacacccaccctccaaagtccagcctctccttttggcccaagctggccgggaactggggtctggggtgggtgctggagatatcacagcacccagctccccactccacaggaaccattgggcccaccggggctgcactcctcggggagcaggagaagcagaaaaattcagacccagccagccctccgcacccaggtgccaattcctgttccggacgcctccacgcacagggccctgtcccccatggtgtccccaggggtgcctggcagcctctgaggcacagacccagagtgcacaggcccaggaaccacggtgggtgtgggggctctgccatgctcaggattcccacgcaaacgctgtgtgccctgccgcattccagtatgaccaagagtgggtcgccctctggagtgtggagtcagggagaggagaaccactccttccttggatgccaactctgttgaccgccgccagcagtgcagcccctgatagcaccgaactcgcccccgctccacggctagtcctgccctcaatagcgccccccacctccgtcccccaatgccgccagtagcgtatacccgataatgccctaacctgtcctcctccatgggcactgaagccccagaaagcgcccataacccaccctccctgctgtgggcagtgcagccctgtacagtgctaccaaccagtacccctaatgcaggcaatgacaccctggatagcgcccccaacccaccccacactgcgaaaggtgcagccctggatagcccctgtcctaccactctgttcatgctgcagtctctgtcaccaccaccagcaaccacagtgaggcaagccagtgggccgcaggctctagcatccagcagccaggcatggagcagctctcgctgatggccggctcctaccactctgaccatgctgctgtctgtctccatggccatcttctttcactacaaaggaataaaactaggtatcaataagaaaagtaattttggaaacaatacaatcacatggaagttaaacactaccctcctgaataaatgactagcaggtcaatgaagatactaagacagaaattcaaaaatttcatgaaacaaagggtaatgaaaacacagtataccaaaacttgttacgcagaaagccatacaaaggcagagatttacagctacaagtgcctaccatccaaacaaaagaaaaacttcaaataaacaatacatcttaaagaactagtaaagaacaaactaaaccgaaaataagaaaataaataagatcgtagcagaaacaaaattgaaataaaaaacacacaagattaaacgaaaagttggttttctggaaagctaaacaaaattgacaaacttttaaccaggctaagaaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttaaacaatgaaaacatccaagaccagaacagattggtaacaagtaatgagattgaagccatcagaaaaagtctcccagtaaagaaaagcccaggaactgatgtcttcactgctgatggcttcacaccaaacaatttaaagacctagtacgaatcctgctcaaactattttgaaaaacaggagggaatacttccaaacttattctatgagaccattattactgtgataacaaaatcagacaaaagcatcaaagaaggaaactacaggccaggatctctaatattgatgcaaaaatcctcaacaaaataccagtgaatcaaattcagtaatacattaaagagataattcatcatgatcaagtgggatgtatccctgggatgcaagggtcactcaacatacaatgtgatacatcatatcaaccaaataaacgacaaaaacagtatgatcacgtcaactgaaaccgaaaaagcatttgatgaaattcaacatcccttcatgctataaatcctcaaagaaacgggcacagaagaaacataccgcaacataataaaaactacaggaaagacacccacagctagaatcatatggaatggggaaaaacggaaagcttttcctctaagatctggaacatgataaggatgccccctgtcaccactgttgtttaacatagtaccagaaatcctagctaaagcaatcagtacagcccctgatatggcccccaacccaccctgccccctaccaccagcagtgtcgcccccccgcaacagcacacccaacatacccaagccgccccgcctccccgcaccatgggcattacagcaccccatagcgccctcaacccgaaaccgccacccacccccccaccgcccacagccgcacagtgcagccccggatagcacacttagcccacctcactgttgccagcaatacagtctgggatagtgcccccaaccggctccccgccaaaggcagtgcagccccggtttgggcccccaaaccatccccccgtgcaggcagcacagccccagatagcacacccaaccagccacccaagacgggcagtgacgcctgagatagggctcccaaccggtcccaggccacccgcagtgcagcctggatagcgcgcttaccccaacgcctttctacgctctggctggctgcagtgtccatcgctgccaccaaccacaaacagggctgcaaacaggaaggattttattcaccgtcgatgcggccccgaggtgtcccaaagcgaggcagtgcccccaaggtctgtgcagagcagaacgcagctccgccctcgcggtgccaccggcccgcccgcccgggtctgtgctgaggagaacattgctctgccttcgctgtatctccgaagtctgtgcaaaggagaactcagctccgccctcgcaaaggcacacagcgccggcgtggcggagaggcggacagcggcggagaggcggacagcggcggagaggcggacagcggcggcgcggcggagaggcggacagcggcggagaggcgcacagcggcggcgcaggcgcggagaggcgcacagcggcggcgcaggcgcggagaggggcacagcggcggcgcaggcgcggagaggcgcacagcgcggcacagcgaggcgccggcccagactccactccccagctgtgaaagggtaagaactgagggtggctgagactcggggttgttcagggcggggtgggctctggacccagcaggcccggcacccaggtcagggctccaggggaggccaggtgggcgaaggccaagaaggggccggggctggtcaggaagggctcctggtaaccagagcactttgcgtgagccagcgtgggaggaaggtgggctggatgagctagggaggcgccgggaggggccttggcagaggcgaccccctccgtcagcccccaggccactgaaccctgggtagcgagaaccgacaggggaggctgcatacagaggagtggaggctccccggctttgggggctctgagtagaagcatctagggggtccctcaagaggcccccaaacgcctccccatggtgagaaaagaaagcgcagagaggggcacggctgtgatttcttttattgccccaaatgtacttcatcttggtagatttctattggctttaaaaatgtgtgtgttttgctgttggggagtggggtgttatacggatgtcagattttgctggttgactgttcagatcttttgtaaatccttgctccttttctgcctagtttcactctgtcacttacattagagtgcggtggcacgaacatgactcactgcagccttgacttcctagggtcaagtacttcccctggcttaacctcctgagtagctggtactataggtgtgtgccgccacacctggctaaatttaaaattttttggagagatgaggccttgctatgttgcccaggctcgaactcctggcctcgagctatcctttgtctttgcctcccagagttctgggattacaggcatgagccactgtgcccggcctctgcctagttttaacagttgctaagaggaggatgttgaagtagatgtcttcttggtgggttaatccttttgtcattaagcagttgttatggtcacttccttttcaccccattggtgaaggaggggtccctgccctaaagtgtaggagatggctgaacacgacacctggcgtggatggatgagattgacagcagtgttttagtcacatatacccacagctcagaggaggacactgcatgccacacagggtcagatgggcaccgcactctgtagcggagtgagggctgtgggctgaggaagcaggcaggcttgatagtaacaagagcacacaatgaccaatggttcccgagggggaatgcagttggcttgtttgaataaattcatgggctggcagacaggtgaagtgaagcttcttaggctgaggtgcaactgtttggctgataaaagaactagccaggtggggagcctttcctgttgggtggcagggtagggggtgtctggtagaaacaggaaaacccacggctaggcctttggggccctgtgaggctcaaagatgtcaaggcagcataggaaattttagatcttaaaattcagcgaagaccctctccagctctggtaaattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttatagttacataattgcttatgtctgatgtttttattatttgctttttcgtttcctttttctttccctccatcttgatctatttctgtataatgttgttgctcgtatctctttgtatagtcttaaagtgtttgctctggatgttacaatatgtgtattgtaatacagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctggtctttcctttgtccctcctcctatagtcccatattcatcccttctgcataagaactttctgtagccatttttttgttttgatttttttgttttaattttttgtattgtggaaatgacagaacatatttctgtagccactttttagcatttctaaattgaccagtgacaaattcctatattctcttcctctgagaatgtctttatttctctcttcatttctgaagggtagtttcatgggatatagaatttgcagcgaacagtttttttgtttggttggtttttttgtttggttgttttttttttaaacacttgaaaatgttgtgccacttccttctggcctccatggcatttgagttggcgtgtccctacaggcattctgccatttttggtctttgtttttagttttgaaagtttaattggtgttgctttcttttggtatactttgaggtttgctcagcttcttgaatctgtaagtttatatctttcaccaaatgtgggaagcctcaggaattagttatttgcatgctttcacagctctggtctcctatgggactcagataacataaatgcggggttatcgtcccacaggtccgtgcagctctgttcatttgttttcaggttattttctctctcttgtttagactgggtgaattctgttgatcaggtttcagcttctctgattctctcctctgtcgtctccacttttactcaatagggcccatccagttagtttttttaaaatttctgttactggattttatatttctgtaatttccatttgattcttcagtttctttgctgatgttttcagttctttgattgttgccataggatttgtagttgcttgttgaagcatttttatactgactgttataagtgatgagtcagatggttccaacatctgcctatgtaatttttttatttttgcaggcagtcctcctgtttaggtttagtctgtaggtcttggtctactttgtgggctgtgattccaatggcaatttaatttcagagccttcatggtgttattttggtctctttggcttatatgtatcactgggattctcccaccagtccctgttgttgcccacctgagggaacaggggagccgccctaggctgggccacctgctgcagctaggtgggtggggaatggtggttgtcttggtgtgtggagctggttttcttgttgtggggaagatctcctttgatctgcggggactgagtctgcctgggttgccttctattgctacgttgggagttgggaaactctgggcctgggtcaccttcctattggatgaggtccagggagacacctggccactatgcattccctagtcctagagtccctcagcagcctttttctgtccaccttttggaattctccattgatcctctcctgtctattatttctagagtttgggttacatttcttaggagggtataatgtgttatcttctctagaccagaaatccttagtggtggtttcgggttgtaactgtgctaaagggagaattggcgtatttgtgatgtcgggtctttcttttcaaatgaggacatatcattattcagtatataatatttacaacacctacttccttgggttgaagaatgtggttaaggcaaggaaagtacttaacacagtgcctggtgtggagagcacttacgagtgttggtagtgatgctattccttttgtcctttggtagcctattaaagcttttcttcttttttaaaaaaataaagttccggtgcacttcttgttaggtttattcctattttatccttttttgcttttattgcaaataggagcttcctatcttttataacgtctacctggttctttggcccttacgtgaaaatgttttaatagccttctaaacattgttctctcaaatgagttttaatttgcctctttcttttgttttcctttttttgagacagggtctcactctgtcacccaggctggagttcagtgacgcaattatggctcactgcaacctctgcctcctgggcccccaaagtgctgggtttacaggtgtgggccactgcacccagccttacttgtctgtttcttttaagagtgggaactataattgagcccagagctccaaaaacaaatgaagaaatgaatgagtgaataagctcttcccatgggtttggtgtggtttgggactctactcttaatctaaatgctatgttttatataatctaaaatttcccctaggtgtgttacacgattgtgttgtgttgaacttacattgagactccttttcacatgtgctggttatcagcgtgggacttttccattcactctttgaattattcgtttgggggacacagatagacctctgtgtctttcataaagagtgtccattggccggttgcagtgtctcatgcctgtaatcccagcactttgggaggctgaggagggcagatcacgaggtcaggagttcgagaccagcctggccaatatggtgaaatcccatctctactaaaaatacaaaaattagccaggcctggtggcgggtgcctataatcccagctgctcgggagactgaggcagtagaattgcttgaacctgggaggcagaggttgcagtgagctgagatcgtgccactgcactccagcttgagtgacagagtgagactccgtctccaaaaaaaaaaaaaacaaaaacaaaagagtgtccattatctatactagaaaaattgagattgggattttgacatgaagtgcggaaatgtggattgggtccatttagtttacctaaacagatgatgaaatactaactgttttacgaagcattccctagtgcaaagttttgcctgtgtttctagtgatgggaacagtgagaatcagacttggaacacggagcgcattgtgggcctgtcgtgggtggggccagcagcacatgcatgccgggctgacagagcagcctttgggtgttcttttcccagaggagctctacggtgactttgaagacttggaaacaggggacgtgcacaagggaaaatcgggccccgatactcaggtatgactttgtcgtagctggctgttcttggtcattgtgttctgagagaggcccgcattgagaaatgcaaatcttacttgtgatgtgtgaagattgcagactggatggatagattccttcctaaagtgtggggatgtggggaccaaagagaagctttcttatttacttgttaagttttggactacagttactaccgtttcttgccatagtcatttgccaagtccactgtgatttttcactcacagaagtcttagcttctcagacttacattcaaccattgccatcattctcctctttttaaatttaagtgtcatttaaaagaatgaaatccctgttctccctaatatttctttagaacagggtctgggagcatctgggtgagggacatgtctgttatttttattctagtttgtgttcccagccagcttaaggaatagcagctagttgtaatgcagatgtaacaatttcctgtagcagtaccatgttattcagagacaaaggttatgttgtgttttgttttgttttattgataatgataacagatttttgctaagatttttgtttaaatagaactttaaaaaatctaatgtttaaagaaaagaccttcataaacatacacaaaattttttcttctggaaatttaagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtgagaaacctcagttcctctcagccccttgtcaagactatcacatagtgtaggaatccctgactttctttgggtccctgcttcctatcctgcttctgtgcctttcacttggactcctgggtagatgcatgtgagtgtgtttattcatgcagtgagctcattgtttctacagtcagaaggtcaccagaaaaagatccatacctattttgtaacaagaattaggaaaccgaaatgactgagacatggtctctacttttgagacttttacaatgtagcgatctgagatagtgtgttcatttcagtgcaagccaatgctgcctattccgatcgctgctccctgatttgaatggcaggtgatcagtggcccgtgtggcttatggacacaccagagctcccaggggaagtgctctgaaaacatcctggtcagagttcagaaggacatgtggagtataaggtcagatgcggagataagggagatggtgtggccctcctgcccaggggtgctgagcaggttgctggaggcggtgatctcactctgaaggagacagacacagaaacgtatgtacagttgatggtgagcatctgagttgcgtcttgttagtgaggccaggagtgcctgtgtaagctggaacagattaggtatatgatttgtgaaacggagtttcatcctacgtcttcatctagtcaaaggactgtttcctgattaggcattagcttagtggttgctagtctgtgttgacctttgaaaggcatgactaggctaactctgaagttgttgcttcacaccatttacaatttaaaattacctagagccttgtgggccattggaaaagactgaatgtttcactctgaaatgggagtccttggagggttttgaccagagaagagacattcaggtaatcagatcactctgccaagagatcagtccagtggcacaaaccagagggctggcagtggagatgagacagagtcaaacccggattgagtttatttggaagctgggtcagtaggatttcctggtggactgaatgtggggtgtgtaagaggaaatgagggtggcgactggaagttcctggaagggtgggttgttgcaggttagataggaaaccgtctgcagatgcagttttgggaagatgatgtttggttcggctgggtatcatgcagacaagcggagtgtcaagtctggagagacaggtctggccagggacttagatgtacagccctcagcatgtagatgccacttaactctgtgaggtggccggggagtgagtgcagagtgactgggaggagcaagactggcatgggcgagatggggcgattgcggccgtgaggcctgagcagtgcctaggagggagagggagaagcagtgtgagcatgcaggcacgcaggagtccagttgtacacggaggcgaagcactgttcagatcccgctgcagtgttaactacggtaaaggcagagttgaccactggaggagtccttcagcgtggaggccttcagcgatcttggcaagcaccaattttcgtggatgtaggagaatgggagcagaggaactggaggctgcaactgcggaaaacttttgtggggttttgctgcagagagaagcagagaaatgaagcagttgttggtggaagaaatggaatcaaaaggttttgagatagagaacagagggaagagctgttggaataaagtccaggaagagtggatggtgtctagtgagcaagtgatgtgtggccctgagtagaggcacgtacaaatcacctgtgcctgagctgcccttagaactttctgtgatcatggagatgcacgtctgtgcttcccaatattgtaacattggccgcaggttgatatggaccacttccagtgtgactagtgtgattgaggaactgcattttaaatattatgtaattgtaattaattttaatttaaatagccacacgtagctcctctataggccaggtcagagctctgataaggctggatatgggaggaaaccctggtagagggttgactgtagaggttcttttggttttggagtgaatcaggaaacagccatcagctgagtgaaggtgagggtggtggtgggtgtttgaagacaagggaaaagtgtgaaagaattgtttggagaggaaggaaagaagatgtggactggggatgtttccaatgttcgagcacgcagggctccacagttatctacatttgctgtcccttggagcaggagagaagaaaacggttgggacatattctgagcagactgtagaggtaaaatacgtagtttttttttgttttttgagatggaatctcgctctattgcccaggctggagtgcagtggcacgatcttgactcactgcaacctccatctcccaggttcaagcgattctctcacctctgcctcctgagtagttgggactacaggcacgcaccaccacacccagctgattttggtatttttagtagagccagggtttcaccatgttggcgaggctggtttcaaactcctgacctcatgtgatctgcccgccttggcctcccaaagtgctgggattacaggcatgagccactgtacctggccaaatatgtagtatttttaataggataaagcctacataattctgtccacagttcctttacttagaaattgctcatttgttcatgttaatgctatgtttattacagataacagcatacaggttttccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcaggtgggtccctttgctgcatatttggtgcctgaggctctgtggatttcccctccatcaatcatcttaccctctcatccccctcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagccttttttttttctttcttttttttttttttttttgagacagagttgcactctgtcgtccaggctggagtgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagggttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtgtgtttttatcttgctgtacctgtagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcggtgagtgtcttaagtagtgttcagggcagggtgttaccattcatgcttgacttctagccagtgtgacgagaggctggagtcaggtctccggagagttgagcagctccagccttagatctcccagtcttatgcggtatgcccattcgccttgtgtctgcagccccctggccacacccagtaacagttctgtgatctatgagaatagttcccttagcgacctttcccttcaaatactttgcagccaggtagagaagtttggagtgaaggttttgttctttgtttcttcgcaatatggatatgaatcttcttttgaaaatattaaagtaaattacctcttttcagatattgtcttcatgcaaacttggtatcctgtttccatcccagccttctgtaacccagtaacatctttgttgaaaccagtgggtgagaaagacacctggtcaggaacgcggaccacgggccaactcaggcttgcccatggtgtcagactaaaggcaaacaaggactctctgtataaggtactggtcgtgtgtgtgttagtggagatgaagcctgtgctctacagacagggagtcacacagacacttttctataatttcttacgtactttgaatgttcaagtataaagtctaacattaaatttgattgaacaattgtatgtttgtgggatattttggagtggaacaccaaaaaatggtaatagtggttctttctggattgaagacaaacttttcttttttaaaataaattttattttatatatttgaggttgacaacatgatcttaaaggatacatatagatagtaaactggttactatagtgaagcagattaacatagctaccatctcacatagttagatttttgtttgtgtgacaggaacagctaaaatctacttatttaacaaaaatcccaaagacaatatatttttattaactatagccctcatgatgtacactagatctctaacttgttcatcctacatgtctgctactttgtattattttaatgtacatctccccatttcctattggtcatttcctatttggcccatttttcaactgggttgtttttctgctattaagttgtaagagttctttactgatttttggatattaacactttatcacatatgtggtttgcaaatatttcttccagtctgttggttcccctttcattttgttggttgttcctttgctgtgcagaggctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccaattttattcttttgcatgcgaaaatcctattattgaagagactatcttttttaccattgtgttgtcttgtttgcccttgtcaaaaattagttgacagtatatgtttggatttatttcaaaggtctctgttctgttccattggtctatttttttgtttttatgccagcaccatactgttttgattactatagctttgtaatacaattttaaatcaagaggtgtgatgcctccaactttttctttcacagtaatccgttggctgtttgggattttttgtggttccataagagtttcaggattgttttttcttttcttttttttttttttgaggcgaagtctcactctgtcgcccaagctggagtgcagtggcataatctcggctcacggaaacctctgcctcctggattcaagcaattcttctgcctcagcctcccaggtagctgggactacaggcacatgccactatgcccggccaatttttgtagttttagtagagacagggtttcactctgttggccgggctggtctccaactcctgacctcgtgatccacccgctgcggtctcccaaagtgctggaattacaggcgtgagccactgtgcctggccaggattgttttattcggttctgtgaagaatgccatcagaactttgatgaggattgtgttaaatctgtatatttgctttgggtagcatgaacattttaacaatattaattctcctgatccataaacacgggatgtcttttcattcgttcatgtctaaatttctttcatcaatgttttatggttttcaagtgtacacatctctcaccttcttggttaaatttattcctaagtttttgtttttctttgatgctatcgtaaatgagattattttcttgattgcttcgtcagctacgttatttgtatatagaaatgcaactgatttttatatgttgagtttataccttgcagcttaactgaattgatttagtagttctcacagttttttgtggaatctttggagtttttttacgtaaaggatcttgtcatctgcaaatagagataattttacttatttaatttagttgcctttttttcctcatctgattgctcttgcaagtattctattgaataaaagtgatgaggctggccatccctatcttgtactcaatcttagtggaaaagctttagttgttccccactaactatgattagactgtgggtttttcataaatggtctttattgtgttgaggaactttccttctatacataaactattaagagttttatcaagaaacgttgctgaactttgttaaatgcttttactgcatcaattgaggtgaccatatcgttttatctttcattttgttaatgtgatatatcacattgattgatttacatattttaaatcagccttgcatgccagggataaatcccacttaaacacgatgtataatgtttttgatatgttgttgaattctatttgctaaaatttttttaggatgtttgcatcagtgtttaatttattggagaagttgacctgtagtttttgtttgtttggtgtgtgtgtgtgtgtgtgtgtgtgtgtgtgtgtgttttggtttggcttaggtattaaggtgatactggcctggtaaaatgtgtttggaattatttcctctcgctctgttttttcgaagagtttaagaagtaaactcccaggggatgggagtgactctggacatgggagtgacatgatagtgactctggaccctgcagtggtgggacacagcagcatctctgtctctgtgaggccaggcgcagcatcagcaaggaccccagaatggtggagcactactgtggcttgggccctcgggggcagggaccagtgcagcaactacttctctccctggggaggcaggtgcctgggcaactcagattctccagagctagtccagttccaaggaagcagggttctacagttgtttgtcctgaagggcaaggtaccccagttcagccaatgccgttttcctgggatatgggggtgccatgttggctcatccctggcaggtgtggctgctcagctcagccaagacactgattccctgtgaagcagggcagcgcttcagctctcatgcagtggggggtgtgactgctcagactggccaaggcactgattccctggaaagcagggcaccaagtcagctcaggctccaaggggcagggcgcaatggcagctgggaggggaggggcacagcagcatggccctgcaggtggggtgtatgctgtgatgtggacatcatttgttcccaccagccatttgaaatttcatccatttgaaatttgattccaaatgtggtggtgtgggaggtggggcctagtgggaggtatttgggtcacagggcagatcctttatgaatagattaatgccttttcatgggactggattagttaccaggagtggattgttatcagagtgagttcagcttcctagactctcgtgtttcctctcttgccatgtgagccccttgcatacacctgtttccccttccactttccctatgagatgaagcagcacaagaccctcgccagttgtgctgcccaatctcggacttttcagacacaagcagggtgagccaaataaaccttttttataaaataagttaccccgagtctcaagtattctgttacagccacactaaatggcctaagacagtgtaacagcggctcgggggtggtgggccactaggtgggtgtgatatagagcaacaaagcctgaggatggaagaagggtgcggtggcagctcaccctgggtgggacatgctcccgaagtggtccaggtccaggagggcacgttgcagcagcagctggtccatgggggtggggcacaatgtcagttccttctctgaggggagtgctggggctactgggcccctcttgcttccttatccctgcagggagacatcccctctgcttcaggctgatccctctgggggaatgggtggtgggggccagatgtttccttccctcctttatgtgaccgtcctggttttctgtgctctgctggatttctgctactccttgatgcactctggggctctcttttagtgactttcatcaaaatatagatgtttgctgctttggctgtctttgtcaggggatgagtgcaaggggctattgatcagccccttgctggcatcactccctcttaaacttttcactgggtactcttttgaactattttttcccccaccgtatacatgtattttttaaacgttaatgtgctaatttctactgaagcaatgtggatttttctgaaagttttaatgttttaataagctttttattgaaatgttaatgtccacacagaagagtgcccgaatcataagtgtgcatctagatgaactgtagcacaccaggctgccacgccctggaccaagcagtagcctcgccctgtggcctctcccaggcactgctgccccaacccacagaatagctactttcccagttcctgatgtagatttgttctgcctggttttgacttctataaaatacagcacattctgtttagcctggcttctttggttcagtattacagaacacatccatgttcttgtctatggcagacattgatttatcgtcattgttgagttccattatatgactgtgtcaccatttttccattgatgagtaaaatgatttcctatttttggctgttatcccacggccctgaacactaggtctggatatgggacttgcaggtatgcaggggcacacgcacttctgctggaggatccctgggtggggtggagactccagggcacctgtgctctgcttcagtatggagtagttggagtgtattgcttagaacaaaagagatgagacactaacactgtgtgtatattctaaatcatatatcagtgaagaaatgtgatgtttgcaacatcttctctggggatgctaaccccctaagtcattattaccatgcatgtaagcacctcacctagatctgcactccatctagcagtgagaaattccaccataatctacacaccataatatcatcaatgtgtctagaagtcagatcctctatgtgtgaaccaagacaatgcctggcaaacaagacagctgggctctcaggtctctgcaccatggggaggtgtgtaaggccattcttgaattactataaagaaatctctgagactggatgatttacaaagaaatttacaaagaaatgttgaattgactcacagttctgtgggctgtacaggaagcttggtgctggcatctgctccttttctgggatgcctcaaggagtttttactcacggcagaagatgaagtaggagcaggcatctcacatggcagaacaggagcaggatagagagtgggtaggaaaggtgtcacaaatttgaacaaccaaatcccatgaaaactcactatcataaggtgaaaaccaacccaagaaggatactctctcatgacccaagtacctcccacaaggtcccacttccaaccttgtgaattacatttcaacatgagatttagtttagcatccaaactataccattattcccctggtctctaaagtctcatgttcttctcacatggcaaaatacaataatgtcttcctaacaatccccaaaactcttaactcattccagcatcaactcagtcgaagtccacagttcagagtctcatttgagttaaggcaagtccctttcacctataggccagtaaaataaaaaacaagttatttacttccaaaatacactggtagtacagacattgggtaaatattcccattccaagagagaaaaaactgccataaaaaaagggctacagatgtcatggaagtttgaaaccccgcagggcattcattaaatgttaaagctccaaaataatctttttttgactccgtctcccacatccagggcacactgatgtaaagggcaagctaccaaggctgagggcagttctacccatttggctacgcagggttcggcccctgtggctactctcataggctgttaagtgcctgcagcttttccaggtgtaggatacaatctgccagtagatctaccattctggaatacagaggacagtgacctccttcccacacctccactaggcagtgccccagtggggactcggtctggggcctccaaccccacatttcccctccacactgacctagtagaggttctgtgggagggttctgcccccacaacaggcttctgccttagcacccaggcttttccatacatcctctgaaatctaggtggaggttgttgaggctccagcactcttgcattctgtactcctgcaggtttaacaccacatggaagcttccaaggcttaacatggcttttgctccccaaaactgtggcatagcattatctggagcctcttgagccaaggctggagctgaatcagccatgaggttgcacaggactgtggggccctaggccagacccagcaagccattcagttcacctaggcctcaggacctgtaatgtgagaggctgcctcagagatatctgaaatgcctttgaggtctttttcccattgtcttggctatcaacacttggctcctctttagttacgcaaatacctctagcaagtgattgtttcgcagcccacttggattcttttcaggaagaggggatgttattttctgccacatagtcaagctgaaaatttttcaatcttctatgctctgctttccttttaaatataaattccaaattaaagtcatttctttgatctcacatctgagtataggctgtagacacagccaggccacctcttgaactctttctgcctagaaatttcttctgccagatactctaaatgattgttctgaagttccaacttccacagattcctagaacatgaatagaattcagccaaactctttcctaaggcataacatgggagatacttgccccagttcccaataagttactcactttccgtctgagatgttgacagcctatgcttcattgttcctaacaccatcagcattttgatcacaaccatttaaccagtctctataaagtctgaagcattttctaatcttcctgttgtgaacccccaaaattggacacaagtctcagttaactcagaaagcttattttgccaaggttgaggaggcacatctgtgacacagcctcaggagatcctgatgacatgtgtccaagatggtaggggtacagcttggttttatgcattttaggcagacatgagacatcaatcaacatgtgtaagatgtacatcagttcagtctggaaaggtggaacagctccaggtgaaggcaggacaacttgaagtggggaaggggcttccagtcttagatagataagagacacatggttgcattcttttgagcttctgatgagcctctccaaaaggaggcaatcagatatgtgtttctctcagtgagcagaggggagactttcaatagactgggaggcaggtttgctctaagcagttcccaggttgagtggggtcccaagatttgttttcctttcacactgtcttctcctgagccccccaaacccttccaacctctggccatgactgagttccacagctgcttttgtactatcaggtatcttttagccatactttatttaccaattatctgtgttaggacattgttgcattgctacaaagaaatttgttgggaaatttacaaacaaaagaggttgaattggcttatggttctgcaggctgtacaagagtcatggtgcctccatttgcttggcttctgaggacacctcaaggggattttacttggtggaacatgaagtgggagcagacatctctcatggcagggtgggagcaagaaagagagtaaggcaggaggttccacacatctaaacaatcagatcttgcaagaactcactcactgtcatgaggacagcaccaagcctcgcggaatccgcttcaatgacccaaccacctcccaccaggtgccacatgcaacattggggattacgtttcaacaggagattgagagaggacacacatccacactatatcaggaggtgtgtgccttgcaaccatcaggggatgctgcaggactgccctatggtccctacacagctgcttagtaagaaccattcactccaaggaacctgtgccctgtgctcaatgatggggactcaggagctgtgtcctctctggcctggcagagtcccctaagcagagacctgtgtatggtctcggcaggtgcttcctcccagggccctcccgagggggaaaccaaaccttcctcctcctcagtctggagtgtgagctaagcttcagctccagggctcagggaggggctgggcagtccttggatggaaacatatttgcatgagcagcccctcctctggcagaggatggagaagaagaggagacctggggcagctcaggcccactgttagggctcaggggctgtgtccaccatggcctggactcttctccttctcgtgctcctctctcactgcacaggtagggaaagtccttataaactgagtctcagtgtccaacctacaccatcccctgtggctcagacctacaagaagctttaccctgggaactgccttatcacccatgatgtctgtgttttcaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaagtaagacaaaaccctcccctctactctcctggtctagtgaaatcacccctgctggtggctctgaccaaatctagctcagggggtgacatctgttgtctcatcgacagcactggagctcccacggagaagtaggtctaacaaagtcctaccttgctcgcatttcacaggcagacatcccttgctcaggggtaaaatctctcagtgttgacattgaagaaggcaagagggctgggttggggttcatctcagctcagagtctagaagtgactcagagatgctgctggtctgagagttttaatatgagccttgggatacaatacagggatgcagatgggaattgtattctctatgtcagtaacgaaccatcagtaattgaaaagtcaatacattgagaatagcataaagcatgaaatactttaggataagtatgacaaaaattgttgttttacacactagaagtcctaaaacattgtttagacgcaggtcttaaagaagacctgagtaaatgcacagataatccttttttttttttttttttttttgaggcagagtttcactcttgttgcccaggctggagtgcaatggcatgatcttggatctcggctcaccacaacctccacctcctgggttcaagcgattctcctgcctcagcctcccgagtagctgggattacaggcatgtgccaccacgcctggctaatttttgtatttttagtagagatggggtttctccatgttggtcaggctggtctcgaacacctgatctccggtgatctgcccgcctcggcctcctgaagtgctgggattactggcgtgagccaatgcgcccagcccagataacccttttttttttttttttttttgagcaggagtctcgctctgtcgcccaggatgcagtgcagtggcgcgatcttggctcactgcaacctctgcctcccggttgaagtgattctcctgcctcagcctccctagtagctgggactacaggcatgtgacaccatgcccggctaatttttttttttccttgtggcaacggggtttcaccgtgtttggtcttgatctcttgaccttgtgatccgcccaccttggcctctcaaactgctgggattacaggcatgagccaccgtgcctggccccagataaccctttttatgtgagagtgtagagaatgttgctgcagctggtgtgggatgggggatggctgggttgagactgtgttgtcacctgcagtgtacacctgaggtgacatggttctgaacatcactttccccattgaaggcccgagtgacctatcacttgcttctcaaaattcaggaactaggtgactctaggagagtgcacaggaagctttctgcatattctttcaagagatttcgaggtcactgactcttttttcaagacttaaacacaaaatccacatccatcattcttgcgtaaagagaccattcttttttttttgagatggagtctcgctctgttgcccaagctggagtgcagtggcatgatctcggctcactgcaagctctgtcttctgggttcatgcccttctcctgcctcagcctcccaagtagctgggactacaggcacccgccgccatgcccggctaattttttgtattttttagtggagatggggtttcaacatgttggccagaatggtcttgatctcttgacctcgtgatccacccgccttggcctcccaaagtgctgggattacaggtgtgagccactgcacccggcccaagatggggtttcatcatgttgacctggctggtctcaaactcccaacctcaagtgatccactcacttcagcctcccaaagtgctgggatgacaggcgtgagccacagtgcccggcctagtacattgtttaaatggtgcatgtaaaacctcatggtactacaactgcctggtgacagactcaccagagtaaataactatcctgctgttctccaaccacatgggattccccaaacaaagatttgttgagtccaagatgcatcatgccagaactcttgcagtcatacacataatttgtttcattttaataaatacggttatcttttttcttcagtttattgtttttaatgtatcatcttctaggtttcattacacatcaaagatgaataatttctctcatctttaggacatgctgaaaacactcattagtgattttgaacagtattatttcctaaacatcctagttggaatggttgatcctaaaagctaccatgtgtcaggctcacctgagtgcagactgtggtctaaacaagctaaagttttaattcttccatcttcaaatacggagcatatttgcttgttttgctctttagcaaaacactgcaaagtcattcgccaggatctcctgcagactggcattcagtgatggagaacagactcctaggtgagatccctggtcacaggatccagatgactatgactgcaagtctggaaaagaagagacagaacaaagatttaccagcataaccctctgagaatgtgccccagccatcctggagggaagagctccctattgacccagcactgcagaatccacagaggaaggacagctctggccaccagggagcagccacacgacaagagaggacccggtgtccccacaggtgaggaaatgagtccatggggctggtcagtgctctcgatttcattctgccataacaggactttgtgtagtcaccacctgagtcctatacagtgaacagccaaggagacatggacagattcacccctgaggaacccagtagaatgtgaagtctgccctgaggtcacgaagaaaagactcggggggctgcctggcctggccctgatggagggggccatggacagaacaacggggaggcaggggtgtctctgagaggctctggtcaccttgtcatacaatggtggtgtacaatgtcgcaccatggacactagggggcgcctgcgcaccattcctgagaagactgggtgtgatgagagcaggaccagcgccacctgtcctgcttggtgccctatgcttagggctcacagatgtcaactctccaccccctgggaccacacagccccacccctggcactctctgacatcctcaggcagaggagcttgacccagggcccagggtgggatcagaaagctggagggtctgatttgcatggatggaccctccttctctcagagtataaagaggggcagggagagacttggggaagctctgcttcagctgtgagcgcagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggcacagtgctccagcccaatggggaactgagacaagaacccccttcttcctcccccaggagggtgagtgccgccagctgctgctcacgcctgacctgtagcttctgctgctgcaggttctcccatgggccacggggcagccagggccctgcctaggagtggaggctccaccacttttgtcctcagagtcaggaacagggactccaggaatgagaatatcctgctcctgcagcttgggacacagggtctctgcactgacatcctgggctgaggtggcaggtccagctgtgtcttcacagtccttcctgtgcctgcccatggtgtggggagggagggagtggggaagggggtgtgggcctttgagcttcactagagacctgagggagcagaggtgctccccaagacctggactccttccctcaccctcctcccatcactctcctcactgtagctatggccaggtgagggctcagggctacttgaggaccttgctcagcccagggcctccatcccaggcattgtttccaaactctgtaagggctgtctctgaatctgtagaaacagttatttctatgtgcccaggactgggttagagggcaccaaccccaccccttgcaaactgctcctcacctcttagcgccccagtgaggagaagaaagagttagaaatcaggaatctactcagggctcccctctctcccctttcccagcctcccctggctttctctttctacagaaacaccaaggaggcagccaccaaggacgaggggaggcccaggcattataccaggcagcggagccagccagtccccccagatggtggagggaggtggtggaggtgtctgggaccagaaaatagtgaggaccctcttactgaagtgaggacgggtggcataaactgaggcccagatggtggaccagatctcctgagccatctactcatttcttcgtgtgttccagtttgggtaagaataggctaaaaaaaaaaaaaaaaggctttgaagaggttcctttcctcagataagaattcgtagaggattattgcccactcaggcattgaggggaggctgagcctcactctcaggccaatagaactgggggctttcaagggaatttgattgtactgagctcccagactctgacatctaagatttttgccctcgtagccgaacccagcactgataccaaaatggatgaaggctgatagataagcctagaatattctagctggcaccatctcgtggaaaagagaatcaagttagaatattgatgtgataaggtggcatcgcacagtgaggggaggagagcttgcatgggggagggtagaggagccactagagggctggacaaggaggagacagtctgaggtaagtttgtgaggaaaactccagatgcttcagagaagatggacaaggaggtaggcagtgtgaaggccatgggaccagctctagtcaccgggagagagtggtcagattcagcaccagtgtctggggaggaggtactgaagcctgggtgaggggagaggctcaaggctggccttaggacctgagtggggcacagtgatcacactgctggggggtccttcaagtgcaagggggctgcaggaaggcttgagctcattgtcacaatgaaaacttagacaacagctccccagccttgttcaaaggtgtcacaggactttttcctctccacatggcaacgtggagaagaaaacttatctctgagatatataagatgttagttctccataacctctcttgtcccctggctgaattcctatttggaaacaaaatgactctccagttttatatatgacatcctcacaaaaaaaaagttccagaatgagaaagatctgccctccctgacccactggtgaggaatctcagccttcaggacaaccagactaaatcattcatgccatctcccatgacagcatcatgtggaccagggagcctaccttatgggtttgggccacacactgcctgtccctagcattgcagctggggacacttacatgctgaactcatggctgggagatctgaggtccagacatgacaggaaaaggaaaaagaccaggagctctgcctaagtagcccccctgtgtgaatcactctaccctccaccctcatcttcagttcgtgatgggtattgtcttgtgaaaactgaaagctgggctgggacacaggcaagagagtctctgactcacaaatctccatcgtgggctctctggcctttctgatattcttttcacacatcaattctgggccaagacacatccatgctcatcaagaaggcattgataggagaatcaggtagcctccagagagacaggaagcagataaacaccctcatgttggcctcctaagcccagaggagaaaaaaaaaagttggaggggaagaagttcaagaagccacactagaagccactgattaccatcacctcggcacctgtcctccatctgcccctctttcaagtgaggaccagactcaggggacagcacctgcacctccccctctgtccatgcactgtgtagggagcctccttctgctctcatctcaaggtggctgctccgccaggtcagccgtatcactgctgagagtcttccctgggtcctggtcacagggtctgggatcagcagcaacctggctttgattcagctctgaccctgccccttcaggacacaaagcccattattaaagggataactgaactctcctagttcactcaaccttagattttccttctcagtgtccttctagaaagtgccgcctctactaaatgatttcatgttatttcctcaggtctagagctatttgatttccaaaattctatactcttctgttctcattcccggtcatggctcattttccctcagcagctaatgatgctaatcatgtatctaccccccattgtcacaaaaaagagagatggaagagttccttagataaatacagggttagcaaagaaaagtttcattatctcttaagaattactccaagatctggccaggcgtggtggctcatgcctgtaatcctagcactttgggagtccaaggtagacaggtcacgagatcaggagatcgagaccatcctggctaacatggtgaaaacccatctctactaaaaatacaaaaaattagccaggcatggtggtgggcacttgtagtcccagctactgaggaggctgaggcaggagaacagcgtgaacccgggaagtggagcttgcagggagccgagatcatgtctctgcactccagcctgggcaacagagcgagactccgtctcaaaaaaaaaaaaataaagaattactccaagatctaagaaaattaattccagttcttcaagagtttactcctcagaaacaacagcatgaatacattaggtagtgaatgttcttggtcttctcaatgaataacgtctgaaaggttcagagtatatgtttcaaaaaggtaagtgcataactttcaaaaaaatgtagtattaacatgtcaacaattttaattggtatatatatttctgaaaaaaaagcagtatgatggtaaaagaaatgtaaaaaagcctttgtaaaacccagtgcttacagtccaccaggatagcacctgtgaagcaaatttcctttgctgaagatacaccgccttttagaataatagcaagatagtttgaatttgtcttcttctctcacagcaatctaaaaattaacttaatcccatttatatgacatatctagaaatattcctgtacatgtggacattcccatcgcacacctcccatccaggctgtcctaaagtggcatctcctcttcttctgctcatgttctccccctctcctcacctctcctgctgacacgtggctcctccctgccttcctctccagtagccccagcagatcaggcccaaccagtgaacaagctcctggacttcttggatttctgaggacttgccctgccagggtgtctttctcaatcacaatctctccttcccgggagtccaattctcctagatcctgttatttatctaatgttatacatctgtatctacttggtggacttccctacatcttcacccgaaccccaggaatcttcaggtcatgcccatatgaccttagttctcctggagtcccttcttccttcttcccctgtgatcccaccaagtggagatctcttctcagaccctggagtgcagcagggacttctctggtctctgccccagggattaagggggtggaattgaggactcctgtgcccttcctatgcctgtgttttcatcagggtcagctgcacaaggtagggattcccactctcagagtatgaagaggggcagggagagatttggggaagctctgcttcagctgtgggcacaggaggcagcactcaggacaatctccagcatggcctggtcttctctcctcctcactctcctcgctcactgcacaggtgactggatgcagatcgaggggagggtccctgggaagcctatggattcttgctttctcctcttgtctctagaagcagaatcatgatgcctgtgtctctcccacttccagggtcctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgctcacacagtgctccaggcccagggggaggtgagagaagaacccccttcctcctctaccaggagggtgagcgctcagctgctactgctcaggcgtggcctgtggcttctgctgctgcagcttcccccatggtccaggggcatccagggccctgcctcagagtagaggcttctctttttttctgttctgagaatcatgcacagcagctccttcctaggaacagggcctccagggaccagaacatccatctctttgtaccttgggacacagggtctctgcagtgaagtcctgggctgaggtgtcaggtccaactgtcatcacaaacctgatgcagaacctgtgtctccatcaacctcatttcctgatttctggaagttccgactgttggctttctgtccctgctcctcagggtgaatcgcttggcttctttcctccccagcctactctttttaataaaaccctttccaaggaggaataatgtccatacgagaaaacacctatatttataatataccatgacacccattttggcatgtttctggatccttgaaagcatcaccaccaccgagctatgcaagctgtgaccaaccccagcagctcctcatgaccctttgtcatctccctttctaccccaatgccctcccgggaagccacagatcctcctctgtcattagtgtttggtttccattttctggaaggtatcagtgttcacaaacattctcttgccatttgttgaggcttctttcactccgcacactttttgagattctccctgttgttgctgaatgacatctcatcccataaagggctcatcagtacctttgagggcccctagccattttgcctttcatgcccattcctgcatttgtatatacacatatagaatccagggtagcctatattccttttaatctgaattttaaaaaatcaatacattttctggggcccctaacagcgtcgagtcctgtaggcatttgatcttctctctccagtgatgctcagccctacttgcatctcatgcgattatactcacttctcgccattattcaacaattttgttttattctcttggttttaaataggcaatacacaaacaagatgccacatgagaactatggaaaccacttccccctcctacatcctgtctcctggcctgttggtttctctcagctgaagtgaccaggaatgcttacatttatgttccctcccagccaggatctgtgtgtagaaacaagggggtctgtctgtgtctgtgtgggcaaccacattatgttttctttagtaccactacaaccttactattgacaaacaactttttaattcctgagactgtgacttcatgtaatcctgacagtagcccgattattgcttttgaggcagtggtcctgattggagaggaactgtttgtgacctggggatggcgttctctaatttatcaaatgtaaacactggaggtcagttaaatttgaattcggtaaaacaatgatgaagaatcaataggtaggctgggcgccgtggctcacaccttaaccctggcacttttggaagccaaggttgatggattgcttcaggccaggagttcgagacaagtctgacccacgtggtgaaaccccgtatctcctaaaaatacaaaaattagctgggcctcatgacatatacctgtaatcccagtgactcaggaggttgaggcatgagaatcacttgaacccaagaggcagaggttgcagtgagctgagaccgggccactaactccaggtggagtaacagagtgacactctgactcaaaaaaaaataccaaaaaaaaaaaaaaagagtcagtatgtgtatcccccagacaatattgtgtatttaaatataaacataactgggtgccctttaatttatctggcaactccacacagtgtcacaacctggaagaagcatagctggggcagtcatccccttactgatgctgggtctaggggcttaactacaaagacagagctttgctagcaaagatacactcaagtgagcacatcagtgagcatgaaatgcatgtgatataattcccaatgaatgatgcctcctcacttctctaattattctttctattatccttcaagtctgcagattcagggcctccccagggattgcttcagcctgagcgctagacaagtgatctcatgtcctgtcacacccagatgcatggggctactctgtccccacacagaggggcttcagcctggggtgcataagtaacatgtgagagagagaagagctcagcctggctctgcttatatctagtgagagaccaacttcgggttcatttgatgctggaggctggtgagctgagagcagaggagagaccaagccttagagtgcagggctttcaggagagaaattgggaacctggaaatgggccacactcttcagtgaggaagaagcaggcagctctaggcacagccctgcattcctagtggcttccccttcatcaagcttgactccctgctttgatgtctgtcagggaatctacttcagcaaggtgaagatcccagggctttactaaaaatagcagtagaccaggcaggtatgtcatggttcaagagttctgtgcacagaaataaatacagatgcatattcacaagggccctcacagttgtctcttttggagtggaagagatgaagaaaggcagggagaaattgaaagactcagtcggtctgggcctggggcagcactggatgctgtggacttatccctgaagggtctgcaggtgaccacagccaggaagccagcccctgctatgaccctgtgtcatctgctcactgctcactgagctcagcagctgtgtcctcacaggaaactgggtgcagccagcttggccttctccaccccacctggaaaatgtgggcaggtgactgtcagcattgagatcctatgaaggggctgggagacaagggaagagggctgatttgcatgaagcaatcattccacacccttatctttaaactatatcccattaatggaagctctggggccatccaaacctgatcaatctaagaggggttatcagctggaggtggtcagagtgaggaagaaactggcttccttgaaagactcatcaacacagccaccaactctgggacaaatggggtgactccctataactgtcacccgatattagccacaggagcctgagcctagtcccctcaccttattgcttctgattctggtccagtcccctgttgtccctggacccttgcctatgtctgagtccagggtggcaggggtagccccatctcagtcaacatctatagagaggtaagagctactacggcttcaagcagagtccacagttttacccatgagggcctcttttgctcccccaccctgtcacacaggtgactactgctgtgggtctggtggagtggcccctggcccctgaaggacacaaggtattccttcctctctaacaccaggcatatagtggagaaggtatgggtgggtatagaacagattggcttttctagatgcaaatcggtaagaccctggctacagaaaaattatttcacaaaaccccacaccctttcgtgacaaaaacactcagtgaattatgaatagaaggaaattacctcaacatagtaaaccctatgtatgaaactcccacagctaacatcacgtgcaatctgaaagactgaagatatttcctgtaacttcaggaacaaagcaaggatgcgcactttcaccacttctattccaaatagtattggaagacctagccagagcaattagccaagaaaaagaaataaacagaaaagaaattagaaatgaaaaagtaaaataatctctgttttcagatgacctaatcttatatgtagaaaatccataaaacttccaccaaaatagcaaactcttctcagctaagggaccatgttctaacccaatgaagggaagctaagaaccttgataaaaggttacaggaacagctaaatggaataatcagtttagagagaaacataaataacctgatggagctgaaaaacacagcagaagaacttcatgaagcatacacaagtatcaatagctgaaccaaaccagtggaagaaagtatatcagagactgaagatcaacttactgaaatgggtgtgaagacaagataaggcaaaaaagcaggaaaagaaatgaacaaagcctccaagaaatatgggactatgtgaaacgaccaaacttacaattgattggtgtacctgaaagtgacggggagaatggaaccacgttggaaaacacacttcaggatattatccaggagaaattccccaacctggcaagacaggccaacattcaaattcaggaaatacaaggaagatcactaagatactcctcgagaagagcaagccaaagacacataaccgtcagattcaccaaggttgaaatgaaggaaacaatgttaagtggatccagagagaaaggtcaggttacctacaaagggaagcccatcagactaacagcagatctctctgcggaaaccctacaagccagaagagagtgggagccaatattcaacttcttaaagaaaagaattttcagtccagaattttatatccagccaaactaagctacataagtgaaggagaaataaaattctttacagataagcaaatgctgaggtattttatcaccaccaggcctaccttacaagagctcctgaaggaagcactaaatatggaaaggaaaaactgctaccagccactgcaaaaacacaccaaaatataaagaccaatgatgctatgaagaaactgcatcaagtaatgtgcaaaataaccagttagcatcatgatgacaggataaaattcccacataataatattaattttaaatgtaaatgggccaaatgccccaattaaaagacacagactggcaaattgggtaaagagtcaagacccattggtgtggtatattcaggagacccatctcacatcaaaagacacacataggctcaaaataaaggaatggaggaatatttaccaagcaaatggaaagaaaaaaaaaagctggggtcgcaatcctagtctctgataaaacagactttaaacaaacaaggatcaaaaaagacaaagaaaggcattacataatggtaaagggatcaatgcaacaagaagaactaactatgctaaatatatatgcacccaatacaggagcacccagtttcataaaacaagttcttagagacctacaaagagacttaaactcccagatgataatactgggagactttgacactccactgtcaatattaaatcaatgagacagaaaatgaacaaggatatcccatccttagaaaaccccatcgtctcagccccaaaactccttaagctgatgagcaacttcagtaaagtctcaggatacaaaatcaatgtgaaaaattcacaagtatttctatgcatcagcaatagacaagcagaaagccaaatcatgagtgaactcccattcccaattgctacgaagaaaataaaatacctaggaatacaacttacaagggatgtgaaggacctcttcaaggagaactacaaaccattgctcaaggaaataagagagaacatgaactcagctctggaccaagtggacctatagatatctacagaaaactttaccccaaatcaatagaatatacattcttctcagtgccacataacatatattctaaaattgaccacataattggaagtaaaacatccttagcaaatgcgaaagaatggaaatcataacaaacagtctttcagactaccgagcaatcaaattagaactcaggatgaagaaacttactcaaaaccacacaactacacggaaattgaacaacctgctcctgaatgactactgggtaaataatgaaattaaggcagaaataaagaagttatttgaagccaatgagaacaaagagacaatgtaccagaatctctgggacacagctagaacagtgtgtagagggaaatttatagcactaaatgccacagcagaaagtgggaaagatctaaaattgacaccctaacatcacaattaaaggaagtttagaagcaagagcaaataaattcaaaagctagcagaagacaagaaataactaagatcggagcagagctgaaagagatagagacgtgaataacccttcaaaaaaatcaatgaatccaggagctggttttttgaaaagattaacaatctagatagaccactagctagactaataaataagaaagaagaatcaaatagatacaataaaaaagataaaggggatatcactactgatctcccagaaatgcgaactaccatcagagaatactacaaacacctctatgcaaataaactagaaaatctagaagaaaggatagattcctggacacatacaccctcccaagactaaatcaggaagaagctgaatccctgaatagaccaataacaagttctggtattgtggcagtaattaatagcctaccaaccaaaaaaagcccaggaccagacagattcacagctgaattataccagaggtacaaagaggagctgataccattccttctgaaaccattccaaagaatagaaaaagagagactcctctctaactcattttgtgaagctagcatcatcctgatatcaaaatctggcagagacacaacaaaaacagaaaattccgggccaatatctttgatgaacattgatgcgaaaatcctcaataaaatactggcaaactgaatccagcagcacatcaaaaaacttacccaccacaatcaagtcggcttcatcgctgggatgcaagtctggttcaacatacacaaatcaataaatgtaatccatcgcataaacagaactaaagacaaaaaccacatgattatctcaatagatgcagaaaagccctttgataaaattcaacatcccttcatgctaaaacctctcaataaactaagtgttgatggaacatatctcaaaataataagaggaatttatgaaaaacccatagccaacatcatactgaatgggcaaaagctggaagcattcactttgaaaaccaccacaagacaaggatgccctctctgaacacttctgttcaacatagcattggaagttctagccagggcaatcaggcaagagaaataaagcgtatttgaataggaagagaggaagtcaaattgtctctgtttgcagacgatatgactgtatagttagaaaacccaatcatctcagcccaaaaactccttaagctgataagcaactccagcaaagtcccaggatacaaaatcaatgtgcaaaaatcgcaagcattcctacacaccagaaatagacaagcagagagccaaatcatgagtgaaccctcattcacaattgctacaaagaaaataaaatgcctaggagtacaacttacagggacttgaaggacctcttcaaggagaactatacactactgctgaaggaaataagaaaggacacaaaggaatgaaaaaacattccattctcatggataggaagaatcaatatcgtgaaaatggccatattgcccaaagtaatctatagattcaatgctattcccatgaagacaccactgactttttctgcagaatagaaaaaagctactttaaatttcatatggaaccaagaaagaacctggataaccaagacaattctaaacaaaaagaacaaagctggaggcatcacaccacctgacttcaaattacactaccaggcaacagtaaccaaaacagcatggtactggtaccaaagcagataaatagatcaatggtacagagcagagacctgagaaataacaccacacatctacaaccatctgatctttgacaaacttgacaaaaacaagcaatggggaaaggattccctatttgataagtggtgctgggaaaactggtagccatagacagaaaacagaaactggaccgcttccttacaccgtatacaaaaattaactcaaaacggattaaagacttaaatgtaaaacccaaaaccataaaaaccctggaagaaaacctaggcaattccattcaggacacaggtgtgggcaaatactttatgatgaaaataccaaaagcgatggcaacaaaagctaaattgaaaatgggatctaatcaaactaaagaacttcggcagagtaaaagaaacaatcatcagagtaaacaggcaacctacagaatgggagaaaatttttgcaagctacccatttgacaaaggtctaatatttagaatctacaaggaacttaaacaaatttacaagaaataaacaaacaaccccatcaaaaaatggactaaggatatgaacaaacacttctcaaaagaagacatgtatgtggccaacaaacatatgaaaaacagcgcatcatcactggtcattagagaaatgcaaatcaaaaccacagtgaggtaccatctcacaccagttagaatggcaattattaaacagtcgggaaacaacagatgttggtgaggctgcggagaaattggaatgcttttacactgtcagtgggaatgtaaattagttcaaccattgtggaagacagtgtggcaattcctcaaggatctagaaccagaaataccatttgagaccagtaatcccattcctgggtatatacccaaaggattataaatcattctaccataaagacacatggacacatatgtttattgcagcactctatgcagtagcaacgacttggaaccaatccaaatggccatcaatgacagactgaatatagaaaatgtggcatatatacactgtggaatactatgcagccataaaaaagaatgagttcatgttctttgcagggacatagatgaagctggaagccatcattctcagcaaagtaacactgaaacagaaaatcaaacactgcatgttcatactcataagtgggagttgaagaatgagaacacgtggacacagggagggaaacatcgtataccagggcctgtccgggggggctgggggtcaaggggagggagagcattaggatgaatacctcatgcataccgggattaaaacctagatgacaggttgataggtgtagtaaaccaccatgtcacatatatacctctgtaacaaacctgcgggttctgcacacatgtatcccagaacttaaagtaaaataaacaaacaaataaataaataaataaataaataaataaaataagtcccaccaaaacaaaaactgttagaactattaaatacatttggtaatatttcagaatacaaaatcaacacataaaaccatctaatggacagccatgatggctcatacctgtaatcccagctcttggggaagctgaggtgaaaggattggttaggatcaagagagttcaataccagcgtgggaaatgaagtgagaccctgtctcaaaaacaaacaaacaaacgaacaagcaaacaaacagggttcttatatttctatacttaatcaaccaaacaggaaacaagaagacaggacacaacgcaaaatgaaattaagaaaacaattcaatttacaatagcatcagaaagaataaaatacttaagaatcaagaaggggactcttctatactgaaaactataaaacattgctaaaagaaattaaagaatacacaaataaatggaaagaaacattgctaaaagaaattaaagaatacacaaataaatggaaagaaaacatttgttcatgaattgaaaaacttgatattgttaagaaatcaatacaaaccaaaagaaatctacagattcatttcaatctctattaaaattccaataatttttttgcaaaagtagaaaaaattaattctaaaatttacatagactatcacaggactccaaatagccaaaatgatcttctaaaagaagaacagtgttggagatttcacacttcctgatttcaaaacatactacagagctacaccaatcaaagcagagtggtacagatagacagacacagagacaaatagaatagaattgagcacccagaaagaatctcttagttatatgatcaaatgattttaaataagggtagcaagaccattgagtggggaaaggacagactccataaaaaatgtttttgagaaaactggatatccacatgcaatgtggaaatggataaaagacccaaatggaaaagccataactgtaaaaatcttaatagaaaacactaggaagaagtttaacaacattgggtttggaaatgatttcttgtatttgacgccaaaagcacaagaaaaaaaaaagaaaaagaatatagataaattggatttcatcaaattgtaaaatttatgtgcaacaaaggactctatcaacagagggaaaatgcaaatcatggagtcagaaaatattttgcaaacattgtatctggtaaggtgtccaggatatagaaagaactcctacaactcaacaggaataaaaaaatagaaacaatctgaataaaacatgggcccaagacttgaatagatatttctccgaagaagatcaataaatggccaataagcacatgaaaagatgtttagcatcactaatcattagagaaatccaaatcaaaccacaataatacacaacttcacacccagtaggatggcgttaccaaaataatagaaaataacaagttctggcaaagatgagtagaaattgtggagaaactataaaatgatgcatccactgtggaagccttatggcagttcctcaaaaaattaaacatagaattaccattttaacagaattttcacttctgggtatgtgcctaaaagaattcagagcagggtctcaaagagaaatttgtacacccttgttcatagcagcattgttcacaatagctaaaaggtagaggcagcccaagtgtccatctaatggataaatgggatatagtatacacacacaagggaatagtattcagccttaaagagagtgttctggcccatgctgtggcacagataaacctgaaagacatcatgccagcagaaataagctggcttcaaaagaacaaaaattgtttcattacccttatatgaggtacctagagtagtaaaagctaccgtgacaagaagtataatgaagtttcccaggtccttggggtggagagtagggggagaatggacagttatttgttttttgtttagtttagttttgctttgttttgtttttgagactgagtctccctctgtcacccagtctggagtgcagtggcacaatcttggctcactgcaacctctgcctcctgggttcaagcgattctcatgcctcagcctcccaagtagctgggattacaggcatgcaccaccatgttcagctaacttttggtattttttagtagagatggggttttaccattttgctcaggctaatcttgaactcctgggctccagtgatccaccgaccttggcctctcaaagtgctgaaatcaaggaagtgagccaccacaccgagccgggcagttcttgtttaatggttgcgaagttttagtttgggaagatgaaaaatttctgaagatgaatggtagcagtgtgattgtacaagttgatttacttagtgacactgaagtgtacacatgaaatggtgaaggtaacaaattttatgtttgaatattttaccacagtcaaaaagaggaagatttatatttggcaccattgctctacttccaagaacagtagaaagatacagtagtaggagagtgtgcacaagtatccaggacgtctttcattttttgccagccctgcagcatcctaacaatccaagagagcaggaggtgtctcattacaggggactcagaataatgtgaagaaatctggggcggggtgggggcataatgatagcacacaggtgccggacccagtccaggagtggccacaaatgcaagggctgcagaagagggggagatgaagctggtggcagtggtagcagctgcttcagctggaaaggggcatctgttgctttccaaagtggttcacagttgaaatatctggcatagatacttcatcctgcctacctttcatgactaactatattttcattgcaatatatgcagtcatagtgagaatacctatttcctccagatacaagcaaacgtgaaggaaatgtgctttagtgctttggccaacttgacatggcagtcacaaaaagaggatgaatatccaaagacaaccttttccaaagataaggttattataccgtttattgtaaatactggaagtgcacaacaatcattcagacacctgggaaaatgacttgaccaaatacagttgtgaaaacaatgagtaaagaaagtgatatattcttggtaaaagaaccactggatctagtgagtaaagaaccaaaaggagatgaccctagattggaacttttagaccaggaccttggtaacattggtcctgtttatgcaacaaaaacaaagcaataccttgtctaccagtgagaatctgaatgagggaacagcaacaggaagcagcagaaaaaaggaaaagaagctcagtgcaaacagctgaatggggagatcacagggaccaccaagaaggcccagggttttctgctcagtgccttccctctcatacaccttagagcacccactgaacaaagataactaccagtatattctagctgagcctgatccccacgcccttggtcctcagaagcttgaacttgactgctgggcaaaattccttattcctggagacctctacagaggctgcttgtatgaacaggttttgttagcctgacataattgagctccccagttaaaagtctccaatgacctgctggctgactgtggttgaacagaaggtctactctatggtacgggattctcatgggttaccttgatatcaccatggatgagatgccaccagacactgctgccagactgggttggtcccagtctttagataactgtcaagcttccttagtttatgataagtttaactattcttgggagaattaaagggaatgaagttccaccagtccactggcaaacactactcttctagctatagacaaggagacatcctgggattttatatgaatcttcctgaagaaacaaagacagtcaagtcattgcctgatacttacaaagataaggccttgataaagtttaagaattatttgtgttttgaggaaaaagactttgtgactgaagcagagaagagcctaaaagagacttcccacagtgagataagattttataaaaatggtgttagtcaaggcatggcttacaaagatattttcaaggggctttactttccagcaatcttaccagaaaacaactgcataatttccatgaacattggactgtgcttcaagtatcctccaaaggatctcacttactgccctatgagtgacatgggctgggatgctctggtagagcacactctggctggtgtcttggtgctagaaatggattcaatcactggacaagaaagtccttcaggggcaaacataaggacactgagggtcatcttattctacctgccttctctccttacttgtatcctaggccagcctatgctagcgcaactgtccacagatctctctctctctttctgtctctctctcgtgtgtgtgtatgtgtgtgtgtgtgtgcatgtgtgtatcaaatgatcaaacatcttcattcaaaagtccaagccctgcagcatcatgagacagtgctaccacacatgaagaaaatgttcaaagggcaccaaatagagatcgcatgatccaaagttatttctgatcccagaaaagaatggcacacaatcaatatgaatagtattagatatcaaaattatagtacaatctcatttgtttttaccatagattcaaactctctttagcatattggaaagcagaatccatgttctactgatgcaattccccttgaccatcatgaaagaattggactgaaagcaggacatttctgaagtctctggaggatacgtaacatgactgttggagggaatgcacataggaagaggtagtgaattatgtgtcaagtgccccaacaaaaggctgtcagtgtttgtctctgacacattgttggggagaaaggtggagtcacaggacacactgccatgggacccacgagacttgatcctacatcccacagcgggcagcctgcatcaacgtggtcatgcagggatagaaacacagccacagaaagctttcacctgcccaagcagcatctcccaagagccagcatgggtgctgtctctgctctgcttcttcctggactgtgtctcagagccctgagttctccctcacccagtttcccaatccccctcttctccactggttaccaggggttaggggagtggggaggggaaataaacgtttaaagggtacaaacttttcacttgggatgatgagaaagttatggaaattcataatggtgatgactgtatcacttttttttcagaggtggtaacttgctctgttgcccaggctggagtgcagtggtacaatgatagctcactgcatccttgaactcttgggtctaggcaagcctcctgcctcagactcctgagtagctgggactacaggtgcaagccaccatgccaggcaattctatcacattgtgaatatacttaacaccactgaattttacagttaaaagtgatttaaatggcaaattttatgttgtgtgtattctatgacaattaaaaatacacttgttcaaatgtcaaaatatatatgatgttatattcataaaattttccttttcacacttatatatttatcctattctaactcattctcatcaattaaaaaagtactgtaattactggtcattatgtactaaattttccataattcacattgaagccttaacccccaatattactgtatttggagacagagcattacagagggtaattaagatgaaatgagatcataaggaccggcatccttataagaggagattagaaaatggacaacataaaatgagatgaggacagagtgagaaggtggtcatctacaagtgtggacacatcttcagtttgtgtggagtaacagttgaagggctcgcccatcctataatgaaagttggaacaggtgccttgggcgggctccaggattaactgatctagtcactgcatcccactgtgggaccccagagggaaagaagcactgtggagattcctgagacattagaaatggagcctgagaaatttccaggacacccacatgggctccaggtgaagcaggggcccagaaggccttgtctgagccctgagtgtgacgcagcacctggccactagggggaggcaaactctgtgaatcctaagggacctgagctcttgctctgagccctgcccttgttaatcaccagccctgggagggagccgatttgcatggaatgtgatgtccctgcccacttcttcactgagggaataagaggctttagggcctcaggctcagctgagagactgaagaacccagcattgcagcagctccaccatggcctgggctcctctgctcctcaccctcctcagtctcctcacaggtcagggtgggcagtgggctgggcccccaaagggacccccacctcccagcctccatctccccatccctgctcttcctcctccaacagctcatcagccacccaccaacaggagccctcatgggtgtctgtgtttccagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgtaacccacagtgacacaggcagaggggaagtgagacaaaaacctcccggctgatctgctctgtccacacttccttcccactggcctgactcacatttcagagggctgtctcttaactctgtatttaaagttttcaccttcccagacattttggagttctaattcacagcatatgttccctgtgtgtaaatattttctcaagagcttttgaaacattgaagtttgcacaccaacatttgtggtttttgccactcacctgtcccctgatgggattgaagtttccaggttgtggaactgctcacaggtgcgtttatcaggaaatcaccgtcaccagctcccacgacctttgtccatattcaacatttgtgagctgcctattcaatgatgggaactgacaatttccctggagacacaaggccttcaccctgactcacagtgtcacataatcgacgtggacttcagccatctccagtcacctccatgtgcacagagctctcatggtacatgtgcttggctgccctagaaagagagaatggacacacaccaaagatagtagaatgtgagcctgctctatatctgagattctgaaagaggcccccactgccttcacagaatgaattccttcacatgcagggagagagctctggtggaatcactctgcaatgctttctgatgacaaatacctggattgaggtcaaatttcacaggttaataacccttttcaagactacctccactacagactccagttcccaggcattaagcctgaggacccttgtagacaaccaacatggggctgtgaccagcaggagcaatgggtaactgtcccaggccctgccttggggctgctcacagccgggtgagccccactggccacaggctggcagaggctgagctgctccctgtgctcgctgatgaaactcagcagcctagtgctctcagggtccagcaaagcctcttgggcagggtcctgtgcctgttcccaacagccgctccttcgaggaccctcctaggcccacactcgagcagctccttcctcaacctcctctgtcctcacatccccttttgggttcctgaatcagtgatcaggtagggtctcatttagccagaagggagggagtagatttgcatgaacagcttcttcttttccctgagggcagaaggaaaaatagtcaagcctggggaagcccagcccaactgtgaggtccagaggctgtgtccaccatggcttgttgcctgaactcctctggtacccaatccttggtctatgtttatagactcaatgaaaatacctccctttctactggcctcttaatgctaacagaatcattttgtcccctaagcacaaatagcctttcgggttgctgggtgggatgacaactagagcagaagtctagcatgtgcaaccccattcctggcccatacatgtccctgctcttggcccagtctttgctggttactccctgaactctgaaacttcagggaagttgagtttctctttctcttgagattgtactcttgaggagctcctgaatttccaggtatagggtgacccctcctcattaaggacatggctctcagacttatccctggtttacttccccaggtttaggtctgtgagttctaaacagtttccctatgtttctttggttgatattttggttgatatttccctttgtttctttaggttgatattacattgggtaattacattggttgattacattgggtaaatatattcttgtagatatacacattataaactcttcccccattaagctcttaataaataaacttgtttgggtgccaatgtaccaatgtaggtaagaagtcttgacgcttttttttttttcttctgcaggagcagaggagaacctgaaaaaaaaaagagagagagacaagttcagcttataatactgttattttcatataaactctcctactttaaaaagtacaaaactagacctatactgaaaatatttttaaatatatcagagtatctgcatctgtcactgtggagatggttgcttgctctaccacagagcacaataatactgagcctcatcttcagcctaggcccctgtgatggtgagggcagtcttgtcttcaagcacagagtgtgagaatcaagtggggaccccatgcagagatggggacgtcagacacacacaccctggctcagcctcacctcatgctcctaacatctccatcttcttcacacagaggctgctgctgcttctggctaacacgggctcctgacgctggttctccagggcccaagagaaagtggtcacatatattcttctaagctgcaaaatttgtatttttaacccaacatgttattataacaatgtgttcataaagcacaatactaagatctatcatcaattgcacagttatgagttatttataggagtggcaaaataaaaagttacgcacacacacacgcagattcgggcaggccagaatttaattacaggagcaaagtttgatattagtgacacaacataacaatgatcctatgtataatgataaacatagcaatggaccatatgaagctttgaagaaacatagtggaaacacagaaaaaatctccctctcaccaaattttagaaaattctaaaaaaaattaaaaatttttaaaacccctcaaaactgagttaatttataaaatatgatacaaaacataaagtttacataactttaacactcttcatactcagtaaatgcaggttctttctccacaatttaatccagtgtaccaaaaccgagccttcctgtttgctggaggaaaacctcagcaccacaacagtagaaaagcaccaacctctctgcccacagtgcatcttccctccagagactccgcaggactctgcatggtctcctgagggccctgaagtggaggttctgtgatgagaagggggcatggatggcacagggcaagaatgtctgcagggtaagagtgttagaaggacaagcttcattcctctctgaaacaagcctatcttacatgatttatctttattcttctctacaaaaaaaaaaaagtcacaaagatagctgcaaagaaatatgtgaaattatacaaggctaagataacaaagaatattggaagaaaaagtaattatgacatcttctatcgaaacattttaggccaagcgtggtggctcatgcctgtaatcccagcatgttgagaggccaaagcaagagaatcacttgaggtcaagagttcaagacaagcctgagatcccatttttattttttaaaagcagcattaaaaaaaaaaggttcatcatagtctcctcttcccacagttaataatgagaatggagaaagttcaaaaagtgaaaatttaagcaactcttatgtacccataacaattttttaaattttgaaaaagaaatgaaacccgtagcacaactgaccaccagcacacaggtgcctcttcttcagctgcccctcctgaagtgacaaccaaacccaggggctcagcacaatgagctctccctctggccatacattccctgtgaggccccatctactctcatcccaacacaattgctccccaggcatctggggactgctgctgagattctccactcatggggtcctgggcacagcggtgttatcccagtccccctcttcctctgtgtcctgggagctggaatcagagtcagcctgatctggcccaaagcctacaattaagagccctgagtggcctctcctgctttccccccacattggactcttcctttcagtgtccttcctggggtactgtgtcactactcaataatatcttatgtcctcagtgctaggcgtttttcacataatatactcttgttagtttctcctcacctttccaagctcagttatcaactctaggctgatgatcctaactattcatttacagcacattgtcatataaaggccagcgatatctagaaaaaaaagtgccaataaatgtgtgtactgcatcttacgaatcactacaaggataccacaaacaatatccctgtatttaaatagagttcactcttcagacacaagagtttaagtggagttcaatataatagtttatatagataatagttaatataacagtttaaccagtctgtctgtggctaaaccagtcaccatctcctgcactggaagcagcaacaataagggtcttgggcttgtgtcctggtaccaacaatgaccaggaagtgccaccaaacctctgatacatatgtacggatccatatatttatatccatatcctgcggcgaatatccacctgcagggatccaggactgaatctcaggctaccggtctggcaaggaggcattgctgagcatctctgggctacaggcttaggacaaggctgatctctgctgttggctttaggcagctccatcgaggtccccacagtgctgcagtctggggaactgagacaaaggcacaccaggtttccaatgagtatgagctacctgcagcaccacccactgtcaggacaactgggctctttaccgtttgtgtgtatgtttcctggtgctgccactaaccagtgcccaggactcaagtcagggacagtgatctagagaatgcagctttgttctttcagagccagcccacagagggagcccttagcaatggcacattgtcagactgcttcaaaagaatcagaaagcctttgattccaggaacaggctgctctggggacagacccgagatgggtcaggggaggcagggacagattccaggtggctctctctcaggcacatgcactaatgcagaggtctaatcatccctattgtctactgaacaactactatgtgccaggctatggggagggctcaggatacagagttaccaagacagacaaggttcctgtcttcatagggctgacaccaaactaaagagagacagtcaagaagtcaatgggaataaggcatattgtggtgtatcaaagaggtgacactggccagaagggggagaatgatagaacgcctttagtgggtcgtaagcaaggaagacacagccttttgtttgagatttaggaggaaagtccagcttcttcaaggaagacaaaaaatgaggggatagtgcgaaggcaaaaggtccagttagaaagcagtggcattgtgcacatgagagatgaggtatctagcatctgatgtagcagctgagctgggaggaatgtgcatgacccacaccatggtgagaaggactagaggaaagaggtcactaggttgaggccctgaccttgtccttgtgatggaaacctgacaacagcctgcagctgcgatcaagcatgtcactctcctcttctctctggaaagctcataggactcaggactcattgctgcccttccctcttattcagtgagatttatttgaaccatcacttttcacacctggacagagacctgcttactttctcttgagcaaaagcactaagggtcgggacagagcactgtagagcacatgggatgatgccctacacactcaaggggctgctgttactgctgttaaagctcacgatcaaacctcccagagctctgtcagaaaccatgagacgggaggtgtcagtgctgaagtagctgatttgggggcacactgatttgcagtctgtgcagtcctgatttggaggtgtgggacagtgagggctgaagcccagcatcggcaagaggttcctgaggtgtctttatgtgccagggtccttgtgaccacctcagtgatgtgtgggggtaaaggtcaattgaaaagctggagagcagtggacaggcaggattctgtgtctgggtgagggacgggatgttcagctcctgcccaggcatccttatttacatttctgtttacctctcttcttccttgtctccttcccagggcagggttccagggctgttgtatctccgctgctctttctccatcacaaagagagcaagagagacaggttatgtgatgactaattccctcttcacactcagttgtctgattgtccttaggaattcttcctgaggatgggaatgtgctgttttatttctcccttacagtgagatcctagccatttgtgaggccaaggagattgaccccatcctgtcgatgaaggattatttataacacacatggtcaaaaagaacatcatcaacttctgcacaagtcagtccattcgtcagggttatagaagtgcacgtctctcagctgtcagcaatgggcttcaaatccccaggatgactaacttgtcaggatgggatcatccacattaagatgtttctttacagttagtgactctattcactgtgtttcccctgctgagatccaacctctatgagattgtttattggctgttttctgtcttgttattgctgaaaacacttcctggcactaaggacagactcaatacatgtttattaaatatgtgagttcacctacattggaatcccaggaagaggtacaaacctgaggtcaagataataatttttttaaaaattctgaatattttgtgtttgagattccaagttcattcaatggaagatactaagtaatgacttttgcctttggatttggttagcaggagaaggatatggatataaaaatgcaaatatatatatcacacatacctccccatggcccagagacctgaaagcccagctggtctctgcagctgccaattgcagcctctgttcactcatttatggtctgattgtcatggatccatatatactggatcccatgggttcatgtggagaaagtggagaggatgcgatgggctttcccagtcctgataaaagaaaccacaggaagcgaatagatcataaagcaaattctggggacagaaaaccctcgagagcaaataaactgctaatatgggtgagttgggaaaatgtctggcaatatttatataactaagaaactttacattagatatccttccttcacaatattcattacggagctttaaatcatccatatgatcaatgcaattcaaacattaaactcatcaaccccaagtcccatagcagactttgatgaggaaattcttgaaggaagaagggtgggtttgtgagctctgtgtccacagaagagatatttctccactaggagaactgggtaaagccaataaataattaggaatgtagatgcccaactggactatattctaatccaatatgcaatgctgtgagtcctgcatctgcaaattgttaacattcattgtgcttccttcagtttcccaattactacaataaattaactttagacatggatgattacagaacagatcaattaatgtgagagtccttggaatgtgttgctttaatccacaaaaattacggaacacttcaaatgtatatatttgttaatttatgtaccaattgtattttactgcttcgttgatctgttgtaaaaatcacccagtgagggagtaagctgatgggtaaaatgggttgaaaaattaaacaagatgaaccacattgatgatggtcaaatttggctgatgggtgcaaacaattcattagaaaagtatctgtatatttgtatggttcaaaagtttccatgctatccagtgtttaaaatatccttgtttgtaactgttctgcttttaaccggtgtacaatgtggacaaaatgtaagcttacactctgactttgagtagaagcccatcttctcccaacaggcagaggagaagctggtgtggagaacatggaaaacacaggagctcagggtttcccaggacagagaagcgagtgagcctggagccctaaaagcaagggtggggctgtgagttgggctgtgggtgtgtgcaggggccacagtgtgaagggcatgcttcagaggccacaggatttggattttataataagaatgatgagttactgaaggggtttaagccaggtagtaccttccctgcctcatctatatgagagggatctgtatccaaatgcctggaggagagcgtgcctgagaaaagtgagtgatcctgattctagattattcactaaagcacctcgtgagtctagaaacccaagggccatttgcacagttagcacaagagtagacgtggcaacattgagaagtgatggtctctgcctttgtctcctctggcattcaatacttgcaaaaacactttgcaggtaaaataaatactgatatttcaaataacctgaaagcatccagtaaaaaaataaaggtggcaatatcaagatacaaacaaattgtataacatttaggacaaatcgtttaccaaaaaatatgacacgactgtgaagaaagtgacgttttacttagggagataatggctaacctcttaaaacagagatatatgtcacactgtgacaggaaagtctacaaaatctcttaatgttcctacatcacaaaattgagtcaaatctctataaaacatatgaaaccattagatgtataacttttgctaaattgctgtctttaacatgtattggatcatttatttttcctggaaaattctcattcttcactgtccttttgaacaaccccagctgcccttcaacccagctcctcagctgacccatttttcatgatgcccaccctgatggcacatgtgggcaactcgatttttctagaatgccatgcaggggtgctgacaactttaaaagttatatagtacatggctgcacatcccacagaccaagactacttctgggagtgagaaatcacagtaataatgcatagcatgatagaagcagtgtctgggaatcagaccatggatatgtgaatacagacagtgactggagagctgcagagaccagctgggttctgaagtctctgagctttgggaaagtgtgtttcctgggaccagcgtcggatgttgtggggctgccctgtggttctgacacagctgctcagtaaggagcattcactccaagaaatccaggccttgaggctgggccctgtgctcactgatggagacttggcagctgtgtcccctctggcctggcagagttccctgagcagggacctgtgtatggtctcaacaggtgcttcctcccagggccttgcaaaaagaaaagcaaaccttcctcctgctcagtctgcagagagagcagagctgcatccccaggtctcaaggaggggcccggcaatccctgggtggaaacacatttgcatgagcagcccctcctctgcaagggtgggaagaaaaggaggcctggggcagcccagtcccactgtggggtaagcggctgtgtccaccatggcctggaatcctctcctcctcctgttcctctctcactgcacaggtaggaaaaggcctcagagaccagggtcagccacacagcctgattctgactcttgtgtcaaagatcactaaaaaaaatattaccttggtttctgtcttaaagcctatatatgcctgtgttccaggttccctctcgcagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggatccaaagatgcttcgagcaatgcagggattttagtcatctctgggctccagtctgaggatgaggctgactattactgtatgatttggcacagcagtgcttcttacagtgacacacacagatggggaagtgggacaaaaacttcaccctgatctgggtcttgttctgtaacagtttttaaattttaaaataaccagccaagggacaaactaaatttggaaataactttctagttgtaaaaggctcttctctcaatttcccatccattcttctgaagtctcagtaaaacaaaaccaaaccaaagcacctgatgaccctgaagtgttggctggttgtccatatgtgctaacaccactgcctgcggagctggacttttgttcttgaaagaagcaaaatgaggctttcctagctcacatcatagtcagagcctggggacatcctagcaggtgaacagtcccctacagcatggactctgctcttccagcgtacaagcagagacctccccttccatccccactagtctgttctcagggctgtctgaggctcactgtgtcccaggaacaaggcactcaaatatgaaatgctgcctgaggacacaggtcagggaattccagatatagtgctgacctggctcagtcctgggtacctgcatttcagtggaaatgtcaggagatgggattacgtctgagggtaactgtggacctgaggccggtaaacctctatgtaggacatgagagagtcaaggggaggctccaccatggctgaggcaaggctgaggctgctccttggccatgggggaagtaggtcccagggatgtgactttcctgcagctcattccactcaggaccacggggactgctgagggtgggtttgctgatccctcagggcctgtgttctcttctcctctattgcaccattggaggttctcactgagtcaggttctagtagtgagtctgtggaacatctgggtacagatactgtttgcttcaagtgactcctccccaggaaactcttgagaaggcccccatctcaatgtcacctttttctgcatggggagcagcagaaacattgggcattccctcccagaaagagcccctaattttgtgacttaggacatcagcgattgtccctcaggggtccaagcctgattctcctgctctgggtttattcccacagcctcctggacaacttctgcgctccagcctgaggactggctggttatcagtgtcacacagctgcatcctgactccatgttaccaagggttcctattccatggggaaatgagagaaagatctgccccactcatcctctctgccccatccctcctttatccttgcctgtgaccaacaccagttcatgccaagacttttactgtcacttgtgttactgaaagcagagcaagggtgcagggatgataactccttttcttactggtctccccaatggaaacagaatcaacttgtttctagaagcaaaaggagctgcccacacatggtgggtgtggatgaggtggggatgacaagaaagaatccagccagtgtgacccagaagtccaggagccttcagcctggtcccacaggtgtcctctccttttggtgcaggtgtgctgatcatttcctgagctctgaatctgtgggaaagatgacaagaaaggagaatccagcctgtgtgacccaagacccatatgtgagagcggaagtctgacacttaagaaaacgtgggctcagcattctgagaggtctggatctggctcggcctagagctgctctagaagagaagcaagagaaatgctcagccttaggtggcccaggcacagtggtcctgtcaaaggtctgagctctctgcaacatggatatcctgcagagacatccttgggaggctgtgatcctagaatgatgtaaaaatgctaatggaagtgagcaggggatggtttatggaggaatgaggagatgggtgtggggtcagatgtggtaaggagggtgcaccctgaagaggagactgtccattgtgactcataggagaaggatgcccggggcctagggcagtgacaaaaagaggacctggaaggaccggcaccctgaagacacgtagagactggggtttggtttgtctgtgagggttcctgaggagaatcacataaaaaatccacagtcagtgtcttctgtccagggctcactgtcgcaactgttgccccttccttccagatcctctgggtgtccaggttccttagccgtggatctgctcctctctctgccctcagcctaagagctgatggggcatccaccaggaagcgcatccgtgggcagggaggaggccgtgggcagccttctcctgtatgtgagacactgctcagcctcggtgaccccctgttcattaaggtgggaggaaaggaaaacaaaattcactgtgaacatctatgcatcatcaaagaaaaagcaatgagaagaaacaggaagtgaagcccagctctaatagtttatttctacttggaaataaataaaacaatatgcctgatgtgttatataaacacaataaactttttataaaaactatgaaaattatgtaaaggagcatggcttacactaaaaggaacatttaaaataatgacacccttgaaatgcaatcccaaaacacagcatccattttatttcagttacatatacggactggttttatttaaatgcctgcaataaatctcactattttgttgtttaaatggagcatttaaaatctcattgtggccaggcgcggtggctcacgcctgtaatcccagcactttgggagtctgaggtgggctgatcacaaggtcaggagttggagaccagcctggccaacatggtgaaacccagtctctactaaaaaaatacaaaaattagccgggcatggtggcgcgtgctggtaattccagctacttggaaggctgaggcaggagaattgcttgaacctgggagatggaggttgcatttagctgagatggtgccactgcactccagcctgggcaacagaccaagactccggctcaaaataaataaataaataaacaaacaaataaataaaaaatctcattgtattgcaactgtctgatgatacattcacaagtataaatatcaacataaccatccagctgtttccctccatccacgtaaaattccccaaacaaatatttgttaagagtccagggtgtatcatgccagaactcatgcaatcataaacacaatctatttcatttttcattttgattaacagaattatcttttttcttaagattattgtttttagtttattagattctagatgtcattacagaccaaagatgaataattttcatcatcttcaagccacccccacaagactcactactgaatttgaaccataatttttccctggaaatcctagttggggtgctcgatgctaagagctatcacatatcaggctcacctgaggacagactctggtcgtcaaaccaagttaaaattttaattcttcccatgttcaaagactgaacatctttgctctttttgctcataagtgaaacactccaaagacatttgccaggatcccccacagactggcattcagtgcttggaggacagactcctaggcaagatccttggtcacagtatccggatgactatgactgcaaatctggggaagtagagggagaacaaagatttaccaggaaaaccctctgggaattcctccccagggcatcccagaggtaagagctccctttctcctcagcgcagcaggatccacagaggaagtggagccctggccaccagggaggagtcacatgagaggagaggacccggtgtccaacactggtggggaagtgagtccatggggccggtccccgctctgggcttgatcctgaaataaaaggactttgtgtagacatcacctgagtcctctacaatgtacagccaaagagccatagacagattcactcctgaggagtccagtagagcgtgaagactgccctgaggtcacaggagggagacacaggtgccaccttactgggccgggacttgggagcgggggcagtggccagaaaacagggcggggcggaggcagcggtgaatctcagaggctctggtcacctgatcacagaacggtttgccttagtctggacactagggggcgcttggggaccatttctgagaagacttggggtaatcagagcagaaccaggcacctgccctgcctgatgtcctctgctcagggctggcagctgtgtcctgtgtcctccccaccccctgggaccacaaagctccacccctgccacaccctgacatactcaagcccaggagcctgacccagggctcagggtggggtcaaaaaccggggggatctgatttgcatggatggactctccccctctcagagtatgaagagagggagagatctgggggaagctcagcttcagctgtggtagagaagacaggattcaggacaatctccagcatggccggcttccctctcctcctcaccctcctcactcactgtgcaggtgacaggatggggaccaagagaggggccctgggaagcccatggggccctgctttctcctcttgtctcctttcgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggtcccacagtgctccaggcccagggggaactgagacaagaacccccttcctcctctgtcaggagggtgagccccggcagctgctgctcaggcccggcctgtggcttctgctgctgtagcttcccccatgggtccaagggcatccagggccctgcctgagagtggaggctcctcctccccttcatcctcagagtcatgaacaggctgtccaggaaacagaacatcctgcttcctgcaacttgggacacagggtctctgcactgaagtcctggactgaggtggcaggtacagctgtgtcgtcacagacccacctctgatgggaaacctgtgtctctgtcatcctccttttcccatttccaggagtttccagagtggtgtcttcctccccctgctcctcagtgtgaatccctgtgcttcctttctctccagccaattctttttttaataaaactcctttcatgtaggaataatgcatatttaataaaccacccagatttataataggaaattagacaaatgttgacattttttgatccttgaatacatcaccaccaacacgcagctatgcaacctgtgaccaaccccagcaacccctcatgaccccttgtcatctccctccctcccttccccagtgctatcctgtgcagccacagatctgtctctgtcactattgtttgctttccattttttggaatgtatcagtgttatcagacattatcttcccatttgttctggcttttttcacactgcaaactccttttgggattcttcctgttctcgctgaattgcacccatcccatagagggctcattactacctttgagggcctttaggttgattattcctgattttgtttatttattttaaagtttgaatttatcgtccatcaaaatcaaactcttggagttatgttcatctaaggtgacaggagagtctgtgatgtcttgtcgggattcttgcttcttcatctcttgcctctcgttctgtctatattggaagaggttctcatattctatttatttacttatttatttatttgggtttttaaggatttcagtgtttttttctctttaattattaatttttttattttaataggtttttagggaatcggtggtatttggttacataaataagttctttagttgtgatttctaagatattggtgcactcatcacccaagtagcgtacagtgtacccagtgagtagtcttttatccctcaccccgcttctaccatttcctcccagtcctcaaagtccattgtatcattgttatgcctttgtgttctcatagcttatctcccacttatgggtgagaatatgccatgctttgttttcaattcctgagttactgcacttagaataacagtccccaattctatccaggttgctgggaatgccattattttgttcctttttatggctgcatagtattccatggtatgcatatatttaacatttcctttatccatttgttggtttatgggcatttgggctggttccatgttcttgcaattgcaaattgtgctgctataaacatgcgtgtgcaactatcttttttgaataatgatttctttttctctgggtacatgcctagtcccagattttgggactttgctggatcaaagggtacatctatttttagttccttaaggaatctgttttccatagtggttgtactagtttaccttcccaccaccagtgtaaaagtgttttgttttcaccacatccatgccaacatctattattggccattcttgcggtattaaggtggtattgtattgtagttttgattggtatttccctgatcattagtgatgctgttcatttttctttatgtctgttggccattcatatatcttcttttgagaatttttatttatgcctttagcctactttttgatgagattgtttagtttttttcttgataatttgtttgaattctttgtagatgctagcccttagtcattaggtggatatgtagattgtgaagattttcttccactcggtgggctgtctgttaactctgctgattatttcttttgctgtgaagaagctttttagtttaattaggtcccatctatttatctttgttcttgttgcatttgcttttgggttcttggtcatgaagtctttgcctaaaccaatgtctagaagggtttttctgatgttatcttctagaatttttattgtttcaggccttaggtttaagtctttgattcatcttgagttgatttttgtataagctgagagatgaggatccaggtttatttctttcacatttggcttgccaattatcccagcaccatttcttgaacagggtgtcctagagtatagtttgaagttaggtaacctgatgcctctggatatgctttttgttgttgttgttgtttgtttgttttttcttagtcttgctttggctatgcaggctcttttttggttccatatgaattttaggattgttttttctagttctgtgataaatgatgttggtattttgatgggaattgcattgaatttgtagattgcttttggtagtatgatcattttcacaatattgattctacccattcatgagcatgggatgtgtttttatttgtttgtgtcatctatgatttctttcagcagtgttttgtagttttctttgtagagttctttaatctccttggttaggtatattcctaagtatttttttttttgcagctatttgttaaaggggttgagttcttgatttgatattcagcttggtccctgttgttgtatttgtgtgccttaattttgtatcccgaaactttgctgaattcattcaccagttctcggagctttttgaatgagtctttaaagttttctaggtatacgatcttattataagcaaacaatgacagtttgacttcctctttaccaatttggatgcccttaatttctttctcttgtctgattgctctggctaagacttccagaactatgttgaacagaagtggtgaaagtgggcattcttgtcttgttccggttctcggaagaaatgcttttaagttttttctgttcagtataatgttggctgtgggtttgtaatagagggctttcattaccataaggtatgtctcttctatgccagttttgcagagggttttaatcatgaagtgatgatggattttatcaagtactttttctgcatcgattgagataatctgtgatttttgttcttaattctgtttatgtggtatattacatttattgactttgtatgttaaaccatccctgcatccttggtaagaaacccacttcatcatggtggactatgatttgatagctgttggattgggttagcaagtatttagtttaggatttttgcatctatgttcatcagggatattggtctgtagttttcttgttttgttatgtccttcccctcattttggttttagggtgacactggcttcatagaataatttattccctctttctccatcctgtgggttaatgtattagtattctccagagggaaagaactaatggaatatatatatatatatatatatatatatatatatatatatatatgagtttattaagtattaactcacataatcacaagtcacacaataggccatctgcagggtgaggagcaaggagagccagtccatgttccaaaactgaagagcttggagtccaatgttcaagggcaggaaggatccagcactggagaatgatgtagggtgggagactaagccaatctctctttcacatttttctgtctgcttatattctagccatgctggcatctgattagattgtgcacgcccaggttaagggcgggtctgcctatcccagcccacttactcaaatgttagtctctttggcaaaaccctcacagacacactgaggatcaatactttgtatccttcaatccaataaagttgacactcaatattaaccatcgcaattactgtcatagacttggtgccaattcttctttcaatgtctgatagaattcaaatgtgaatctgtctggtcctggacttttttcgggggttgactttttaaaattattatttcaatctcactgcttgttattggtctgttcagagtttctacatcttcctggtttaatctaggagggttgtatatattcagatatttatcaatcttctctaggtttttcagattatgtgcatattatcttttatatagtttttttgttttaattttatttagttctggtctaatctttgttatttcttttcttctgctgagtttgggtttgcattgttcttgatcctccagtttcatgaggtgtgaccttagaaggtctgtttgtgctctttcaggctttttgatgtatgtatttaatgctaaacttttcccttagcactgcctttgctgtatcctggaggttttgataggttgtatcaagatttagaactactgcaaccttactattgaccaacaggtttttaattcctaagagtgtgacctcactgaatcctgacaacagctttatgattgcttttcatgcagtaggccctggttagagaggggagtgcttgtggcctggaggtaggattctgcaatttatcaaataaaaacactggaggtcagttaaatttgaattcagtaaaacaatgacaaagaattagtatgtgttagtatctcccacacaatatttttcagttgaaatacaacttatctgggtgccctgtcgtttatctgccaactcctcacaggattcaaggcttggaagagggagtgttggggctggcctcgtcttactgatgccagttctatgagatgaacctcaaaggcagagcttctctaacacagctaccctcaagaaagcacgtcagttagcactaaatacatggtataagttcctcaatcaatagtgcctactcacttccctaattcttctttgtattattcttcaagtctgcagactcaggacctctgctggggttgctgcagccagagttctggatgagggacctcataagcctttcaaaaccagacgcagggggactactcagtccccacgcagcggggcttaagccaggggtaaataagtaagaaatggaagagctcagcatggctctccctttgtccagtgagacagcaaactccagggtccttttgatgctgaaggtgcgtgggctgagagtagggggagacccaccctgagagcccagaacttccaggacaggacttgtcagtctgaaaaggggccacactcttgagtggggaagaaggaggcatctctcgccacaggcctgcatttctggtggcttccccttcaccaaactgtgctctctgctctgatgtctatcagagaatctccttcagtgagactaagatcccaggactttactaaaaataacagcatgaaccagatagatttgtaatggtaccagaattctctgcagagcaatgagtacaaatgcagcttaacaaaggccctcacactcataactgaaaggctcagtaggtctgggtctggggcagtactgggtgctgtaggcttgtccttgaggcatctacaagtaagaacaactgggaagccatcctgctgtgaccctgtatcatctgctcactgctcactgggctcagcagctgtgtcctcacagggaaccaggttcagccaacctggccttctccaccccacctagaacatgtattccggtgactgtctggactgaggttctatgaagggactggcagacaagaagagggggctgatttgcatgaagaaaccattgcacaccctttcctttcatctaaaacccattaatggatactctggggccacccacagaagtctagcttgtctcctaaatttgagagttaggaaggagtcatttcttatcaatctacaggtagaggggccatcagcagcagagggccagagtgagggagaaactggcttcgagagactcatcaacacagccaccaactcttggacaaatggggcacttgctataacagtcaccccaagctactcacaggagcctgagcctagtcccctcaccttattgcttttgattctggtccatgcctctgttttccctggactctttgcccatgtctgagtccagggaggcaggggttgctccatctcagtcaaaatctatgtatatgtaacagctactatggcttggagcagagtccactgttgtacctatgagggcctatcctgctccaccatccccttacacaggtgacaactgctatgtttctgatggactgacccttttcccctggaagacacaaggtatttattcctttctaacacaaggcatatagtggagggggtaggggtgggtgtgaagcagagtggcttttccagatataatgcagtaaggccctggttacagaagatcatttcacaaaattccacaccctttcatgataaaaacactcaacaaactatgaatagaaggaaacttcctcaacatagtaaaggccatctatgaaaatcctacaactaacatcgcatgcaatctgaaagaccaaagatatgtttttgtaatatctatcaggatcaaagcaacaatgcacattttcaccacttctattaagacagtattggaagacctagccagagtaattaggcaagagaaagaaataaacagaataaaaattagaaataaaaagtaaaattatctctgttttcatttgatttaatgtcatatgtagaatacccttaaaagtcccacaaaagaaaactttgtcagaatgattaaatgtattcggtaatatttctgaatacaaaaatcaccatgtaaaattatctcatggctgggcatggtgactcatgcatataatcctaacactttgagaggctgaggtgggaggactgcttgtggtcaagagttcaagaacagcctgggcaacaaagcaaggccctgtctctacaaaaagagagagagagagatgaaagaagaaaggaaagaaagaaagacagaaagaaaggaggaaggaaaagaaagaaagaaagaaagaaagaaaagaaagaaggaaggaaggaagaaagaaagaaagaaagaaagaaagaaagaaagaaagaaagaaagaaagaaagaaagaaagaaaatctcttacatttcaatacttgagcaaataggaaacaacccaaaacaaaatcgggacccacacccattaggatggctttacccaaataatggaaaataataagttgtagcaaagatgtatagaaattataactgtaatgcattgctggagggactataaaatgatgcatccactgaggtggccttgatgacagttgctcagaaaactaaacatagaattaccattttatcagaattttcacttctgggcatgtgcctcaaagaattgaaagcaggatctcaaaattgtccacccttgttcgtagcagcatcattcacaatagctaaaaggtggaggcagcccaagtgtcatctaatggataaacggaatatagtatacacacacaagggaatagtattcaaccttaaaaagaaagttctgacccatgcgatggcatggatgaaccctaaagacatcatgccaacagaaataagctggtttcaaaaggacaaatgttgtctgtttgctcttatatgaggtacctagagtagtgaaatccatagagacaagaagtagaatgatgttttccaggcatgaaattttggtttgggaggatgaaaaattcctggagacgaatggtggtacgtgactgtacaacaatattactttacttaatgacactgaagcgtgtggttgaaaatggttaaaatatgtgttttgtgtttgaataatttaccactgtcaaaaacaaaaagatttatatttggtgcagttacaagaaccataaaaatatacaggactaggagagtgtgcctgagtagccaggacacccttccttctgtgccagccccacagcatcctaacagaccaatagagttggaggtacctcattacaggtgacacaaaataacatgagaaagtctgagaatggccatgatggtaggggtgggtgcctgacccagtccaggagcagcctctagtgcaactatggccaaagaaggggagatgaagctggtggcaatggtagcagcctctccagctggagagggacatctgctgtcctatgaaaatggctcatagttgatatatctggcaaagacatgtcatcctgtctacctttcatgaccaactacagttttcatagtgctttggttaagctggcatggcagtcccaaacacaggatgaatgctatagcatttattgataaatactgggagtgcatgatgaccattcagacacctgggaaaatgactaggctggataacatcgttaaaacaatgagtaaagagagagatttattcttggtaaaggacctcctggatccagggagtaaagacctgaaagaagattgcccaagatttggacttttggatcaggactttggtaaaactgatcctgtttatgacaagcaaaagcaaagcagtgccctgtctgtgagtgggaatctgaatggggcaactgaacaggaagcagcagaaaagaggaagaggagttcagtgcaaacagcaagatgagatctcagagaccaccaagaaggcccagagtgaccctttgttttctgctcagcgccttgccccttacaccttttaaaacacccatttaacaaggatggctactggtatattccaaccgagcctgagccacacacccttggtcctcagaaggttgaagactgctaggcaggagaaattattcctgaagacctctacggagcctgtttctgtgaacaggttttgttagtctaacatgattaagctctccaggtaaagatctccaatgaccagctggctgactgtggttggaaagaagggttactctatgatgcaggcctctcatggggtatggaaagggacctgggactttgaaatcatcaaggatgagttgtcaccagacaccactgccaatggggttggtctcagtcctaaggtaaccatcaatctcccttaggttatgataaacttagctattcttggcagagcaaaagggaaccaagttccacctgtccactggcaaataatactcttctagctacggatgaggacaggtcttgggattttatattaatcttcctgaaaacacagagacagccaagttattgcctgatacttacaaagataaggctttgataaaatacaagaattatttgtattttgaggaaaaagacattttggataaagcacagaagagcctaaaacagattctgcacaggcaaataatattttataaaaatggtgtcaattaatatgttgaataaaaggtatttttgagggggttgatttccagccatctcacaggaaaacaactgcatggtttgcattaactttggactgtgctgcgagtgtcctccaaaggatctcgcttactcccttatgagtgacatgggctgggatgctgtggtagagcacactctggctgatgtcttgtatctcctggagacagaagtggatggaggcacagtcctccatgggaaccctgaacaggtccctctttcttttcaaatatggactttctggggaatgatactggacggcttctgtagttgttgttgttttttgaactgtctcaaatgttttcccaaagatgctacagaacatagcctatccatttagcaagtgaaaaggctgaataagactgggagagactccctgctcatcatcattcttcttccacttccagtgactgctcatattctgtgccataagccaacagctactgatcccaagatcttgtaatccctctgtaaaactggtgctgtactgcataccttgccagctgggactttttatcttactgcattttccaggaataaataaccttgtcccaaaaacaaacatatttaaagacatttccttctgtggacactgattccatgctatctgttttccaaggaagtggtgagcccgtttctgagaacacctggtatcaatggctgtcccttccaaaccaagcaaaaagtgatttcttgtcggtgtggatttggttttgttattaattttaaaacatacctttgaagacttagatctctgaaactactagatctctagaagtgtaattgtgaaaaaagtttgcttgcatcatcaacaacatgaaaaactctttctaaataaaatttgttttgaagttaaaaaaaagaataatgcaagattggaaactgggaggtctgaagattcccaagagcactctcaattctgaagctaattttcagctcagggaccccaaacagcccttcacttcttatgagtccctagaaggactcacatgactcactgaaaactgtgacattcattaatgtgatttttctacagtgaaataatacagattaaaataattcaaggaaagagacacatgggcagagttcaggagaattccaagcacaagcatccatttgtcctctcccagtggagtaatagacaacgctgcattctgccggcaacaatgtgtgattctatgtaggaagcattgccaaccagcaaagctcacccaggcttggtgtccagaaaaattttgattggtggggtgggtgagagtggggttgttatgtagaccttgatgaccatcctcatggctcacttgagtttccactgaattgacaataaaacttcaatcttcaacctttggtcattttcttttaaaaaattttctaaagaaaattattttaaaaagtctcatataaacgagctgtttatccaatatgaggctcaacgcaaatagtttcaaaaagtcagtaggtcattaaaacaattatttagtcattcaaactaaatatttagtcattcaaacgttgttatctggtgttcagatagcaacgaacaccatgtagcactaaaatcgcattatagtcacaggggcaggatttcagcaacagcaagagaaagtaatacaaacaggaatgagcaaagaatagacaagtaatgggtatgaattggcctgggaaatattgtggcaatgtccaaagacaaatcaatagttatttgttaaagaagtgaaagacaacacattctcagtccaggaaagccaccagggggtggtctgggtctcttggattgtaagaagctcaagaggttcaaacttaatgaaccctgcacagatgctcactgactcatggaaatgttagagcagctgcttcctcccacaggacaaatccacagcacacagccaccctgggctggccccccacagtgtagctgctctcagggctgtggacccaggtggtgataaaggcagtaaagatttgcataaagcagcacacagcacaccccctccgtgcggagagctcaataggagataaagagccatcagaatccagccccagctctggcaccaggggtcccttccaatatcagcaccatggcctggactcctctctttctgttcctcctcacttgctgcccaggttaagagagatttcaaataccagcctttggagggatccctttttctccctttctaattcctaatatatgtctgttttttttgtttcagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcggcacagtgacagacccatgagaggaaccaagacataaacctccctcggcccttgtgatgtggagatcacatgatcagacatgccagatcccaagatagcctacatgtggaccagccatagaaaggggaaggaaagggtttgaattgattcctatttctacttaagtcttgatgtgtaggaaatgtaagaatgatttgggagtaactggatcaaaaaaaaaaaaggaaaagttaattgttttctattctaaaaggaacactaacagcaggatcacatataaaggctgggtcaaaatgcatttcctccagaaagaagcatcttcagtgtataggctttctgagctaagagcaaagaaactttttttgcatattactgaagtttgttttattgagttactttcaaaccaatacctccagaaagaagcatcttcagtgtataggctttctgagctaagagcaaagagaagaaactctttttttgtatatgactaaaatttgctttattgatttactttcaaaccaatacatgcctattatataaaataaaaatattaaaaaccaccaagttcactgcaaagctgtctcatcagaaacaatccaatttcttcatttggatgcattctttcatttttgttctcaatatttccacaatgggggtcataccttgtgctttttctctctggttttacacatctttatgcctcctcccacaccctgtgcctctctcctgactctcagggtcctgggcagtcagggctcacttggtagcctgcacagtctgtctgtgacaaaaccagtcaccatctcctgcactggaatcagcagcaataaggttcttggaattgtgtcctggtaccaacaatgacaaggaagtgcctccaaacttctgatgtatagaagcaaatatctgcctgcagggacccaggatggatgctcgggctaccagtttggcaaggaggccttcccaagcatctctgggctccaggctgaggacaacgctgatctcaactgttggcttcagacagccccctggaggcccaaacagtgctgcagtctgggggagtgagacaggaacatgtcaggtctcctaggagcacgacctaactacagcaccatacaaccaggacagcagggctgtttaccatttgtgtgcatgtttgctggtgcttctgctaaccaggacccagggctcagattagggacagtgatctagagaatgctgctttgttttctcagggccagacttcagagagagcccttggccacagcattgtcagactgcctcagaagaatcagaaagtccttgatttctggaacaggctgccctgggaatacagccatgataggccagggcaagcagggacagaatccagctgggtctgtctcaggcatgtgcactaataaagatctctgtttgtccttattgtttactgaatacctactatgtgccaggctcaggtctcatgctaaggatacagaggtgagaagacagacagggattctgtcttcacaggactgacaccatgcagaaaagtgagggccaacaagtcaataggagtaaggcatattgtggtgtatccaagaggtgacactggccagaagggggagagcaataggaagcccttagggagttgtaagcaaggaagacacggagtctgatgggagacttaggagaaaagtccagcttctccaaagaagatgaaaaaggaggggagagagtgaaagtggagggtctaattaggagacggtagctttctccacatgagagatgaggtctccagcaagtgatgaagcagctgaggtggtgaaatatgcgtgacccacaccatggtgagtaagaccaaaggaaagaggtcactaggttgaggcccaaagcttgttcctgtgatataaacctgacaacatcctcttgccgttactgagtgtctcacacaccttttttctttggatatctcctgggactcaggactcattgctgcccttccctcgtattcagtgagattcatttcgaacatcacttttcacacccagagagagacctggctcctttgtatggagcaaaagcactgagggtcaggacagaacattctacagaacatgggatgatgccttacacactaaaggactgctgttaaagctcgtgatcaaacctccctggagctacatcagaaaccacgagaggggaggtgtcagcgcttaggtgcctgatttcagggcacactaatttgcagtttgtccagctccctcccaggcatttttatccacccctctctttacctcctttcatccttgcctccttctcagggcgggcctccaggcctgtggtgtctctgctgctctgtctccatcacaaacagagcagtagggagattatctgataatgaagttccctcctcatactcagttatctggttccccttaggaattcttctgcatcatgggaatgttctgttttatttctgccctacagtaggaacccagccatttgtgaggccaaggagattgacctctttccgttgaagcaggattatatttaacacatgtattcaaataacatcatcaacttatgaacaagtcaatccattcttcagaattatagaaatgcatgtctctcagctgtcagcaattggcctcagatccctagattggcgaacttgtcagggtggggtcagccacatgaagatgtttctttatagttagtgactctattcactgggtttcccctgttgagatccaacctccatgagactgtttatttttgttgttgttttctgtcttgtcattgcccaaaatgctgcctggcactaaggaaagacttaatacatgtttattaaatatgtgagttcacctacattggaatcccaaaaagaggtacagatctgaggtcaagttaataatttttaaaaaaattctggatattttgtgtttgagattccaagttcattcaatagaagatattaagtatgaagttttgcctttggatttggttagcaggagaaggatatggatatgaaaatacaaatggatcacacatacctccccatggcccagagtcttgagtgcctagctgctctctgcagctcctaatcacagcctctgttcactcatttatggtctgattcccatggatccatacatgctggatcccatgggcttatgtggagaaagtggagagaaggtgatggccctgctaaaaaaaccacaggaagcaagttgataatgaagcaaattctgggcacaaaatctctcaagagcaaataaactgcagaatatgggtgagttgggaaaatttctggcaatatttatataactaagaaggtttacattacatatacttcaacaaaatattaattctaaagcttccaataagtcatatgatcaatgcaattcaaacattaaactcatcagtcccaagtcccataatagactttgatggagaaattcttgaaggaagaatgatgggtttgtgagctctgtgtccacagaagagatatttctgcactaggaggactgggtaaagccattaaataattatgaatgtagtgcccatctggacttttttctaatccaatatgcaatgctgtgggctctgcctttgcaaatcgtagcattcattgtacttcctccagtctcccaattattacaataaattaattttaaacatgaatgattaaaagacaaatctattaatgttagagtccttggaatctgttgctttaatgcacaagaattatggaacacttcaaatgtatatatttgttaatttatgtaccaatgataaaatactgcttccttgatctgttctaaaaatcacctagaaagggagtaagttgatgggtaaaatgggttgaaaaattaaacaagatgaaccatattgatgatggtcaaagttggctgattggtgcaaacaattcatcagaaaattctctgtatatttgtatgactcaaacgtttccatgctaaccagtgaaaatatccttttttgcaatgagatgtttatgttctgcttttaccaggtgtacaatgtggacaaaatgtaagcttacactttgacttcaagtggaagcccatcttctcccaacaggcagaggagaagctggtgtggagaacatggaaaacacaggagctcagggtttcccaggacagagaagtgagtgagcctggagccctaaaagcaagggcaggggctgtgagttgggctgtgggggtgttctggggccacaatgtgaagggcatgttgctgaggtctcagggttcaggtttcataataacaacgaggagttactcaaggggcttaaaccagggagtgccctgcctgccctatctgagtgacagggatctctctgaatgccttgagaagagagtgtctgagaaaagtgagtgatcctgattctagattattcgctaaagcacctcgtgagtctagaaactcaggggccatttgcacagttagcacaagagtagatgtggctaaattgagaagtgatggtctctgcttttgtctcctgagacatccaactcatttgcaagagaattttgcaggtaaaatacatactgatctttctaataaactgaaaacacctagtaaaaaaatacacgtggtaatagcacaatgcaatttgtataacagctagaacaaattcttgaccaaaaaatatgatgcaactgtgcagaaaatgacgttttacttagggagataatggctaatttcataaaatagtgaaatatgtcacactgttcactggtaaaggtaagtctagcaaatctattagttttcctgtatcacaaaatcgaatcaaatctctttaaaacgtatgaaaccattgtaaatataacttgtgttgcattgctgtctttttttttttttttttttttttttagacagaatctcgctttgtcgcccaggctggggtgcagtggcccaatatcagctcactgcaagctccacctcccgggttcccgggttcacgccattctcctgcatcagcctcccgagtagctgggactacaggcgcctgccaccacgcccagctaatatgttgtatttttagtagagacggggtttcaccgcgttagccaggatggtcttgatctactgacctcgtgatccgcccgccttggcttcccaaaggaattgctgcctttaacatgtcattgatcctttatttttcctggaaatttttcattattcaccatctttttgaacaaccccagctgcccttcaacccagctcctcagctgaccccttttccatgatgcccactctgatgacatatgtgggcaaatagatttttctaaaatgccctgttggggtgctgacacctataaaagttatgtatgtacaggtctgcacatcccacagaccaagactacttctgggagtgagaaatcgtagtaataatgcatagcatgatagaagcagtgtctgggaatcagaccatggatatgtgaatacagacagtgactaaagagctgcagagaccagctgggttctgaagtctctgagctttgggaaagtgtgtttcctgggaccagcgtcagatgttgtggggctgccctgtggttccgacacagctgctcagtaatgagcattcactcagagaaatccaggccttgaggctgggccctgtgctcactgatggacactcggcagctgtgtcccctctggcctggcagagttccctgagcagggacctgtgtatggtctcaacaggtgcttcctcccagggccttgcaaaaagaaaagcaagccttcctcctgctcagtctgcagagagagctgagctgcatccccaggtctcaaggaggggcccggcagtccctgggcggaaacacatttgcatgagcaacccctcctctgcaacagtgggaagaaaaggaggcctggggcagcccagtcccactgcgggggtaagaggttgtgtccaccatggcctggactcctctcctcctcctgttcctctctcactgcacaggtaggaatagacttcagagaccagggtcagccacccagcctgattctgactcttctggcaaagatccctgaaaaactttaccctggtttctgccttagcacccattaatgtctgtgtttccaggttccctctcgcaggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttctcacagtgacacacacagatggggaagtgggacaaaaacctcaccctgctctgggtcttgctctgtaccaatttttaaattttaaaataactggcctaggcacaaactatatttggaagtactttctagttgtaaaaggctcttctctcaattttctatccatttttctgaagtctcagtaaaacaaaacaaaacaaaacaaaaccacctgatgaccctgaagtgttggctggttgtccacatgtgctaacaccagtgcctgtggagctggacgtttttttcttgaaagaagcaaaatgaggctttcctagctcacatcatggtcagagcctggggacaacatagcaggtgaacagtgccctgcagcatggactctgctcttccagcgtacgggcagagacctccccttccatccccagtagtctgttctcagggctgtctgaggctcactgtgtcccaggaacaaggcactcaaatatgaaatgctgcctgaggactcaggtcagggaattctggatatagtgctgacctggctcagtcctgggtacctgcatttcagtggcaatgtcaggagatggcgttagatattagggtaactgcgggcccgatgccagtaaacctctatgtaggacatgacagaatcaaggggaggctccaccatggctgagacaagccagaggctgctccttggccatgggggaagtagatcccatggatgtgactcctgtagctcatcccactcaggaccacggggactgctgagggtgggtttcctgatccctcagggcctgactgtgttctcttctcctctcttacaccattggagcttctcactgactcaggtctagtggtgagtctgtggaatatctggatacagaaactgcccaatatttgcttcaagtgactcctccctgggaaactcttgaggaggcccccacctcaaggtcatctttttctccatggggagcagcagaaacattggccattcccatggaaatggctatgaggcctcccagagagaacccctaagtttatgacctaggacaatagtgatggtccctcaggggtcccagcctgcttctcctgatctgggtttatccacacagcctcctggagtgcctctgggctccagcctgaggacctggctggttatcagtgtcacacagctgcatcctgactccatgttaccaagggttcctgttccatgtggaaatgatagaaagatctccccactcatcctgtctccccatccctcctttatccctgcctgtgaccaacaccagttcatgccaagacttcagctgtcagttgtgttactgaaagcagagcaagggttcagggacgataactccttttcttactggtctccccagtggaaagagaatcagtttgtttcaagaagtaaaataagctgcccacacatggtgggtgaggatgaggtggaaatgacaagaaagaatccagcctggctgggcatggcagctcacacctgtaatcctagcagtttgggaggcggaggtgggtggatcacctgaggtcaggagtttgagaccagcgtgagcaacatggtgaaacatcgtctctactaaaaatacaaaaattagttgggcatggtggctggcgcctgtaatcccagctactcgagagactgaggcaggagaatcgcttgaaccagggaggtggaggttgcattgagctgagatcatgacactgcactccagcctgggcaacaggcagagactccatctcaaaaaaaaaaaaaaaaaaaaaaagaaagaaagaaagaaaagaaaaaaggaaaagaaagaatctaggcagtgtgacccagaagtccaggagccttcggcctggtcccacaggtgtcccctcctttttgaacaggtatgctggccatttgctgagctctgaaactgtgggagtgataacaagaaaggcgaatccagcctgtgtgacccacagatgtgagagaggtagtctgatgcttaagaaaaggtgggatcagccttctgaaaggtctggatctggcttggcctagagctggtgtagaagagaagcaagagagatgcttagccttgggtggcccaggcccagctgtcctgtcaaggggctgagctctctgcaacatggaaatcctgcagagccatccttgggaggctgtgatctcagtaggatgcaaaaatgctaatggaagtgagcaggggatggtttatgggggaatgaggggacggtgtggggtcaggtgtggtaaggagggtgcaccctgaagaggagagtgtccattgtgactcacaggaggaggaggcccggggcccagagcagtgacaaaaggaggacctggaaggacctgggccctcaagacacacagagactggggttttggtctgtccctgagggtccctcaggaggatcacataaaaaatccatagtcagtgtcctctgtccaaggctcactgtcccagctgttgtccctcccggatcctctgggtgtccacatcctgtagttttggacctgttcttctctctgccctcaacctaacagctgatggggcatccaccaggaagcgcatccgtgggcagggaggaggccgtgggcagccttgtcctgtatgtgagacactgctcagactcggtgaccccctgttcattaacgtgggaggaaaggaaaacaaaattcactgtgaacatctatacatcatcaaagaaaaagcaatgagaaaaaacaggaagtgaagcccagctctaatagtttatttctacttggaaataaataaaacttaatatgcctgatgtgttatgtaaatacaacaaacatattttaaaaactataaaaattatgtaaaggcacatggcttacactaaaagaaacatttaaaataacaacacccttgaaatgcaatcccaaaacacagcatacattttatttcagttccatgtatggactggttttatttaaatgtctgtattaggtttcactatttggttgtttaaatggagcatttaaaatcttattgtattacaacttatatcaacataatcatcttgctgtttttctgtatccccttaaaattccctaaacaaatatttattaagagcccagggtgtatcatgccagaactcaggcagtcacagacataacctgtttcatttttcattttgatcaacagaattatgttttctgttaagcttgttgtttttagttcattagattctagacgtcattacagatcaaagacgaaaaatttctatcatctttaagccacccccacaacactcactactgaatttgaaccaaaatcttctcctagaaatcctcgttggcggctcgatagtaagagctgccatgtatcaggctcacctgaggacagacgctggttaaaccaagttgaagttttaattcttcccatcttcaaagactgagcatctttgctctttttgctcataagtgaaacactccaaagtcatttgccaggatcccctgtagatgggcattcagtgtacagactcctaggcaagatccctggtcacagtatccaaatgactttgactgcaaacctggggaagtagagagagaacaaagatttaccagaaaaaccctctgggaatgtcttcccaaggcaccctagagggaagagctccctttctcttcagctccacaggatccacagaggaaggagagctctagccagcaggaaggagccacatgagaggagaggaccaggtgtcccacacaggtggggaagtgagtccatggggctggtccccgctctgggcttgatcctgacataagaggactctgtgtagacaccacctgagtcctctgcaatgtacagccacagagccatggacagattcactcctgaggagtccagtagagcgcgaagactgccttgaggtcacagcgggaagacacaggtgtcacttgagctggcctggacctgagagagggggcagtggacagaacagaggggaggcagtggtgtgaatgagaggctctggtcaccttatcatagaatggtttaccttggctggacaccaggggacgctgggggaccatttctgagaagacgcgcggggggcgggggtgggcggtgatgggagcacaaccggccacctgttgtgcctgttgtcctctgctcagggctcacaactgtgttctccccaccctctgggaccacagagctccacccctgccacaccctgacatcctcaaggcaaggagcctgacccagggctcagggtggggtcacaaagctgggggggtctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcaggtgacaggatggggaccaagaaaggggccctgggaagcccatggggccctgctttctcctcttgtctccttttgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcccacagtgctccaggccaatagggaactgagacaagaacccccttcctcctctgtcaggagggtgagccccagcagctgctgctcaggcctggcctgtggcttctgctgctgcagcttccttcatgggtccaggggcatccagggccctgcctgagagtggaggctcctcctccccttcagtcctcagagtcaggaacaggacatccaggaaacagaacatcctcctccctgcagcttaggacacagggtctctgcactgaagtcctgggctgaggtggcaggtccagttgtgtcatctcagacccacctctgatggggaacccgtgtctccgtcatcctccttttcccatttccaggagtttccagagtggtgtcttcctccccctgctcctcagtgtgaatccctgtgcttcctttctctccagcctattcttttttaataaaactcctttcatgtaggaactatgcacatctaataaactacccatatttataacaggaaattagacaaattttggcatttttctggttccttgaaaacatcaccatccccgggagctattgtgaccatcccggcagctcctcatgatgcttgtctcctccctccctcccctaatggcctctcaggaagccacagatctgcctctctcactactgtttggtttttttttctggaatgtatcagtgttatcaaacgttatcttcccatttgttcaggcttctttcactctgcacacttgctttgagattatccctgctgtcgctgaattgcacccatcccttagagggctcattactatctttaagggtccttaggccatttttttctgattttattcatgtatttcctttaaagtttgaatttattgttcatcaaacaaactctatgggtgatgttcatctaaggtgacaggacagtccgtgatggtttgtcaggattcttgcttcttcagttcttttcttggctctctctatagtggaagaggttctcatcttttatttatttatttatttattttggggtttttttaagggttttagcgattttccctttttaattatttttaaaatttgttattttattttaataggtttttggagaacaagtgttgcttggttacatatataagttcgttagtggtgattcctgagattgtggtgcactcatcatccaagcagtgtacactgtatccaatgagtagcctctcatccctcacctccctcctatgctttcccccgagtccccaaagtccattgtatcattgttatgcccttgggttctcatagcttatctcccacttatgagtgagaacatacagtgttttgttttccattcctgagttacaccagttagaatgatagtctccagttccatccaggttgctgtgaatgccattattttgtttatttttatggctgtgtagtattccctggtatgtgtatgtatacatcacatttgctttacctacttgttgatttatggacatttgagctggttccatgtttttgcaattacagattgtgctgctataaacatgcgtgtgcaagtatctttttttgtataatgacttctttttctctgggtagatacctagtcgtgagattgctggatcaaagggtacgtctatttttgtttccttaaggaatctccacactgttttccacagtgattgtactagtttaccttcccaccgccagtgtgaaagtgttttgttttcaccacatccatgccaacatctgttatttttttattatagctattcttgtgataggaaggtggtaacacagattgtggtaccgatttgcatttccctgattattagtgatgttgaacatttttctatatgtttgttggccatttgtacaagttcttttgaaaattgtttattcgtgtccttagtccaccttttgatggaagtgtttatttttttcttgataatttgagttcttcgtacattctagatattagtcatttgttggatgtatagattgtgaagattttcatccactttgttggttgtctgttaactctgctgattctttcttttgctgtgcagaagtttttttcgtttaattaagtcccatctatttatctttgttcttgttgcatttgcttttgtgttcttggtcatgaaatatttgcctaaaccaatgtctagcaaggttgttctgacgttatcttctagaattcttaccgtttcaggccttagatttaattatttgattcatcttgagttgatttttgtataaggtgagagatgaggatgcagtttcattcctctacatttggcttgccaattatcccagcaccatttgttgaatatggtgtcatttttctactttatgtttttgtttgctttgtcaagcatcagtgggttggaagtatttggtttcatttctggattctttattctgttcctttggtctgtgtgcccatttttatatcagtaccaagcagatttagtgactatggagtcaaactttactggagtttgaagctgggtaatgcgatgcctccagatttgttccttttgcttagtcttgctttgtctatgcaggctctttttggttccatatgaattttaggattattttttccaattctctaatgaatgatggtgatattttgatgggaattgcatagattttgtaacttgcttttggcagtatgatcattttcaatgtattgtttctacccattcatgagcatgggatgtgtttctatttgtttgtgtgtgtcatctatgatttctttcagcagtgttttgtagttttccttgtggaggtctttcacctccttggctaggtatatcctaagtatgtattttgcagctatttgcgaaaggggttgagttcttgatttgattttcagctcgtttgctgtcattgtataacagagctactgattcgtgtgccttaattttgtatcttgaaactttgctgaacttatttacagttctaggagctttttcgatgagtctttaaggttttctaggtatatgatcatattatcagcaaatagtgacagtttgaattcctctttgtcaatttggatatctttgatttgtttctcttgtctgattgctctggctaagccttccagtactatgttgaatagaagtggtgaaagtgggcattcttgccttgttccagatctcaggagaaacgttttccacttttttccgtttaatataatgttgactgtgtgtttgtaatagagggcttaatagaggacataagttatgtcttttctatgtcaattttgcaaagagttttaatcatgaagtgatgctggattttgtcaagtattttttctgcatgtattgagataatcatgtcatttttgtttttaatgctttttatgtggtatatcacatttattgactcacatatgttaaaccatctctgcattccctggtttgaaaaccacttgatcattgtggactatgtttttgatagctgttggatacatagaataatttaggaaggagtccccctttttccttcctgtggattaatgcattagtcagcgttctctagagggacacaaataatggaatatatatatatgtttattaagtattaactcacatgaacacaaggtccaacaataggctgtctgcaggctgaggagcaaggagagccagtccgagttccaaaactgaagaagttggagttccatatttgaaggcaggaagcatccagcatgggagaaagatgtaggctgggaggctatgcccatctctcttttcatatttttctacctgcttattttctagccatgctgtcagctgattagattgttcccacccagattaagggtgagtgtggctttcccacccactgacaaaaatgtgaatctcctttggcagcaccctcaacagacacacacaccaaggatcaatacttttttttttttttttttggagatggagtcttgctctgtcacccaagctggagtgcagtggcgcgatctctgctcactgcaagctccgcctccagggttcaagcaattctttgcctcagcctcccgagtagctgggactacaggtgcccaccaccatggccggctaatttttttgaatttttagtagagacggggtttcaccgtgttagccaggatggtctcgatctcctgacctcgtgatccgcctgcctcggcctcccaaagtgctgggattacaggcgtgagccactgcgcccggccaatactttttgtccttcaatccaatcaagttgacgctcagtattactcatcacaagtccactccttgtcagcatgaacccatatacaacttgtgatatcgtacataatcttcaaataaagacaataataaagtcataattacgcctaacataatacaattatccttcatacaaccagaacgcacgaatccctaacacaaatactattacatcaagttactgatacttaaatgctgatgtgacgtcaataaatcttatgttatatgacaaaggagaaaggaaataaaatgaagatattttcttagtacgagtttatagatgcgcaaacatgtttttaacaaaagaaggaggaaatactcttgacaattacactcctcgtttctgccgctggccatagctggtattgatgactaccttcttctactacccattctgtattccctttgccttcagcaagcacctcagtaggttgtgttttttttcctggtggagtgacccaaatcttcattcctgaagggtcccattgaccttaatcacagggcatggtaatagcaagaaatgccctaatgcatctcctgtattccatgcatgttcttcagtaactccattgtggagtagtaaactgatttcattttgatagtctgggtcaatcaccccagccgacactgtaactcccttcttagccattgacttaaaggtaggagaagcccaaaatgtccaggtggcaatcttaacttccagtttaatggaatcattgttgtgtctccaggtggtagtgttccttcctctggaagtaaatcctttgagccagcagaacataatgtctcaggaacaggaagcaaaacatttgctagtggatcactagggttgatggtgagtggtgccacttccacttccaccccttgattcctggatccatgaatcctggctacaggagggacagtaccatatattggatgctgatttaaagcatacacagccatctggagaactttgccctggccctgcaaagtattgtcacctagttggcaatgtaattgtgacttcaaaagccattccactgttctatcaatccagctgtttcaggatgatggggaacatggtaagaccagtgaattttgtgagcttgagcccactgctgcacttctttagtcataaagtgagagcctttgtcagagcattgttgtgtggaatatgatgacagtgaatgaggcattccaagagtacacggatggtagtctcataggcaaaccaatatctaggataagtgtctatttcagttaagacaaacctctgcccttcctgtgatggaagaggtctgttgtatttctcctcacacagggcaccagttgagatattgctcctcagaagacagcattagctgcgggggtctgcctgcagaccctgactcaaacgacggatgaataaaaacggacactgacacacagatattctgtttggccagtccggctgggttctttgattctgagtgtccgacaacatacacaccaggagaggtttgtcactgtggtgggtcctgagcagctggtactccaggcatttatttagtatacaattaacaacagaagctttgagtaaacacacttgtggataattaacatggttaagagagtagttctacgaatgattaaagctcaggtaccctggtctaaagtaaataccattacggggcaatatccctggttgacctcccaccgagagggccatctggctcaaaggttagttaatggagatagggtaaacaggcttaactgggaaagcctccattgtccctagcatttaccctatgacctaatgctctaaggtaagaaccagctgccttcagcctgtacaattattacaagctatgtaacattttagccttccaaaatgtttgtgattattccctataactttccctaatatttccctttgatatttctgccaccatcctgagtgaatcccaacagaggtccaatataatcaacctgccaccaggtagctggctgataaccccaaggaatggtgccacatcaagggctcagtgttggtctctgctgctggcaaattgggcactcagcagtggctgtagctaggtcagccttggtgagtggaagtccatgttgatgagcccgtgtgtaacctccattcctgccagcatggccacttccctcatgggcccattgggcgatgacaggggtgtctggggaaagaggatgcgtggtgttcacagaactggtcatactctcctcttgattattaaaatcctcctctgctgaggtcacccgttggtgagcgctcacatgggatacaaatactttcacagtttttgaccactcagagaggtccatccacatatcttttccccaaatttctttgtcatcaattttccaatcatacttcttcctagtccctgtgacagttactacaggacagaatgaagggggactaacacagaaatgaagacaaagacaaagggatctgttttaaagaaggggtcagggggctccttgcttctagtgagcaagggccctgagctactgcaatccttcatatttattaggtagaaagaacagggaggaggaggtaacagttggtcagctgcttgatttatcacaggttcacaggattgctttctttatacaacatacttcagatgtgctgcagataatcaaaagaaacactgtgcttggggcgtgacggctctcagcattcgttctggtggtagatgcagtttgtcgtttgccaacaacctgcattcatgagaacagcttgctgtttgctccagtggtatactgagttggtcacgaccctcattctttcggcctccaagaagtccctgatcgtccagccaaaccgttgactacagcaaataaattcatatataatcacacatctggagatttctccttccatgcaaagagcacaaccaggtgtgctcctcaaagttctgcccaatgggaagatttcccttcaccgctgtacttcagggatgtcctggaaaggggctgtagtgctgcagctgtccactttccggtggtgcctgcatatcatgcagatacatttgtgaaccaggccctagtcttctttctgtcagctgatcatagtgaactgcccctgagaccaccagtgcaggctgggggatagtgcaggctggtggcaggagtggaggtcatggacatttgagccacttccccatgtaacttacttgtgccttcagcccaaatacgtatataccacttccactgaatgatggaatgctgctgtgcatgatccactttatggctaaatgggttagaaagcacccacttcatgacaggcagttcaggttgcgtggggactttaagacgcatagtcaaatgttcagtttccaccaaagcccagtaataggccaagagctgtctctcaaaaagagagtagctacctgcagaagatggcagggccttgcaccaaaatcctagaggcctccactgtgattcacttacagtggcctgacaaagactccaagtagctttgctatctgccgctgacacccaaataccattgggtctgttgggtcatacggcccaagtggcagagcagcttgcacagcagcctggacctgttgcagagccttctcctgttctgaatcccactcaaacctggcagccttttgggttacttgataaatggactggagtaacacacccaaattagagatatgttgcctccaaaatccaaataggcccactagccattgtgcctttcttggttgtaggaggggctaaatgcagcaacttatccttcaccttagaaggaatgcctcgacaggccccacaccactggacacctagaaattttattgaggtagaatgcccttgaattttagttggatttaccgcccatcctcttgcatgcaaatgtctcaccagtaagtccactgtgtttgctacttcttgcccactggatgcaaccagcacaatgtcatcaatttaatgggtcagtgttatatcttgcaaaagagacaagcaatcaaaatttctttgaataagattatgacacacagctggagagctcatatacccctgaggtaggaccgtaaaagtatattgctggccttgcctgctgaacgcaaattgcttctggtgggccttatggaccggaatggagaaaaaggcattttccaagtcaatggctgcatatgaggtgccaggagatgcattaatttgctcaaacaaggaaaccacatctggtacagcagctgcgattggagtcaccacttggttaaacttccgataatccactgtaattctccaagatccatctatcttctgcacaggccaaatgggagagttgaaaggggatgttgtgagaatcaccacccctgcatttttcaagtccttgatggtatcactaatctctgcaatccctccacagatgcaatattgtgggtttatttttttttaataaagtttcactctgttgcccaggctaaactacgatggcagaatcatggctcactgaaacctccatctctggtttcaagcaattctcctgcctcagcctcccaagtagctgggattacaggtatgtaccatcacaccccacgaattttttgtatttagtgtagatgaggtttcaccatgttggtcaggctggtctcgaactcctgacctcaggtgaggtgatccacactaagatccagcttatgtggatcttttctcttcttttcttggttaatctcactagtggtatatataattttatttatcttgtctaagaattggtttttgtttcatttatcttttctatcatttttttgtttcaattttatttagttctggtctgatattgctatttcctctcttctgctgggtttgggtttgcattgttcttgattctccatttccatgaggtgtaaccttagattgtctgtttgtgctctttcagactttgtgatgtacgtatttaattctaaacattcctcatagcactgcttttgctgtatcccagaggttttgataggttttatcaagatttagtacaactgcaaccttactattggccaacggcttttgaattcctaagagtgtgacctcatttaatcctgacaacagctttatgattgcttttcattcagtaggtcgtgattagagagggagtgcttgtggcctggatggaaggttctccagtttatcaaataaaaacaccgaaggtcagttaaatttgaattcagtaaaacaatgacaaagaattagtatgtgtaactcccacacaatattgttcatttgagatacaaacttaccttgtagttcatctgccaactgcacacagggttcaaagcctggaagaggcagagttagagctggtcttctcttcctgatgccaggtctatgagctgaacctcaaagacagggcttctctaacacagctaccctcaagtaagcacatcggttagcactaaatacacagtatacgatgcccaatcaataatgcctactcacttttctaattcttctttctattattcttcaaatctgcagactcaagacctcccgaaacattgcggcagccaggattttgaatgagggtcctcatatgtctttccaaacaagatgcaagggtgctccttggtccctacacagaggggcttaagccaggagtgcataagtaacatgtaagagacagaagaactcaacctggctctccctctgtgcagtgaaacacctaattccagggttctttgattctgaaggtgggtgggctgagagaaagaggagccccaccctgagagctccgagtattcaggacaagacttggcagcctgaataggggctatactcttgagtgtggaagaagcaggcatctctgggcacaggctgcttttctggtggcttctccttcaccaaactgggctccctgctgtgatgtctatcagagaatctccttcagtaagaccaagattccaggatttaactaaaaatagcagcacagaccagaaaggtatgtcatggtacttgaattctgtgcagagcaataagtacaaatgcagcttaacaggggccttcagagttgtatctttggtgaaggagaaaatagacaatggcagggagaaactgaaggactcagtaggtctggaactggggcagcactgggtgctataagcttgtccttcaggggtctacagatgctgacacctgggaagtcatcctgcatcatctgctcactgctcactgggctcagcagctatgtcctcacaaataaccagattcaatcaacctggccttctccacccaacctggggaatgtattccagtgactgtttcaactgaggttctatgaaggggttgggggataagaagaggggactgatttgcttgaagaaaccattgcacaccctttcctttcatctaaaacctattaatggaaactctgaggccacccatagaagtctagctggtcttctaaatttgggagttacgaaggagtcattcctgatcaatctacaggataaggggccatcagcagctggtggtcagagtgaggaagaaaatggcttccttgagagactcatcagcacagccaccaactctggggaaaatggggcacttgctataacagtcaccccaaactactcacaggagcctgagcctcgtcccctcaccttattgtttctgattctggtccatgcctctgttttccctggacccctcgcccatgtctgagtccagggtagcaggggtagttccatcccagtcaacatctatacagaagtaacagctgctatggcttgaagccgagtctacagttctacccatgagggcctctttttctccccaatcccctcacacaggtgaccagtgctgtgggtctggtggagtggccactggccactggtcccaggcgaacacaaagtatttattcctctctaacaccaggcatatattggagggggtttggtgggtgtagaacagagtggttcttccagatgcaaagcagtaagaccctgtctacagaaagtcatttcacaaacctccacaccctttcatgataaaaacgctcagtgaactatgaatacaaagaaactaccctaacatagtaaaagctatctatgaaaatcccacagtcaacatcacacataatcttaaagaccaaagatatgtttttgtaatatcaggaacatagcaacaatgtacacttcactgcttctattcaaaacagtattgaaagtcctagccacagcaataaggcaagagaaataaataaacaggataacaattagaaataaaaagtaaaactatctctgttttcaatggatttaatgtcatatgtagaatacccttaaaagttccacaaaacagcttttgtcagaatgattaaatgtattctgtaatgttcagaatacaaaatcaccatgtaaaaacacctcatggctgggcatggtgactcacgcctataatcctggcactttgagaggctgaggtgggaggattacttgggatcaagagttcaaggacagcctgggctacaaagcaagagcctgtctcaagaagaaaaacgaaagaaagagagaaacaaagaaagagatagaaagaaagaaagaagaaagaaaatctcttatatttcaatacttagaaaatctcttatatttcaatatttaaacaaggacacaggaaaaaacccaaaacaaaattaataaaacaaatcaaattgcaacatcattagagagagtaaaatatggctgggcacagtagctcatgcctgcaatctcagcactttgggaggctgatttggacggatcatctgaggttagaagttcaagaccagcctcaacaatatggtaaagcctcgttcctacaagataaaataaaataaaattgctagctgtggtggcacatgcctgtaatcccagctactcaggggtccaagtcacaagaattgcttcagcctaggagggagaggttgcagtgagccaagatcttgccactgtactccagcctgggtgacagtgagacattgtctcaaagaaacaaataaataaaaatgaaacagtaaaatacttaagaataaagttattcaaagaggtgaaagacttgtagattgaaaagtataaaacattactaaaagaaattaaagaatacacaaataaatggaaagaaatcctttgttcatatactggaaaactcagtattgttatgctaacaaaacaaaccaggaggaattgacagattcatttcaatctctgaaaacattccagtaatattttatgcaagaatagaaaaaaattaaacctaaaatatatatagagtatgaagggaacctaaacagtcaaagtcatcttgtaaaagaagaccagtgttggaggtctcacactttctgatttcaaaacatactacaaagctacactaatcaaaacagagtggtatatatgtaacatacatactgacaaataaaatagaactgagtgcctagaaaaaaaactcttagttatacagtcaaataattttaaacaaggttgtcaagacttttcagtggaaacagtacagtctttcacaaatatagacgttctgggaaataatactgaatggcttttgctgttgttgtttttgaatggtctcaaatgttctctcaaagatgctgcagaacatagcttattgattttgtaagttaaaaggctgagtaagactgtgagagactccctgctcatcatcattcttcttccacttccagtgactactcttatattctgtgccataagccaacagctactgaccccaggatcttttaatccttctgtaaaactgtcattaaaaaaaaattgtctaaagtaaattttttaaaaaattctcacttaaaccagctgtttatccaatataaggctcaacacaaatagttacagaaagccagtaggtcattaaaacaattaatttagtcattcaaataaaaatgaacaccatgtaacactaatatcaaattatagtcacaggggcaggatttcagcaacagcaagagaaagtagcacaaataggaatgagcaaagaatagacaattaatgagtgtgaattggcctggaaaatattgtggcaatgtccaaagataaatccacagttatttgtgaaacaagtgaaagaccacgcattctcagtccaggaaagccaccagggggtggtctgggtctcttgaactgtaagaagctcaagaggtccaaacttcatgaaccctgcacaggtgctcattgactcatgtaaacgttagagcagctgcttcctcccacaggacaaatccacagcacacagcctccctgggctggcccctcacagtgtagctgctctcaggcctgtggacccaggtggtgataaaggcagtaaagatttgcataaagcagcacacagcacaccccctccatggagagagctcaataggagataaagagccatcagaatccagccccagctctggcgccaggggtcccttccaatatcagcaccatggcctggactcctctctttctgttcctcctcacttgctgcccaggttaagagagatttcaaataccagcctttggagggatccttctgtctgcccttctaatttctaacatgtgtctgttttttgtttcagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcagcacagtgacagactcataagaggaaccaagacataaacctccctcggcccttgtgatgtggagattgtgtgatcatacacaccagctctcaagacagcctacatgtggaccagccatagaaaggggaaggaaagggtctgaattgatttctatccctccttgtgccctgaagtggaggaaatgtgagagtgatttgcagtaattgaatgagacaaagcaaaagttatttgttttatatgaaaaaaaaaaacagaaacagcaggatcagatctaaaggctgagtctaaatgcatttcctccagacagaagcttcttcaaacgatgggctttctgagctaagagcaaagaaaataaactctccacgggtatattattaaagtttattttattgagttactttcaaagcaatccatgactattatataaagtcagaaagtattaaaaatcaccaagttctctgctaagctaccttatcccatgcaatcaaaataagtacttttcttcatttggatgcattttttatttctgtttttaatatttccacaatggtgattaaacctggtgctcattcctctggtttgatccacctttatgctcttgtcatttaaagttaatgtaagtagtgttccatttatttaaaaggataaaatattttaatagttgatcattgcattttgaactgagtaccagtgaagtattctagcttttaggtaatttcaattgtttgctagtcaatgatgttatacgttgttgtcattaaaccattcctggtcatttctgtggattttgtgaggtcagagaaaatgtctgtgcttttcaatggaaagccttgggtacattattcctgacttcccaacgcacaaaatagagaaacacaaatttcctgctcatgttagttagagcataagagattcaggtacgaggaacaatttataccccaaactacatacagtgtcttcaggcatgtattagaagtgtacttctcaaactctctgatacccttagttctgaagaagctcaaagttggctaatacttttatatttatctttttattttttttacctcagccagcactttctcctgattcctggggttttctgcatttccagtgaatccagtgaatcacacaaataggctaactgattcttcccaaactccagcactctcccttatgtgctgatctagtgaggaatcacatgggaagagagacccatggatttctggcggcctgggaagtgagttcatggctggcctcagcttgcaaaccagacacttgtctccttgtttccctttactgttcattgggttcagcagctgtgtccttccaggtttcctggacagtgatggaccacactctcccaactcccaaccacccgctcctcaaaaggaataaccagactcagcaacttatgtgaggggcacagccaggggtcaggatagattggcattaagtcccctcaattaagagaggccagggaaggggggctgttccccctaatccgtgtggctcaggaagcagagctctagagacatctctaccatggcctgcaccccctcctcctcaccctcctcagtcgcggcacaggtggctggagacagggagtcagggactggcactggcaggaccagggctctgctttgctcccctggctcactgagctgcctccctcaccctgtgtctctctcccgactctcagggtcccgggcaatcatggctcatcaggtaacctgcaccgtctgtctgtggctaaaccagccaccatctcctgaactggaagcagcagcaataaggttcttggaattgtgacctggtgccaacaatgaccaggaagtgcctccaagcttctgactcatagaagtaaatatctgcccgcagggattcaggacagacgctcaggctaccagtcttgcatgaagcccttcctaagcatctctgggctttaggctgaggacaaggctgatcactcctgttggcttcagacagccccctggaggtccaaacagtgctgcagtctgggaaagtgagatgagaacacgccaggtctcctaggagcatgaccttccaatggcaccacccacaaccaggacagctggtctgtttaccatttgtgtggatgtttcttgatgctgccgctaaccagggcccaagacttagttcggggacagtgatctagagaatacagctttgttctctcacagccagccctcagaggaagcccttagcaacagcattgtcagactgcctcaaaaaaatcagtctttgattccaggaacaggctgccctggggacagactcaagatgagtcagggtaagcagggacagaatccagctgggtctgcctcaggcatgtgcactaacgcaaaggtctgttcatccttattgtctactaaacacctattatgtgccagtctcaggagagtgctcaggatacagagtttacaagacagacagggttcctgtctttacagggataatgcctcacagaagagtgagcaccaacaaatcaatgagaataaggcatattgtgaggtataaaatggttgacatgggccagaagacagtgagcaacaagaagctattaggaggttgtaagcaaggagatacagactctggtttgagattcaggaggcaaagtccagcttctctaaggaagatgaaaaaggaggggacagagtgaagaaagatggtccagttaggacatggtggctttgtacacatgagagatgaggtttctggcaagtaatgtggcagctgagctgaggcctgtgctgtggatcccagacgggagccacctgctaggcctaggctggagccctctgcctctgctcacgaggaccagcagctgtgtccttacaggtccttagggagccacagaacagccccaccctggtccaccccatcccaggctcagctttctaggcaagggtcagagtcagggcctagggtgggacttggccagcccaggggaggaggctggtgtgcatgaagagaccctccttcatcctgggctgctggcgaaagtaatagggactgggggagctcaagcccagctgagtgtcatcaggatgcagagctgtgtgtgggtccccaccaaggcctgagctcctccctttctcccccttctcattcactgcacaggtaactagggctagggatcagggctgtgggtgaatggaacgaggaccctgcatgctgccctctcaactgacccacctctctcaccctctgttagtccaggtgtcaaggttctgggcccagtctgtgctgactcagtggtgtgaagagttcctgtgggtggggtaaactgccgccatctatcacacttgaagcagaagcaaggctgggtgtgggcctgtgtcctggtatcagcagtgcccccaaactcctcatctatgacagcagtcattggtctgcacaggtcccagcgaagttctcaggtcccaggttggggatcatggcatccctgagcatctctgggctccaggcagagaatgaggctgattctttcgctcatcttgagacccaaggatccatgattaggcagtgctgcaggccagtgggtagctgggaggaaaaccttctgtctccccagtaatgtgtcttccctcttcagcctccaccccttcagcacaagtttctggggaggagggtctgaagcccgggtgagaaaaagggtcaaggctggccttaggacctggatgggcacagtgaccccctgctgagagggccttcatgagcaagaaggctgggggaggtcctgagttgatttttacaatggaaacagacaccagctccccatccttgttcaaaagcatctcaggaccttttcctctgcagatggcaagggggagaatctccctctgagatacatgagaattcccttcccatgacctgtcctgtcacctggatgaattcgtatttggaaaccaaatgactccccagtgccaggcattacatcctcacagaaaacctgccagaatgagcaagatcttccctccctgacccactggccaggaatctcggacatcaggatggctggactagatcactcatgccatctcccctgacatcatcatggttaccggggggactctctgattaatttgggccacacagtgcctgtccctggcattgcagttggggacgcttacaggctaagtttatggctgggagacctagggtctagaaaggagaggaatagaacagaagctttgcctacatggccccctgtgtgcatcactcttccctccacctttatcctaagttcatgatgggtgatgtctccttgaggctggaacctgggcagtgacatgggcctgtgtgtcctcatctcacaatgcttcatcttgggctccctgacctttctgatattcctataatggatcaatttcaggctaggacacagccatgcccatacaggaggcagtgatctgagaatcaggtagtcttagaagagacagaaagcaaataaacaccctcatgttggcctcctaagcccagaggacataaggaaatgaaaggaattcaagaagaaacataagtggtcactgcccaccatcacctgggcacctgttctccacctgcccctctctcagtgaggaccagactcagaggcctagagaaacacgtcttcatctgttcacaccgtggggtgcctccttctggactcatcccaagactgctgctcccccagcttacctgtgtaactgctgagagtcttcacagggacctggtcacagggtttgggatcaggatcagcctggctttaactcagctgtgaccctgccccttcaggacaaaaagtgaactattagggctctaactgaactctcctgatttacttaaatcttatattctccttctcaatatccttctaggaagttctgtctctacccaataatgtcaggtcatttcctcaggcctagagccatttgatttccagacttctatactcacacttatgctctcattctctgtcatggttcatttactacgcagcagctaatgaggccaaccatgtatctacagcccattgacatgaaaaatggggaggagagggttccttagataaatacagggttagcaaaggaaagtttcttaggaatcacttcaggatccaagaaaattcattccagagcttcgagagtttacaactcaaaaacaacagcataatatatgaggtggtgaatcttcttggccttctcaatgaataacctcagaaatggtcagagaatatgcttcaaaaaggtaagagtatgactttcacaaacatatagtattcacatatgtcaacaattttaattggtttatgtattttggagaaaaacagtatgatgataaataaatgttaaaaagcatttttaaaaactcagtgcttatactccaccaggatagaacctgtgaaggaaatttctgtgttgaagatacactgtcttttagaataatagcaacatagctatgaattttgtcttctcatctcacaatctacaaattaaaatcaccccatttatgtgaaatatctagaaaaatacaggtacatttggacattcccatctgccaccacccatccatcttctcctaaagtggaatccctctgcccccattctgctcctctccacacatctacctgctaacacgtgactcctccctgccttcctttccagatccctagcagattgggcccaccaggggaacaagctcttggacctggggatcaaaagtgcatcttgttggacttctgaggacttgccctgcaagggtctctttctggatcacaatccctctgttcctgggcatccccttttgctggatcctgttatttatctctgtgttactccatctaggtctactctgtggacttccctgcatcttcacctgaaccccaggaatcttcaagtcatgccaatattccctcagttctcctgaaatgtcttattttctcttctcctgagatcccaccaagtcatcccttctgagacccctgagtgtagcagggccctctctggtctctttgcttcaattatgaatgaggagaatgggaggtcctctttgccgctcctacccctgtgttgccatcaggatcagcttcatgaggcagaatgaggctgtctagatcaacatggctttcccaacattgagctctgtgcccagcacaaggtaggtgctcagtaactatttgagaaaacctacatttcatcacactggccacattacactgagtccaggatggggatgaactgggagaagcagtggtggaaatattcctctctctgctttcaggctaagaactgatgggacgttcaccagggagagcatcccttggcagaaagggggccatgggcatccttgtcctgtatgggagacactgctcagcctgggggaacctctgttcatgaaggtgggagaaaaagataaacaaaattcactgtgaatgtctatgtatcatcacagaggaggcaatgacaagaaaataggaagtgcaagcccagttacaattggtttctactttaaaagaaataaaatttaatatgcctggtgtgttatgtaaacacaacaaacatttttcgaaaactataaaaatatttaaagtaacatggtttacaataaataggaacatttgaaataatgacaccctggaaatgcaatcctaaaatacagcatacattttatttcagttatttatcttgactggttttatttaaatgtctatattagagatcactacttcattgtggatttttgtttgtttgcttgtttgttgtttttgagatagagtctagctctgtcacccaggctggagtgcagtagcacaatctcgacttattgcagtctccagctcccaggttcaagcacttctcctgcctcagcctcccacgcacctgggaccacaggtgcgcaccagtatgcctggctaatttttgtgtttttagtagagatggggtttcttttttttttttttttttttttgagaccgagtcttcctctgttgccaggctgaagttcagtggcgcaatctcggtacactgcaacctctgcctcccaggtttaagcaattgtcctgcctcagccttctgagtagctgggactacaggcacccgccaccatgcccagctaattttcacatttttaatagagatgggatttcaccatgttgcccaggatggtcttgatctcttgacctcgtgatccgcccaccttggcctcccaaagtgctgggattacaggcgtgagccactgcacccggcctaagatggggtttcatcatgttgaccaggatggtctcaaactcctgacctcaagtgatccactcacctcagcctcccaaagtgctgggatgacaggcgtgagccacagtgctcgacctagtacattgtttaaatggtgcatgtaaaacctcatggtactacaactgcctggtgacagactcaccagagtaaataactatcctgctgttctccaaccacatgggattgccccaaaaaatatttgttgaatcccaggtgtatcatgccagaactcttgcagtcatatatacaatctgtttcattttaataaataggattatcttttttcttcagtttactgtttttaatgtatcatattctagatttcattacacatcaaagatgaataatttctatcatctttcagacatgcccaaaacactcattagcgattttgaacagtattctttcctaaacatcctagttggaatggttgatcctaaaagctaccacgtgtcaggctcacttaagtacagactctggtcaaaacaagctgaagttttaactcttccatcttcaaatactgagcatatttgcttgttttgctctttagcaaaacactgcaaagtcatttgccaggatcccccgcagattggcattcagtgatggagaacagactcctaggtgagatccctggtcacaggatcccgatgactatgactgcaagtctggaaaagaagagacagaacaaagatttaccagcataaccctctgagaatgtgccccaggcatcccggagggaagagctccctatcgacccaggactgcagaatccacagaggaaggagagctctggccaccagggagcagccacacgagaggagaggacccagtgcccccacaggtgaggaaatgagtccatggggctggtcactgctctcgatttcattctgacataagaggactttgtgtagtcaccacctgagtcctatacagtgaacagccaaggagacatggacagattcacccctgaggaacccagtagaatgtgaagtctgccctgagctcacgaaaaaaatgactcagggggctgcctggcctggccctgatggagggggccatggacagaacaacggggagtgaggggtgtctctgagaggctctggtcaccttgttatacaatggtggtgtacatgaccaaaatggacaccaggggatgcctgcgtaccattactgagaagactgggtgtgatgagagcaggaccagcgccacctgtcctgcttggtgccctatgcttagggcttacagatgtcaactctgcaccccctgggaccacatagccccacccctggcactctctgacatcctcaggcagaggagcctgacccagggcccaaggtgggatcagaaagctggagggtctgatttgcatggatggaccctccttctctcagagtataaagaggggcagggagagacttggggaagctctgcttcagctgtgagcacagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccacggtcctgggcccagtctgtgttgacgcagccgccttcagtgtctgcggccccaggacagaaggtcaccatctcctgctctggaagcagctccgacatggggaattatgcggtatcctggtaccagcagctcccaggaacagcccccaaactcctcatctatgaaaataataagcgaccctcagggattcctgaccgattctctggctccaagtctggcacctcagccaccctgggcatcactggcctctggcctgaggactaggccgattattactgcttagcatgggataccagcctgagagcttgcacagtgctccaggccaatggggaactgagacaagaaccctcttcctcctccgccaggagggtgagtgcctgcagctgctgctcacacctgacctgtagcttctgctgctgtagcttcccccatgggcctcggggcatccagggccttgcctaggagtggaggctccaccacttttgtcctcagagtcaggaacagggaccccaggagacagaatatcctgctcctcagcttgggacacagggtctctgcactgaaatcgtgggctgaggtggcaggtccaactgtgtcttcacagtccttcctgtgcctgcccatggtgtggggacggagtgaggaagtgtgggccattgagcttcactagaggcctgagggagcagaggtgctcccgaagacctggactccttccgtcaccctcctcccatcactctcctcactgtagctgtggccaggtgagggctcagggctacttgaggaccttgctcaacccagggcctccatcccaggcattgtttccaaactctgtaagggctgtctctgaatctgtagaaacatttatttctatgtgcccaggactgggttagagggcaccaaccccaccccttgcaaactgctcatcacctctcagtgaaacaatgaggagaagaaagagttagaaatcagaagcctccccaaggctcccctctctcctctcaaccagcctccccttggcttcctccttccacagaaataaagaggaggcagccacagaaggcaagggaaggtccaggcattataccaggcagtggagccagccagtccccccagatggtggagggaggtggtggaggtgtctgggaccagaaaatagtgaggaccctcttactaaagtgaggaggggtggcataaactgaggctcagatggtggaccagatctcctgagccatctactcatttcttcttgagtttcagtttcagtaagaataggataaaaaaaaagtctgaagaggttcctttcctcagataagaattcgtagaggattattgcccactcaggcattgaggggaggctgagcctccctctcaggccaatagaactgggggctttcatgggaatttgattgtactgaagctcccagactctgacatctaagacttatgctctcgtagcagagcccagcactgataccaaaatggataaaggctgattgataagcctggaatatcctagctgacaccgacttgtggaaaagagaatcaagttagaatattgatgtgataaggtggcatcgcacagtgaggagaggagagcttgtgtgggggagggtagaggagccattagagggttggacaaagaggacacagaatctgaggtaagtttgtgaggaaaactccagatgcttcagagaagatggacaaggaggtaggcagtatgaaggccatgggaccagctctagtcaccgggagtgagtggtgagattcagcaccagtgtctggggaggaggtactgaagcctgggtgaggggagatgctcaaggctggccttaggacctgagtggggcacagtgatcacactgctggggggtccttcaagtgcaagggggctgcaggaaggctcgagctcattgtcacaatgaaaacttagacaacagctccccagacttgttcaaaggtgtcacaggactttttcctctccacatggcaacggggagaggaaaacttatctctgagatatataagatgtttgttctccataacctctcctgtcccctggctgaattcctatttggaaacaaaatgactctccagttttacatatgacatcctcactaaaaaaaaagttccagaatgagaaagatctgccctccctgacccactggtgaggaatctcagccttcaggacaaccagacgaaatcgttcatgccatctcccatgacagcatcatggggaccagggagcatatcttatgggtttgggccacacactgcctgtcccaaacattgcagctggggacacttatatgctgaactcatggctgggagatctggggtctagacatgacaggaagaggaaaaagaccaggagctctgcctaagtagccccagtgtgtgaatcactctaccctccaccctcaacttcagttcgtgatgggtgttgtcttgcgaaaactgacagctgggctgggacacaggcaagagagactctgacccacaaatctccatcgtgggctctctggcctttctgatattctttttgcacatcaattctgggccaagacacatccatgctcatcaagaaggcattgataggagaatcaggtagcctccagagagacaggaagcagataaacaccctcatgttggcctcctaagctcagaggagaaaaaaaagggaaagaagttcaagaagccacactagaagccactgatcaccatcacctcggcacctgtcctccatctgcccctctttcaagtaaggaccagactcaggggacagcacctgcacctccctttctgtccatgcactgtgtagggagcctccttctgctctcatctcaaggcgactgctccgccaggtcagccgtgtcactgctgagagtcttacctcagtcctggtcacagggtcttggatcagcagcaacctggctttgattcagctgtgaccctgccccttcaggacacaaagccgatgattaaagcctaactgaactctcctagatttctcaaaccttagattctccttctctgtgtccctctagaaagtgccacctctaccaaataatttcatgttatttcctcaggtctagagctatttgattaccaaaattctatactcactcttctgctctcattccttgtcatggtccattttccactcaggagctaatgatgccaaccctgtatctacaggccattgtcacaaaaaaaaaaagaaatgagagggttccttagataaatacagggttagcaaagaaaagtttcattaccccttaggaattactccaagatctaagaaaattaattccagagcttcaagagtttactcctcagaaacaacagcatgaatacattaggtagtgaatgttcttggtcttctcaatgaataacctctgaaaggttcagagtatacgtttcaaaaagataagtgcataactttcacaaaaatgtaatcttaacttatgtcatcaattttaattggtatatatatttctggaaaaaaaagcagtatgatggtaaaagaaatgtaaaaaagcctttgtaaaacccagtgcttacagtccaccaggatagcacctgtgaagcaaattttctttgctgaagatacaccgccttttagaataatagcaagatagtttgaatttgtcttcttctctcacaacaatctaaaaattaacatgatcccatttatatgaaatatctagaaatatatctgtacatgtggacattcccatcgcacacctcccatccaggctgtcctaaagtggcatctcctcttcttctgctcatgttctccccctctcctcacctctcctgctgacacgtggctcctccctgccttcctctccagtagccccagcagatcaggcccaaccagtcaacaagctcctggacttggggaacaaaagtacatcttcttggatttctgaggacttgccctgccagggtgtctttctcaatccaatctctccttcccggcagtccacttctcctagatcctgtaatttatctaatcttattcatctgtatctacttcgtggacttccttacatcttcacctgaacaccaggaatcttcaggtcatgcccatatgcccttggttctcctgtagtcccttcttccttcttcccctgtgatgccaccaagtcgaagtctcttctcagaccctggagtgcagcagggacttctctggtctctgccccagggattaagggggtggaagagtggactcctgtgcccttcctatgcctgtgttttcatcagggttagctgcaaaaggtagggattaggctgtctaggtagggattatggcattaggtagggattatggcatttccagagctgagctctatgcccagcaaaagatacgtgctcagcaactacttgacagagacctacctcttatcacatgggacacattatactggacccaggatggggctgaactgggagaggtagctgtggacctgctcctcgctctgccctcaccctaagagctgatggggcatccaccaggaagagcattcctgggcagggagagggccatgagcagccttgtcctgtatgtgagacacagctcagcccggtcacaagatccagatgactatgactgcaattcaggggaagtagagaatgaagattgaccagaataaccctctgggaatgtgccctgggcctcctagagggaagagcttcccttctattcagcgctgcaggatccacagaggaaggagagccctggccaccagggaggagccacatgagaggacccggtgtccccacaaatgggaacgtgagtccatgaaagtcggtccctgctctgggtttgattgtgacctatgaggacattgtgtagtcaccacctgagtcctctacaataaacagtgagagcgccacggacagattcactcccgaggagcccagtaaagtgggaggactgaggtcacagggagaagacacaggcaccacctggcctggccctgacagggggcagtggacagaacagtgcggaggcagtggggtctctagaggctctggtcaccttgtcataccatggtttgtctcggtctggacactagagggcacttggggatcattcctgagaagactgaggttgatcagagcagaaccagccacctgtcctgcctagtgtcctctgctcagggctcacagctgcgtcctttacacccgtgggaccacacagccccacccctgccaccccctgacatcctcaggcatagggacctgacccagggcccagggtgggattagaaagctgggggtctgatttgcatggatggaccctcccactctcagagtatgaagaggggcagggagagatttggggaggctctgcttcagctgtgggcacaagaggcagcactcaggacaatctccagcatggcctggtctcctctcctcctcactctcctcgctcactgcacaggtgactggatacaggtccaggggaggggccctgggaagcctatggattcttgctttctcctgttgtctctagaagccgaataatgatgcctgtgtctctcccacttccagggtcctgggcccagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttccacagtgctccaggcccggggggaactgagacaagaacccacttcctcctctgccaggagggtgagccccggcagctgctgctcaggcctggcctgtggcttctgcggctgctgcttccctcatggtcccaggggcatccagggccctgcctgggagtggaggctcctcctccccttctgtcctcagagtcaggaacagggaatccaggaagcagaatatccctctcccttaacttgggacacaaagtctctacactgaagttctggactcaggtggcagatccagttgtgtcacctcagacccacctctgatagggaacccatgtattcattattctcctttccccaattccaggagtttccggagtggtgtcttcctctccctgctcctcaatgtgagtccctgtgtttcttttctcccaggcctattctttttttttttttttaacaaaactcctttcatgaaggaaaaatgcacacctaataaaccagctgaatttatagcattaaattcggcccattttggcatttttctggatctttgaaaatatcaccaccactgagctatgcaacctctgactaaccccagcagcccttcatgatgctttgtcatctccttcactccccgaatgccctcctgggcagccaggaatctgcctttgccactactgtatggtttccattttctgaaacttactagtgttatcaaacactatcttcccatttgttcgagcttctttcactctgcacacttcttttcagattctccctgctgttgctgaattgcatcccattctacagagggctcattacaacctttgagggtctaggacattctcttctgattctatttatttacttatttattttaaagtttgaattcattgtccatcaaatcaaactctacgggtgatgttcatctaaggtgacaggagtcagtgagggcttctcaggattcttgcttcttcatctcttccctctaattctttctataatgggagaatttcttatctttttaaagtttttctatttattattttatgttggcttttaaggtttttagtgttttttaaaatttttttatttcaataggtttttgggaaacagatgttgttttgttacataaataagtttgttagtggtgatttctgggattttggtgcactcatcacccaagcagggaacactgtacccaatgtgtagtcttttatccctcaccccatcccaccctttctcctgagtccccaaagtccgttgtatcattcttatgcctttgtgtcctcatagcttagctcccatttatgagtgaaaacatatgatgtttgcccttttattcctgagtgaattcacttataatgatagtctccattccatccgggtttctgttaatgccattatttcattcctttttaaggctgagtagcagtctacatatatatatatatatatatatatatatatatatataccacatttgcttcatccactcattgattgatgggcatttgggttggttctatgtttttgcaattgcaaattgtgctgctataaacatgagtgttcaagtaattttttcatgtaatgacttcttttcctcttggtagatacctagtagtgagattgctggatcaaatggtagatccagttctttaatgaatctccacactcttttccatagtggttgtactagtttacattcccaccaacagtgtaaaagggttcccttttcaccacatccatgccagcatcaattattttaatttttttattatgcccattcttgagggagtaaggtggtattgcattgtgactttgattttcatttctctaatcgttagtgatcttgagcattttgccatatgcttgttagccatttgtatatcttcttttgagaattgtctattcatgtctttagcccactttttgatgagattgtttgtttttttcttgctgattagtttgagttctttgtagattctggatattaatactttattagatgtatagattgggaagattttctttcactctgtgggttgtcagttaactctgctgactgtttattttgctgtgcagaggctatttcatttaattcagtcccatctatttatcttcgtttttaatgcatttcattttggattcttggttataaagtctttgcttaagccaatttcttctagaatttctaaggtttcatgtcttagatttaagtctttgaccaatcttgtgttagttttgtataagatgagagatgaagatccattttcattcttctacgtgtgacttgcctattatctcagcaccatttgttgaatagcgtctccttttcccactttatgtttttgtttgctttgtcaaagatcagttaactctaagtattttgcttcatttctgcattctctattctgttacatcggtctatgtgcctatttttataccagtaccatgctgttttggtcattatggctttatagcatagtttgaagtcaggtaatgtgatgcttccagatttgttatttttgtgtagacttgttttggctaccggggctctttcttggtttcatatgaattttagttctatgaagttctgtgaagaatgatggtggtattttgatggaaattgtattaaacttgtagattgttttggcagtatggtcattttcacaatattcattctatacatccatgagcataaaatgtatttccatttgtgtcatctgtgacttctttcagcagtgttttgcagctttcctggtagaggtctttcactttcttggttaggtatatttctaagtattttagttttttggcagctattgtaaaaggggttgagttcttgctttgattctcagcttggttgctgtcgttgtatagcactgctactgatttgtgtcctttaattttgtatcctaaaacttgctgaatactttcactagtgctagaagcatttggggtgagtcttcagggttttctatgtatacaatcatattatcagcaaacagtgacagtttgacttcctccttatcagtttggatatccctgatttctttctcttgtctgattgctctggctaagacttccagtactacgttgaatagaagtggtgaaagtgggcatccttttgttgttccatttctcaggggaaatgcttttaacttttccccattgagtataatgttggctgtgggtttgccatagatggcttttgttgccataaggtatggtcccttctatgctgattttgccaagtttgaatcataaaggatgctggatttcgttagatgccttttctgcatctattaagataatcatgtgattttgtgttttaattctgtttatatggtgtatcacatttatcaacttgtggatgttaaaccatctctgcatttctggtataaaagcaatttgatcatggtagattatctttaagacagctgttggatttgggtagctagtattttgttgaggatttttgcatctagattcatcagaaatattggtctgtagtttatttttgttatgtcctccctggttttggtatcagaatgatactgtcttcacagaatgatttagaaaggattcccattttctctatgctgttgaatagagtcagaaggattggtaccagttcttctttgaatatctaatagaattcagctgtgaatccatctggtcctggattttttgttgtttgcaattttttttattaccatttcaatctagctgcttgttattggtctgttcagagtttctacatcttcctggtttaacctagtagtgttgtatatttccaggagttcatccatctcctttaagatttctagtttatgtacataaaagagttcatagtagcctttaatgatcttttgtatttctgtggtatcaatagtaatatctcccgtttcatttctaattgagcttatgtgggtcttctctcttcttttcttggttaatctcgttaatggtctgccaattttatttatcttttcaaagaaccagctttttgtttcatttatcttttgtatttttttttgttttgacttcatttagttctgctctgatcttcattatttcttttcttttcctgggtttgggtttggattgttgtggtttctccagttctgtgaggggtgaccttagattttctacttgtgctctttcagactttttgatgtaggtatttaatgctataaactgtcctttaagcaccacttttgctgtatcccagagcttttgacaggttgcattaagatttagaacaattgcaatcttactatcaatcaacagctttttaattcctgaggatgtgacctcatttaatcctgacaatagctttattattgcttttcaggcagtagaccgtgattgaagaggtaatgctttgtggcctggaggtaaggttctaaaatttatcaaatattaaattggtgcacaagtaattgcaggttttacaaataaaagtaatggcaaaacccacaaggacttgtgcaccaatgtgatataaacactggaggtcagttaaatttgaattcagtaaaaacaatgataaagaatctgtatgtgtatcacccacacagtattgttcaattgtaatacaaacaactgggtgccctgcattttatcgggaaactccacacagggttcgcagcttgaaagaggcagagctgtggcaggcctgcccttcctgatgccaggtctaggtgcttaacgtcaaagacagagcttctctaagagagctaccctcaagtgaacatgtcagttggcactaaatacatgtgatatgatccccagtcaatgatccccactcacttccctaattctttctattatcctttaagtttgcagactcagggcctccccagaaattgctgcagcctgagttctggacctgggaccgcatgtcctgtcacaaccagatgcaaaagggctctttagtccctacacagaatggcttcagccaggagagcataaataacatgtaagattagaagagctcagaggggctctccttctgtcccatgacagatgaaacttcagggctctgatgcttgtcagggaatctccttcagtgaggccaagatcccaggactttactaaaattagcagagtggaccagacaggcatgtcatggtacaggaattgtgttcagaacaataagtgcagatgcatcttaacaagggccttcacgttctatctttggtgaaaaaggaaatagacaaaggcatggagaaactgaaggactcaatgggtctgggactgaggtagcgctgagtgctttgggcttgtcctggagcagtctgcagatgataacagctgggaagtccacccctgctgtgaccttgtttcatctgcccactggatcagtggctgtgtcctcacaggaaagctggctgtagccagactggccttctccatcccacctgggaaatgtattcagatgactctctggggtgaggttctactaagggcttgggagttatgaggagggggctgatttgcatgaaagaaccatttcaccccctttccttcatctaaaacccattaatagaaacttcagggccattcatagaagtccagctggtctcctacatttgtggggcataaaggatcaatgcctgatgaatgcctgatcaatctaaaggaagaggggctatcagcaggtagtggtcagagtgagaaaggaactgacttttttgagagattcatcaacacagccaccaactctgggacaaatggggtgactctctgtaactgtcaccccaaattacccacaggacactgagccagtcccctcattctattgcttctggttctagtccattcccctattgtccctaaacacgttgcccatgtctgagtccagggtggcagggatacctccatcccagtcaacatctacagagggcctcttctgttcccctctcacctcatgcaggttactactgttgtgggtctggtggagtggcccctggagaacacaaggtatcccttcctctggaaagccaggcatgtaatagacatggtatgggttgatgtagagcagagtggctcatccagatgcaaagcagtaagaccttggctacagaaaattatttcacaaaattccacaccctttcatgacaaaaacactcgatgaactataaatagaaggaaactacctcaacatagtaaagaccatctatgaaactcccatagtttacatcacataaaatctgaacaaccagagacattttctgtaatatcaggaacaaaccaaggatgcatactttcacatcttcaattccaaatattattggaagacctaggcagagcatttagcctagaaaaagaaataaacagaataaaaactagaaataaaagtataaaattatctctgttttcagatgacataatgtcatatgtagaacgccattaaaagacccagaaaataattctgaaagaatgattaagtgaatttggtaatgtttcaggatacaaaatcaccacttaagaacatctcatggctaggcatggtggctgacgcctataatcccaacactagggaggctgaggtgggagaattgcttggggtcaacagttcaagaacagcatgagcaacaaagcaagaacctgtctctaccaaaaataaaaaaataaaaaggaaggaaagtcacttgtatttctatacttaaccaaacaggacaccacccaaaatgaaattaagaaaacaattcaagaggacccacagaccctctgaaggaaggggactgcacccgcaggacccgggagacaccgcaaatactgtgagtgcctcaactgcggaagtgggaaaaggagaccctcctctcccaaacacacacccctactgaagaatgtgaaagtctgttagcaggagaagttctcaactttacctggaacggagttaagttagacagccaagctcagtgaaatacacaggtgtaggaggtagcggggaggccctgggaacttgctgaatccccaagcaacccattcctttctggcaccacaggaatacatcaggaaggaggacagacaagcagcgggtaaaactccacgggaagaaggacttccctagctgaactttgcaacaattcgaatcgggtgagaggcctcctggctctagtatccatggcactagtatccatggctgagaggcccatggatagttcacatcacaggactctgtgcagaaacccccagtaccagcccagagccgggtagacttgctgggtggctagacccagaagagaaacaaaaatcactgcagttcagctcgcaggaagacatccacaggaaaagggggagagtgctacatcaagggaacaccccatggaacaaaaaaaatcttaccagcctttagccctagacctctcctctgacagagcctaccaaaatgagaaataacttggggggaagagtgggagaggggcgaggagtaaaagacaacaaacatggtacagtgtatactgctcaggtgatggctgcaccgggatctcacaaatcacccctaaagaacttactcatgtaaccaaacaccatcttcccaataacttacagaaaaaaaaaaaagaatattataacaatggaatcatatattatgcagcctttcagcattggcttttttcacggagcacaatttccttgagatatatctgagttgcgttgtatcaattatatagtttgtttctttttattgctgagtaatgtttcatggtacggttgtatcaagcttgtttaaccattcgccagttgaggaacatgtggattatttccagtttatttttttggctattaggaataaaactactatgaacattcttatacattaaaaaaaaaagaaaacaattcaaatttcgtcattagaatgagtaaaatgcggctggcacggtatctggtgcccataatcccagcactttgggaggctgagacgggggatcatctgaggtcaggagttgttagagaccagcctggccaatatggtgaaaccctgtctctactaaaaaaagattaaaaaaaattagctgggtgggtggcacactcagtgattgcagctactcatgaggctgaggcacaataatcacttgaacccaggagacagagtttgcagtgagaggagatggtgccactgcactctaacctaggtgacacagtgagactctgtcccaaataaataaataaatgtaaaatacttaagaataaacttaagaaggtaaaacacttgcacattgaaaacaataaaacattgctaaaagaaattgaagaatacacaaataaatggaaagacgtttttgattatgtattggaaaactcaatattgttaagataccagtagaaaccaaaataaaatatactatagagtcatcacaatctttatcaaaattccaatactacttggtacaagaatggatataattctaaaatccagatacccaaaatagccaaaataatcttgtaaaagaagaacgttgttggaatcctgacacttcctgattccaaagcatactaaaaagatacactaatcaaaacagagtggtacatatagacagacatacagacaaatagaatagaattgagtgccttggagaaaactctcagttatatggtcaaatgattttcaacaagcttgccaagaccattcgtgagggaaagaacagtctttttaacaaatgctgttgagaaaactggatatccacatgcaatctggaagtgaatcaaagacacaaatgggagagccacaactgaatcttaaaagaaaacattgggaagtaggtccacaacgtagggtttggaaatgatttcttggatatggcacaaaaaagacagggaaaacatagaaaaagaagaatatagataaattgcatttcatcaaactgtaaaacttatgtgcagcaaaggacactaccaacagagtgaaaatgcagataatagaatgggaaagattgttacaaactttatatctgataaggcatccaagctatagaaagaacttctacaactcaacagtaacaacaaaaataggaataacccgaaaaaaacaaggacaaaggacttgagtagatattactacaaaaaaagatctacgaatgtccaataagtacatgaaaagatgtacagcatcaccaattattagtacactgcaaatcaaatcacaataatatacaactctatacccattaggatggcattaaccaaataacagaaaattaaaagttctagcaaagatgtttagaaattgcaactgttacgatttgctggagagactgcagaatgatgcttccactgtggatgccttatggctgttcctcataaaatcaaacatagaattaccattttatcagaattttcacttctgggaatgtgcctgaaaaaattgaaagcaagatctcaaagagaaaattgtacatcctcgttcatagcagcattgttcacaatagctaaaaggtggaggcagcccaagtgtcaactaatgaatcaacaagatatattatacacacacaagggaatattattcagccttaaaaagaaagtctgacccatgcgatggcatggatgaacctttaagacatcatgccgtcagaaataagctgacttcaaaaggacaaaaattgtttgccagcccttatatgaggtacctagaatagttaactccacagtgacaagaagtaaaacgatgtttcccaggtatgaagttttggtttgggaaaataaaaaatttgtggagatgagtggcagtactgtggttgtacaacagtgttaatttacttaatgtcactgaagtatacatttgaaaattgttgaaataatgtattttgtgtatgaatattttactacagccaaaaagaggaagatttatgtttggtgcagtttctctacctccaagaacagtggaaacctacaggactaggagagtgtgcatgagtatccaggacactcttccttttatgccagccccacagcatccaggacacccttccttttattccagccctgcagcatcctaacaagttaagagagtcagacgtacctcattacaggtgactcagaataatatgagaaagtctagaggtggccatgatgttagcggtgggtgcccaacccagcccaggagcagccgcaaatgcaacagtggccaaagaaggggagatgaagctggtggcagaggtagcagcccctccagctggagaggggcatctgcttctgtacaaaatggttcacagttgataagtcttgcatagatgcctcatcgtttacctcatgaccaactacagttttcattgcaatgtacgttatcatagcagtaatgtctatttcctcctgtagcaagcaaacatgaacgaaacgtgctttactgctttgtccaacaggacatgttagtcccaaacacaggctgaatgtttaaaggtaacgttctctaaagataaggatattataccatttattgataaatacggggattgcatgatgaccattcagacacttggaataattacttggctaaataacattgtttaaacaatgagtaaatttagttattctttgcagagcaaaaaagatccaagtttcaccagtcccttggcaaacactacatttcaaactatggaagggagacatcctgaaattttgtgctactctttctgaagacacagaaacagtcaagtcatacctaatacttatgagcataaagctttgataaaattcaagaattatttgcattttgaggaaaaagactttgtcgctaaagcagagaagaacctaaaacggactcctcatagtgagctaatattttataaaaaggtgtcaatcaaggtgtggcttacaaaaatactttcaaggatgtttactttccagccatctcactggacaagaactgggtggttttcattaactttggactgtgctttaatttcctaaaaatgatgtcacttactgccctgagtgacatgggatgggatgctgtggtagagcacactctggctgatgtcttgtacctgctggagacagaaaaggatgggagacacagtcctccacaggaaatctcaaatgggtccctctttcttttcagatatggactttctggggagtaatactgtagggcttttcttgttgttgcctttaactgtctcaaatgttctcccaaagatgctactgaacacagcctctcctttgagcaagttaaaagtctgggtacgactgtgagaggctcctgcctgccaacactctttctccactttcagtgactgctcttcttctgagggccgtaaaccaacaactgctcatcccaagatccactaagccctctgggaaattggtgctgtactgcataccctgcctgctgggacttgttacattgatgtattttctaaggagtgaataatcttgtccaagtaactaacttatttaaagacattttcttcggtgggcactgactccatggcacccgttttccaaggagttggtgagcttgtttctgagaatgccagaaatcaatgtacattccaaatcattctaaaagtgatttcttttcggtgtgggtttggttttgttattaattttgaaatatatctttgaatactgagatctctgaaactactagatctctagaagtgtaattgggaaagaaggttgcttgcagctttaacaaaatgagaaactcttcccaaatacaacctgttttgaagttaaaaaaaaatgtgacattagaacctgcaaaatctaagagtttccaacagcagtctcaattctgatgctaactgtaagctagggactcccccaacaacgcttcacttcttatgattcccaagaaggactcacatcactcactgaaacttgtgacgtttgttgatatgattttttacaacaaaagaatgcagattaaaataattcaaggaaggaggtacatgggcagagttcaggagaattccaagcacaggcattcagttgtcctctcccagtaaagtaatagacaatgctgcattctcctggcagcaatgtgtgattctgtgcatgaattattgccaaccaggaaagctcgctgaagcttggtgtccaggcaggtttttttgggggtgtgagttggggatggggttgcttatgtagaccttgttgatcatccttatggctgactccgacttgaatttccactgaattgacaataaaacttcaaccttaaatatttggttattttctttttaataaattctctaaaataaattattttgaaaatgctcgctttagctagctgtttatccaatatgagactcaacataaatagtttcaaaaagccagtgggtcattaaaacaattcctttagtcatccaaaacattcagataaaaattaacaccatgtaacactaaaatcgaattatagtcactggggctggatttcaacaacaggaagagaaagtagtacaaatagggatgagcaaaaaatagacaagtaatggatgtgaattggcctaggaaatttacagtggcaatgtcaaaaaggtaaatcaatagttatttgacaatacatgctcagtccaggaaagccaccagggggcggtctgggtcgtctgcatcataagaagctcaaggagttcaaactgaatgaaccctgcacagttgctcactgggtcgtgtaaaatgttagagcagctgcttcctcccgcaacacacggccactctgggcagtcccctcacagtgtggctgctctcagggctgagaacctgggtggtgctaaaggtggtgaatgtggtaaagatttgcataaagcaccacacaacacacctcctccacacagggatctcagtagcatcttcaaaggatgggctttctgagctaagagcaataagaagaaactttctaaacttactaaaatttatttattgagttatgttcaaagcaatacatgcctattacataaaatcagaaagtatttaaaatcaccgagttctcggcaaaggttctttattccaagcaatcaatatgactatttttttttatttggatgcattctttcatttttgttctcagtatttccacaatggtgatcaagccttgtgctttttcatctgcttttatacccctttatgatctagtcatttcaggttaatgtaagtagtgttccatttcttaaaagggataaaatatttaaatagttgctaattttatttttatttgaataccaatgaaatattatcatttttagataattcttattgtttgctactcaaacgaagatatgatattatcttattattaaaacactcctggtaacttctgtggattttgtgaggtcagaaaaaaaatgcctgaaattttcaatggaaagccttgagtacattacacctgacttcacaatgcagtaaatagagaaacaagagtttccgattcatgtaagaaggagcataacagattaaggtatgaggaataatttatatccaaaactacaccagtgtctccaggcatgtgttagaacagtaccccccaaattctgttgtgcatatgcatcttctggggattttacaaaatgcagattctgattcagtggctctggagtgaggacacagtctctgcatttctagaaagttcctaccacacaaaatccacatatatgtttgaacaataacaaggccagccaggagaagaggctcaggtgtgtaatcctagcactttgggagtttgaggcaaaagaattacttgaggccaggagtttgagaccagccagggtaacgtcacaagatcttttctctacaaaacatgtttttaaataataaaaaatgaattagccaggcgtagtgtggcatgcttgtcatcgtagatacctaggaggctgaggcaggagggtcgcttcaccccaggagttcaaagctgcgatgagctatgattatgccactgcactccagcctgggtgacaaagtgagaccttacctctaataacaaaaacagccataacaaattcataagaatagtgtaaaataaggagaaaccttggcagacaataacctaagagatatctcagacatagtgaactaatgtgtttggatgacagaagaaccccacacttggctggctgtggtgactcaggcctgtaatcccagcactttaggaggccaaggcgggcagatcacctgaggtcgggagttccagaccagcccggccaacatggaaaagccccgtctctactaaaaatgcaaaattagccgggcgtggtggcgcagcctgtaatcccagctactcgggaggttgagccaggagaatcactggaatccgggaggcggagtttgcggtaagctgagatggaacgagccacactccatgcaggaagacgaccagggaggacagctgcaaagcagggagaggctcccctttctttaagaaacaaaacaaaagcaaacaaacaactaacctgacctcccctctggctcccatccaacattcttactagcttctcatctagtcttttctgtagtgtagcccatccttaccctctcccctcccacatctctgattcctgaattcccttcttgggtctctctccttttcctgtcaaccacttctcccctctatcatcctgagttaattatcaagagctttatagcaggaagcctattggtatttttccagattttttttcttggaattggacattcatacattttctctctttttttgggggggtagggtggggtgggggtgggggtagggacagggtctcaccctggttgcccaggctgtggtctcaactcactgcaaccttcacctcctgactcaagcaatcttctcagctcagcatcccaagtagctgtgactatgggcacgcaccaccacaccctgctaatatcttgtatttttggtagacatggggtttccccatgttacccaggctggtcttgaatttctgagctcaagtgatccaccctcctcagcctcccaaagtcctggaattacaggcatgagccgctgtgcccagcctattttttctcttttacgagcctctctgattccctagttctgaagtagcccagagttggctgattctcctattttgcctcagctagcacttcctccttctcctttttttttttctccttctgatccctggagtcctctgcatttccactgaatccagtgaaccacacaagcatgctcatttattctccccaaactccaccactctgccttatgtgctgatccagtgagaatcaagaaggaagagagacccatggatttctgtgcagcctggaaagtcagttcatggctggacttggctgggacaccagacacctgtctccctgtctctatttagtattcatagggcccagcagctgcatcctcccagggtgcctgaagagtcactgaccatgctctcctacccagcctcaagaagccacccagtcctcgagaagtataatcagactcagcatcttatgtgaagggaacaaccatggggacaggttagacttgcattgagtcccctcctctaagaagggccagggaaaaggggctgttccccctaatctgtgtggctcaggaagtagagctccagagacttctctaccatggcctgaatccctctgctgctcaccctcctcagtctctgcacaggaggctggagatagaaaggcagggactggcactgggaggaccagggctctgccttgctcccccggctcaccgagccacttcccacaccctgtgtctctgtcctgactcttagggtcctgggcagtcagggctcacttggtggcctgcacagtttgtctgtgactaaaccagccaccatctcctgcactggaaacagcagcaataacgtccttggaattgtgtcctggtaccaacaatgaacaggaagtgtccttaaacctctgatctgtggatgtaaatatccacctgcagatccagaactgattcttgagtgatcagtctggcaaggaggccttcctgagcatatctgggctccaggctgaggacaaggctgatcactaacgttggatttggacagttctctggaggcccccacggtgctgcagtctgtggggaagtgagatgggaacatttcaggtctcctaggagcacgacccgacagcaccacctacaactgggaaaactgggctgtttaccatttgtgttcatgtttgcttgggctggtgctagccagggcccaggtctcaggtcagggacagtgatttagagaatgcagctttgtttcctcagagtcagccctcagagaaagcccatagcaacagcattgtcaaattgcctcaaaaaaaatcagaaagtccttggttcctggaacaggctgccctaggaacagagcccaatcggtcagagcaagcagggacacaactgtgcagaaaacaacaagttttacttagggagataacggttgactgtataaaatgagaaatatgtcacactactcacttgtaaaagtaagtttaccaatgctattcatttccctatatcactacgttgagtaaaaactctaaaatgtatgaaaccactgtagagataacttttgctgaattgctactttaacatgtcatggatcatttatttttcttgcaaaattctcattattcaccgtccttttgagtaacccccagctgcccttcaacctagctcctcagctgacctcttctccatgatgcctaccctgatggcacatgtgggcagttaggtttttctagattttaaaagttatatatgtacatgtctacatcccatggaccaagactcactctgggagtgagaaatcacaataatcatgcatagccttatggaattagtgtctagcaatcagaccatagaggtgtgaatagagacagtgactaatgagctgcagagatcagctgggccatcaggaggtaagtgtcctctaaccagcatgggatgctgggggactgccctatggtccctacacagctgctcagtaaggaccattcactcaaagaaatccaagactaggggctaagaccccgtgctcactgaggggtacttagcatctatgtcctcccatggcatggcagagtcccctgagcaggaaggtgtgtatggtttcagtaggtgctttcttccggagccctctcaaggggaaaagcaaaacttcttcctcctcagtctgcagtgtgagctgagcttcagccccagagcttagagaggggctgggcagtccctggatgaaaacacatttgcatgagcagcccctcctctgcagagtatgggaagaaaaggaggcctggggcagcccagtcccactgtgcatgtcaggctgtgtccaccatggcctggactcctcttcttctcttgctcctctctcactgcacaggtagggacaggcctcagagatcagggccagccacccaacctgattctggctcttctggtaaagatccctgaaaaacctcaccctgaaccctgcccatcaaccatgagtgtctgtgtttgcaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgcttctcacagtgacacacacagatgggaaagtgggacaaaaacctcaccctgctttaggtcttgttcttaaaaaattttaaattttaaaataactggcctaggcacaaactacatttggaagtactttctagttgtaaaaggctcttctctcaatttcccatccattcgtctgaagtctcagtaaaacaaaacaaaaccaaagcaactgatgacactgaagtcttggctggttgtcatatgtgctaacaccactgcctgtggagctggacttttgttcttgaaagaagcaaaatgaggctttcctagctcacatcatggtcagagcctggggacatcctagcaggtgaacagtgccctgcagcatggactctgctcttccagcgtacgggcagagacctccccttccatccccagtagtctgttctcagggctgtctgtggctcactgtgtcccaggaacaaggcactcaaatatgaaatgctgcctgaggacacaggtcagggaattctagatatagtgctgacctggctcagtcctgggtacctgcatttcagtggcaatgtcaggagatggggttaggtattagggtaactggggacctgagaccagtaaacctctatgtaggacatgacaggagagtcaaggggaggctccactgtggctgagacaagccagaggctgctccttggccacgggggaagtaggtcccatggatgtgactttcctgcagctcatcccactcaggaccatggggactgctgagcgtgggtttcttgatccctcagcgcctgtgttctcttctcctctcttacaccattggagcttcttgctgaatcagggtctagtggtgagtatgtggaaagaccaccacatctcaaggtcacctttttctgcatggggagcagcagaaacattgggcattcccgtggaaatggctacggaggcctcccagaaagagcccccaagtttatgacctaggacagcagtgatggtccctcaggggtcccagcctgattctcctgctctgggtttatccacacagcctcctggagcacctcttggctccagcctgaggactggctggttatcagtgtcacacagctgcatcctgactccatgttaccaagggttcctgttccatgtggaaatgagagaaagatctgccccactcatcctgtctccccatccctcctttatccctgcctgtgaccaacaccagttcatgccaagacttcggctgtcacttgtgttactgaagcagagcacaagttcagtaaaaataatcccttttcttactggtctcccaatgcaaacagaatcaatttgtttctagaagcaaaaggagctgcccacacatggtgggtggggatgaggtagggacaagaaagaatccaccctgtgtgacccagaggcccagaagcctttagtctggttccaaaggtgtctcctcctcttggtgcagttatgctgaccatttcctgagctcagaaactgtgcgagagatgccaagaatgaagaatccagcctgtgtgacccagagacccaaacgtgagacaggaagtctgatgcttaagaaaacgtgggttcagcattctgaaaggtctagatatggcttggcctagagctggtgtagaagagaagcaagagagatgctcagccttaggtggcccaggcacagcggtcctgtcaaggggttgagctctctgcaacatggatatcctgcagagacatacttggggaggctgtgatcccagaatgacacaaaaatgctaatggaaatgagcaggggattgtttatgggggaatggggagacaggtgtgggataagatgtggtaaggagaatgcagcctgaagaggagactgtccattgtgactcataggaggagtagggccggggcctacagtagtgataaaaggaggacctggaaggacctgggccctgaagacacacagagactggagttttggtctgtctgtgagggtcccatgaggataaaaatccatggtcagtgtcctctgtccagggctcactgtcccagctgttgtccctcctggatcctctgggtgtccagattccgtagctgtggacctgttctcctctctgtcctcagcctaagagctgatggggcatccaccaggaagcacatctgtgggcagggagggggccatgggcagccttgtcctgtatgtgaggcactgctcagcctcggtgatccctgttcattaacgtgggaggaaaggaaaacaaaattcactgtgaacatctatgcatcatcaaagaaaaagcaatgagccaaacaggaagtgaagcccagctctaatagtttgtttctacttggaaataaataaaacttaatatgcctgatgtgttacgtaaatgcaataaacattttttgaaagctataaaaattatgtaaaggaacatggcttacactaaaaggaacacttaaaataatgacacccttgaaatgcaatcccaaaacacagcatacattttatttcagttccatatatggactggttttatttaaatgtctatattaaatctcactattccatttttaaatggagcacttaaaatctcattctacggcaactgcctggtgatacatttaccagtggaaatatcaacaaaaccatccagctgttttcctccatccccatagaattccccaaactagtaattattaagagcccaggatgtatcatgccagaattcatgcagtcgtaggcataacctgtttcatttttcattctgatcaacagaattacaatttttcttaagcttgtttttagcttattagattctagttgtcattacagatcaaagataaataattttctatcatccttaagccacccccataacactcactactgaatttgaaccataatttttccctaaaaatcctagttggggtgcttgatgttgagagctaccacgtatcaggctcacctgaggacagactctggttaaaccaagttaaaattttaattcttcccatcttcaaagactgagcatctttgctctttttgttcataagtgaaacactccaaagtcatttgccaggatcccctgcagatgagcatttagtgtacagactcctaggcaagatccctggtcacagtatccagatgactatgactgcaaatctggggaagtagagggagaacaaagatttaccaggaaaaccctctgggaattcctccccagggaatcctagaggaaagagctccctttctcctcagcgccacaggatccacagaggaaggagagctctagccaccaggaaggagccacatgagaggagaggacctggtgtccaacacaggtggggaggtgagtccatggggctggtccctgctatgggcttgatcctgacataggactttatgtagataccacctgagtcctctacaatgtacagccaaagagccatggaaagattcactcctgaggagtctgaagactcctcagtagagcgtgaagatagccctgaagtcacagggaggagacacagacaccacttggcctgccttggacctgagagagggggcagtggacagaatggggggaggaagccatgtatctgagaggttctggtcaccttatcatagaatggtttaccttgatctggacaccagagggcgcatggggatcattcctgagaagacaggggtgatcagagcagaaccagccgcctgccctgcctggtgtcctctgctcagggctcacagctgtgtcctccccaccccctgggaccacaaagctccacccctgccaccccctgacatcctcaagccaaggagcctgacccagggctcagggtggggtcacaaacctggggggggtctgatttgcatggatggactctccccctctcagagtatgaagaaagggagagatttgggggaagctcagcttcagctgcgggtagagaagacaggactcaggacaatctccagcatggcctggtcccctctcttcctcaccctcatcactcactgtgcaggtgacaggatggggaccaagagagaggccctgggaagcccatgcgaccctgctttctcctcttgtctccttttgtctcttgtcaatcaccatgtctgtgtctctctcacttccagggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcccacagtgctccaggcccagggggaacagagacaagaacccccttccttttctgccaggagggtgagccccggctgctgctgctcaggcctggcctgtggcttctgctgctgcagcttcccccatgggtccagggatatccagggccctgcctgagagtggaggctcctcctcccctgagtcctcagagtcaggaacagggtgtccagaaaacaaaagcagggtgtcctgctccctgtagcttgggacacagggtctctgcactgaagtcctgggctgaggtggcaggtccagctgtgtcatcacagacccacttctgttggggaacctgtgtctccatcatcctactttttccatttccaggagtttccagagtggtgtcttcctcccccttctcctcagtgtgaatccctgtgcttcctttctctccagcctattctttttttaataaaactcctttcatgtaggaataatgcacatataataagccacccatatttacaatagggaatgagacaaattttggcatttctatggatccttgaaaacatcaccaccaccgggagctatacaacatacaacctgtgaccaaccccaatagctcctcatgacccttgtcacctcattccctcccccaacaccctccttggaagttgcagatctgcctctgtcactactgtttggtttctcttttctggaatgtatcagtgttatcaaacattatcttcccatttgttcaggcttctttcactctgcacacttcttttgagattctcgctgttgttgctgcattgtacccatctcgtagagggctccttactatctttgaaggtccttaggccatttttttctgattttatttatgtatttattttaaagtttgaatttattgtgcatccaaatcaaactttaggggcaatgttcatctaaggtgacaggacagtctgtgatggcttgtcgggattcttgcttcttcatctcttgcttctgattctctctatagtggaagaggttctcgtctttcatttatttatatatttatttatttactgatttatttgggtttttaagggttttagtgatttttctctttttggttatttttcaatttttttattttaataggtttttgggggacaagtgttgctttgtcacataaataagttctttagtggtgatttctgagattttggtgcactcatcacccaagcagtgtacactgtacccaatgagtagtcttttattcttcacccccctcctaccctttctcctgagtccccaaagtccattgtatcattgttatgcctttgtgttctcatagcttatctcccactgatgagtgagaacatacaatgttttgttttccattcctgagttactgcacttagaataacagcatccagttccatccaggtcgctgtgaatgccattattttgttccttttatggctgggtaatattccatggtatgtgtatgtatacatcacatttgctttatccacctgttgatttatgggcagttgggctggttccatgcttttacaattgtgctgctataaacatgcgtgtgcaagtatcttttttgtataacgacttctttttctctgggtagatacctagtcgtgagattgctggatcaaagggtacatctatttttatttccttgaggaatctccacactgttttctgtagtgactgtactagtttaccttcccaccaccagtgtaaaagtgttttgttttcaccacatccatgccaacatctattattatttttattttttgattatggccatttttgtggtagtaaggtggtatcacatcgtggttttgacttgcatttccctgatcattagcgatgtcaaacatttttctatatgtcttttgtccatttgtatatcttcttttgaaaattgtttattcatgtctttagtccatcttttgatgggactgcttattttttttcataatttgtttgagttctttgtagactatagacattagtcatttgttggatgtatagattgtgaagatttgcttccactcggtgtgctgtctgttagctctgctgattcttttgctgtgcagaaggtttttagtttaattaagtcccatctatttatctttgttcttgttgcatttgcttttgggttcttggtcatgaagtatttgtctaaagtaatgtctagaagggtttttttaatgttatcttctagaatttttacagtttcaggccttaaatttaagtctttgattcatcttggcttgatttttgcataaggtgagagatgaagatccggttttattcctctacatttggcttgccaattatcccagcaccatttgttcaataggatgtcctttttccactttatgtttttgtttgctttgttaaagatcagttatttggctccatttctggattctctattctgttcctttggtctacgtgcccacttttgcaccagtaccttgcagttttagtgactgtgagtcaaattatgctagagtatagtttgaagttgggtgatgtgatgcctccagatttgttccttttgcttagtcttgctttggctatgcaggtcttttttggtttcatatgaattttaggattgttttttccagttctgtaatgaatgatggtgatattttgatgggaactgcattgaatttgtggattgcttttggcaccatgatcattttcaacatattgattctacccattcatgagcgggggatgtgtgacatgattttttcagcagtgttttgtagttttccttgtagaggtctttcacctccttggttgggtatattcctaggtgtatttttttgcagctatttgtaaaaaggtttgagttgttgatttgattctcagcttgttcactgttattgtataacagagctactgatttgtgtgccttacttctgtatcctgaaactttgctgtatttatttaccagttctttttttttttttttttttttttgagatggagtctcgctctgtcgcccaggctagagtgcagtggcgcaatctcagctcactgcaagctccgcctcctgggttcacaccattctcccaccttagcctcccgagtagctgggactacaggtgcctgccaccatgtccggctaattttttgtatttttagtagagacggggtttcaccgtgttagccaggatggtctcgatctcctgactttgtgatccgcctgcctcggcctcccaaagtgctgggattacaggcgtgagccaccgtgcctggccatttatttaccagttctaggagatttttggatgagtctttaaggttttctaggtatatgatcacattatctgccaacagcaacagtttcacttcctctttaccaatttggatgtcctggatttgtttctcttgtctgattgctctggcttagacttccagtactatgttgaatagaagtggtgaaagtgggcattcttgtcttgttccagttctcaggggaattgtttccaacttttttttcctttcagtataatgttgactatgggtttgaaagagtgggcttttcttaccataaggtatgtctcttctatgtcaattttgcaaaggcttttaaccatgaagtgatgctggattttgccaagtgctttttctgcatgcattgagataatcatgtgatttttgtttttaatgctttttatgtggtatatcacatttattgacttgcatatgttaaaccatccctgcatccctggtatgaaacccacttgaacatggtggactatgtttttgatagctgttggatttggttagctagtatttcatttattatttttgcatctatgttcatcagggatattgttctgtagttttcttgttttgttatgtccttccctcattttggtatgagggtgacactggctacaaagaataatttaggaagaatttcctctttctccttcctgtgaattagtgcattagtcagggttttctagatggacagaactaatggaatctgtatatatatagcatgatcacaacatcccacaataggctgtctgcaggctaaggagcaaggagagccagtccgagttccaaaactgaagaacttggagttccatgtttgagggcaggaagcatcaagcataggagaaagttgtaggctgggagcctaggcccatctctcttttcatatttttctgcctgcttattttctagccatgctgttagctgattagattgttcccacccagattaagggtgggcatggctttcccacccactgactcaaatgctaatctcctttggcagcaccctaacagacacacccaggatcaatcctttttatccttcaatccaatcaagttgacactcagtattactcatcacaagtccaccccttgtcaacttcaacccatatatatcttctgagatcatacataatcttcaaataaagacaataataaggtcataatgacacctaacataatacaactatcattcatacaaacagaaacacatcaatccccaacccaaatactgttacataaagttaacgatacttaaacgctgatgtgaagtcaataaatcttatgtcacatgataaaggagaaaggaaataacatgaagatattttcttaggacaaaggtatacacgcacaaacatgtttttaacaaaagaaggaggaaatactcatgacaattacactcctcgtttctgcagctggccatagctggtattgatgattactttcttctactatccattctgtattctgtattccctttgccttcagcaagcacctcagcaggtcgtggatatttttccagatggtgtgatccaaatcttcattcctgaagcatctggttcatttgtagtcctgcctggatagggctgttttagttttccatggaccttaatcacagggcatgataatactaagaaatgccctaatggatctcctgtattccatgcatactcttccttacctccgttatggagtagtaaactgatttcatcttgatagtctgtcccaaacaccccagccaacactgtaactcccttcttagcctgttgacttaaaggtaggaggagcccaaagtgtccaggtggcaatcttaacttccccagtttaatggaatcattgatgtgtctccaagtggcagtgttccttcctctggaactaaatcctctaagccagcagaacataatgtcgtgggaacaggaagcaaaaattttgctagtggatcactaggggtgatggtgagtgctgccacttccacttccaccccttgattcctagactcatgaatcctggctatgggagaaacagtgccatatattggatgctgactcagagcatacacgccttctggggaacttagccccagcactgcaaagtattgtcacctagttgacattgtaattgtgacttcaaaaggccattccattgttctatcaatccagctgcttcaggatgatgggaaacatggtaagaccagtgaattttatgagcatgagcccactgctgcacttctttatgaataaagtgagtgccctggcgagaacaatgctatgtggaataccaggatggtgaataaggcattccatgagtccacggaggatggtagtcttacaggcaaacccatatctggaataagtgtctatatcagtgaggacaaacctatgcccttctcataatggaagatttccaatataatcaaccttctaccagatagctggctgatcaccccaaggaatggtgccatatcaagggctcagtgttggtctttgctgctggcaaattgggcactcagcattagccatagctaggtcacccttggtgagtggagagccagttcgagttccaaaactgaagaacttggagtatgatgttcaagggcaggaagcatccagcacaggataaagatataggttgggagggtaggccagtctctcttttcacatttttctgtctgcttatactttagccatgctggcagctgattcgattgtgcccacacagattaagggtgggtctgcctttcccagcccacttactcaaatgttaatctctttcagcaacaccctgaaagacacacccaggatcaatactttgtatcctttaatccaatcaagttgacactcggtattaaccatcacaattaatgtcataggattagtactaattcttctttgaatgtctgatagaattcaactgtgaatctgtctggtcctggctttattttgttgattttttttaaattaccatttcaatcttgctgcttgttactggcctgttcagagtttctatatcttcctcatttaatttgggagggttgtatacattcagaaattgatccatctcctctgggctttctagtttatgtgcatagaggtaatcagagtagccttgaataatcttttatatttctgtggtatcagtattaatatcttctgtttcatttctatttgagcttatgtggatcttctcccttttcttggttaatcttgctaatggtctattaattttatttatcttttcaaagaaccagttttttgtttcatttgttttttgcattgctttttgtttcaattttatttagttctggtctaatcttcgttatttcttttcttctgctgggtttgggtttgccttgttcttgagtctccatttccatgaggtgtaaccttagattgtctatttgtgctctttcagactttgtgatgtatgtatttaatgctaaacattcctcatagcactgcttttgctgtatcccagaagttttgataggttgtattaagatttactacaactgcaaccttactattgaacaatagctttttaattcctgagagtgtgacctcatttatgcccaaaaacaactttatgattgcttttcatgcagtaggccatgattagagagggagtgcttgtggcctggaggtagggttctccaatttatcaaataaaaacattggagtgcagttaaatttgaattcggtaaaacaatgacaaagaattagtatgtgtatctcccacatgatattgttaaattgaaatacaaatttacctgggtgcgctgtagtttatctaccaactcctcacaggcttcgaggcttggaagaggcagtgttggggctggtctcctcttactgatgccaggtctatgagctgaacctcaaaggcagagtctctctaacacagctaccctccagtgagcatgttagttagcactaaatacaccatatacgatttccaatgaataacacctactcacttccctaattcttctttctattattctccaagtctgcagactcaggacctccccaggggttgctgcagccagagctctggatgagggacctcataagtctttcaaaaccagatgcaaggggactactcggtccccacacagtgaggtttaagccaggggtgcataagcaacatgtaagagacagaagagctcagtatggctcttatggctctccttctgtccagtgagaaaactccagggtccttttgatgctgaaggtgggtgggctgagagtaggaggagacccaccctgacagcccagagattccaggacaagacttggcagcctgaaaaggggccacactcttgagtggggaagaaggaggcaactctgctcacaggcgtgcatttctggtggcttcccctttaccaaactggactccctactctgatgtctatcagagaatctccctcagtgagaccaagatcccaggacattgctaaaaacagcagcatggaccagacaggtatgtcatggtacaggaattctttgcagagcaataaatacaactgcagcttaagaggggccctcatagtcataactttggtgaagaagaaaatagacaaaggcagggagaaactgaagggctcaataggtctgagactggggcagcactgggtgctataggcttgtccttgaggggctgcagataatgacagctgggaagccatcatctgttcactgctcactgggctcagcagctgtgtcctcacagggaaccagattcagccaacctggctttctccaccccacctgggaaatgtattccggtgactgtctggactgaggttctatgaaggggctaggagacaagaagagggagacaggctggtttgcataaagaaagcattgcacaccctttcctttcatctaaaactcattaatggaaactctggggccatccatagaagtctagctggtctcctaaatttgggagttatgaaggattcattcctgatcaatctacaggaagggccatcagcaggaggtggtcagagtgagggagaaactggcttccttgagagactcttcaacacaaccaccaactctggggcaaatggggtgacttgctataacagtcatcccaaactactcacaggaacctgagcctagtcccctcaccttattgcttctgattctggtccatgcctctgttttccctggaccccttgcccatgtctgagtccagagtggcagggatggttccatcccagtcaacatctacaaagaagtctacatctacagctactatgacttgaagcagagtccacagttgtacccaagagggcctcttcagctcccccaccccttcacacaggtgacctctactgtaggtctggttgagtggcccctggaccctggtgaacacaaggtatttattcctctctaacaccaggtatatagtggagcaggtctgggtgggtatagagcagagtgtctcttccaaatgtaatgcagtaagaccctggctacagaaaatcatttcacaaaactccacgccctttcatggtaaaaacacccaatgaactatgaatagaatgaaactacctcaacacagtaaagaccatctatgaaaatcccacagctagtgttggccgggctggtctccagctcctaacctcgagtgatccgccagcctcggcctcccgaggtgccgggattgcagacggagtctcgttcactcagtgctcaatgttgcccaggctggagtgcagtggcgtgatctcgtctagctacaacctccacctcccagccgcctgccttggcctcccaaagtgccgagagtacagcctctgcccggccgccaccccgtctgggaagtgaggagcgtctctgcctggccgcccatcgtctgggatgtgaggagcccctctgcccggctgcccagtctgggaagttaggagcgcctcttcccggccgccatcccatctaagaagtgaggagtgtctctgcccggcagcccatcgtctgagatgtgcagagcgcctctgccccaccgccccgtctgagatgtgaggagcgcctctgcccggccgcgaccccgtctgggaggtgaggagcgtctctgcccggccaccccgtctgagaagtgaggagcccctccgcccggcagccaccccttctgggaagtgaggagcatctccgcccagcagccgccccgtccgggagggaggtggggggccagcccccgcccagccagccgccccgtccgggagggaggtggggggtcagccccctgcccggccagccaccccgtccgggagggaggtgggggggcgcctctgcctggccgccccttctgggaagtgaggagcccctctgcctggccaccaccccgtctgggaggtgtacccaacagctcattgagaacgggccatgatgacaatggcggttttgtggaatagaaaagggggaaaggtggagaaaagatagagaaatcagattgttgctgtgtctgtgtagaaagtagacatgggagacttcattttgttgtgtactaagaaaaattcttctgccttgggatgctgttgatctatgaccttacccccaaccctgtgctctctgaaacatgtgctgtgtccactcagggttaaatggattaagggcagtgcaagatgtgctttgttaaacagatgcttgaaggcagcatgctcgttaagagtcatcaccactccctaatctcaagtacccagggacacaaacactgcggaaggccacagggtcctcggcctaggaaagccagagacctttgttcacttgtttatctgctgaccttccctccactattgtcctatgaccctgccaaatccccctctgcgagaaacacccaagaatgatcaataaaaaataaataaataaataaataaataacaaaaaaaaaaaaaaagaaaatcccacagctaacatcatatgcaatctgaaagaccaaagaggtttttgtaatatcaggaacaaagcaataatgcacactttcaccagttctattaaaagcagtattggaagacctggcaagagtaattaggcaagaaaaagaaataaacagaataaaaattagaaataaaaaataaaatctctgttttcagatgacataatgtcatatgtaaaatgcccttaaaagtcccacaaaaaattattagaatgattaaatgtattcagtaatgttttataatacataatcaccttgtaaaaacatctcatggctaggcatggtgactcatgcctgtaatcccagcactttgagaggttgaggtgggaggatttcttgggttcaagagttcaagaacagcctgggaaagaaagcaaggctctgtctctaagaaagcggtggggggtggggggaagagagaaagagagagaaagagagagaaaagaaagaaagaaaaagaaagagagagaaagaaagaaagaaaggaaagaaaaagaaagaaagaaagaaaatctgttataattctatacttaaataagcaaacaggaaacaactcaaaatgaaattaagaaaagaaatcaaattacaacatcattcgaaagagtaaaatacggctgggcacggtggctcatgcctgtaatcccagcattttgggaggttgatttgggggtatcacctgagattagaagttcaagagtagcctggtcaatatggtgaaaccctgtctctactaaaataaataaataaataaataaataaataaataaataaataaataaataaaatttaaaattagctaggtgtggtggcacatgtctgtaatcccacctgctcggggttgaggcacaagaatcactcgagtatggtaggcagaggttgcaatgagccaagatcctgccactgtactccagcctgggtaacagagtgagacaatgtctcaaataaacaaataaataaagataaacgagtaaaatacttaagaataatattaatcaaaatggtgaaagacttgtacattgaaaactataaaacattgcaaaaagaaattaatacacaaataaatggaaagaaatcctttgttcatttattggaaaactcaatattgttaagctaggcatacaaaccaaaaggaatctacagattcattgcattctctatcaaaattccaagttagtatggagatcattaaaaagtcaggaaacaaaagatgctagagaagatgtggagaaataggaatgcttttacactgttggtgggagtgtaaattagttcaaccattgtggaagacggtgtgatgattcctcaaggatctagaaccagatataccatttgacccagcaatcccattactgggtatatacccaaaggattataaatcattctactataaagacacatgcacatgtatgtttgttgcagcactagtcacaatagaaaagacttggaaccaacccaaatgcccatcaaggatagactggataaagaaaatggggcacatgtacaccacggaatactatgcagccataaaaagggatgggttcatgtcctttgcagggacatggctgaagctggaaaccatcattctcagcaaactaacacaggaacagaaaaccaaacactgcatgttctcacttataagtgggagttgaacaatgagaacacatggacacagggagggtaacatcacacaccggggcctcttggggatgggagctaggggagggatagcgttaggagaaatacctaatgtagatgatgggttgacaggtacagcaaatcaccatggcacgtgtatacctaggtaacaaacctgcacggtctgcacatatatcccagaacttaaagtatatattttttaaaaagtgcaagccaaacaaacaaacaaaaagaatagaaaaaaattaatcctaaaatttatatataatattgagagaatctaaatagtcaaaatcatcttgtaaaagaagaacagtgttggagatttcacaccgatttcaaaacatactacaaagctacactaatcaaagcagagtggtacatatagacagacatactgacaaataaaacagaactgagtgcctaaaaaaacctcttagttatacagtcaaataattttaaacaaagttgtcaagaccatttagtggaaaaggacagtctttttcacaaatactgttgagaaaactggatattcaccagcaatctggaaatggatgaaagacccaaatggaagagccaaaactgtcaaaatcttaaaagaaaacattagggagaaggttcataatatagggtttggaaatgacttcgttaatatgacaccaaaggcacagaaaaaaatagaaaaagaagaatatagataaattggattttatcaaattgtaaaacttatgggcatcaaaggacactatcaaccgagcaaacatttgaatcatagaataggaaagattgtcgcaaattttgcatctgataagagatgcagactatagaaagaactcctaccactcaagagtaactacaaaaatgaaaacaatctgaattatatgggcaaaaaacttgagttcgtattgagtagactccaaagaagatctacaaatgggcaataagcacatggaaagatgttcagcatcactaatcattaggccagtgaaaatcaaaccacaataatatacaactccacacccattaggatggcattaccaaaataatagaaaataacaagatctagcaaagacgtatagaaattataactgttatgcattgctggagggactataaaatgatgcacccattgtggaggtcttatggcatttccccaaaaaaattaaacgtagaattgccattttatcggaattttcagttctgggtatgtgcctcaaataattgaaagcaggatctcaaagagaaaattgtacacccttgttcatagcagcgtcgttcacaatagctaaaaggtggaggcagctcaagtgtcatctaatggataaacgggatacagtatacacacacaagggaatagtattcaaccttaaaaagaaagttctgctattctgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtctcagtaaactattgcaagaacaaaaaaccaaatgccgcatattctcactcataggtgggaactgaacaatgagaacacatggacacaggaaggggaacatcacactctggggactgttgtggggtgggggtaggggatagggatagcattgggagatatacctaatgctagatgacgagttagtgggtgcagcgcaccagcatggcacatgtatacatatgtaactaacctgaacattgtgcacatgtaccttaaaacttaaagtataataataataaattaaaaaaaaaaaagttctgactcatgcgatggcattgatgaaccttaaagacatcacgccagcagaaataagctggcttcaaaaggacaaatattgtttgcttgcccttatatgaggtatctagagtagtcaaatccatacagacaagaagtagaatgaagttttccaggtgttaagttttggtttgggaagatgaaaaatttctggagataaatggtggtactgtggttgtacaacagtgttaatttacttaatgacactgaagtatacacttgaaaatggttaaaataatgaattttgcatttgaataatttaccactgtacaaaagaggaagatttatattcagtgtagtttctctaccaagaacaatcaaaacatacaggattgggagagtgtgcctgagtattaggacacccttccttttatgccagcctgcagcttcctaagaggccaatagagttggaagcgcctcattactggtgactcaaagtaatgtgagaaagtctgggagtgaccatgatgtaagtggtgggtgtctgacccagcccaggagcagccgcaaatgcagcagctgccaaaaagggggagatgaaactgatggcagcagtaacagcctctccagctggagtggggcatctgctcttgtgcaaaatggttcacagttgatacatttagcacagaatctcatcctgtctacctgtcatgatcaactacaatttttattgcaaagtatgccatcagagtggcatattttatccagcagcaagcaaacatgaaggaagtttcccttagtgctttggtcaaactggcatggcagtcctgaacactgaatgaatatccaaagacaaggttctccaaagataaagatattatactatttattgataaatactgggagtgcatgatgaccattcagacacctgggaaaatgacttggctgaataacattgttaaaacaatgagtaaaaaaagagatgtgctcttggtaaaggaacacctggatccagggtataaagaccggaaagaagactaccgcagatttggacttttggatcaggacttggtaacattgaccctgtttacgacaaccaaaaacaaagcagtgctgtgtctacagtgggaatctgagtcaggaaactgcagcaggaacagcagaaaaaaggaagaggagctcagtgcaaacagaaggatggggagaccacagggaccaccaagaaggcccagagtgactttttgttttccgctcagggctgtcctcctcacaccccttggatcacacatttaatgaagacggctactggtatagtctaacttagcctgatcctcacacggttggtcctcagaagcttgaaattaactgctgggcaggaaaacctattcctggagacctctacagtgactgcttctatgaacaggttttgttagatcaacatgattaagctccccagttagagatctccagtgactggctggctgactgtggttggaaagaaggtctactttatggtgcagacctctcatgggatacggaaagggtcctggtactttgaaatcaccatgaatgagatgccaccagacaccactgccagactgggttgatctcagccctaaggtaactatgaagctcccttaggttatgataaatttagttattattggcagagcaaaagggaatcaatttccaccagtccactggcgaacactactgttttagctatgggcagggagacatcctacgattttatattaatcttcctgaaaacccaagagacagccaagttaccaagataaggctttgataaagttcaacaattatttttattttgtggaaaaagactttgtggctaaagcagggaagagtctaaaacagattccatatagtaaaataatattttataaacatggtgtcaatcaagatgtggcttcaaaagatatttttagggggttacttttagccatctcactggacaagagcttcatagtttccattaactttggactgtgctccaagtatcctccaaagaatctcacttactgccctgtgagtgacatgggctgggatgctgtggtagagcacactctggctgatgtcttgtattttctggagacaaaagaggatgggggcacagtcctccatgggaaccctgaacaggtccttctttcttttcagatatggactttctggggaataatattgggtggcttttgttgttgttattgtttttgaactgtcttaaatgttctcccaaagatgctacagaacatagcctatccatttaccaagttaaaaggctgagtaggactgtgagagatgccctgctcatcatcattcttcttccacttccagtgactgctcttatattctttgccataagccaacaaccgctcatcccaagatctcataatccctctgtaaaactgatgctgtactacataccttgccagctgggacttgtaatcttactgtattttctaaggagtgaataatcttgtccaggtaactaacatatttaaagacattttcttctgtggacactgactccatgccacctgttttccaaagaagtggtgaagctgtttctgagaacacctaaaatcaatggttgtacattccaaaccaatctaaaagtgatttccttttgctgtgggtttggttctattactgatttggaaatatacctttgaacactgagatctctgaaactactagacttctagaagtgtaattgtataagaagtctgtttgcagctttaacaaaatgagaaactcttcccaaattaaagctttctttgaagttaaaaaaaaaagaataatgtgagattggaacctgtgaggtctgaggattcccaagagtactctcaattctgacgctaattgtaacctaagggctccccaacagcccttcacttcttatgattccctagaaaaactcacataactccctgaaacctgtgacatttattgatacaaatttttacagcaaaataatacagattaagataattcaagggaagaggcacatgggcagagttcaggagaattccaagcacaagcacccagttgtcctctcccagtggagaaatagacagtgcttcattttgctcacagcaatgtgtgattctgtgtatgaaacacctatttcctgggtgagccaaccaggaaagctcacccaagcttggtgtccagagggcttttaaggggtggtctgggtgagagtggggttattatgtagaccttgtggatcatcctcaaggctcacttcagtttccattgaattaacaataaaacttaaaccttcaatctttggttattttctttttaaaaattctctgaagtaaattattattaaaattctcacttaagacagctgtttatccaatatgaggctcaatataaacagtttcaaaaagtcagtaggtcattaaaacaatttcttcagtcattcaaaccattcagataaaaattaacaccatgtaatacaaaaattgaattatagtcacagggacaggatttcagcaatggcaagaaaaagtagtgcaaataggaatgagcaaagaatagacaagtaatgggtgtgaattggcctcggaaataccatggtaatgtcaaaaagataaatcaattgttattttgttaaataagtgaaaggccaggcattctcagtccaggaaagccatcacagggcagtctgagtcttctgcatcttaagaagctcaagaggttcaaacttaataaaccctgcacagttgctcactggttcatgtaaaatgctagagcagttgcttcctcccactcagcaaatccacagcacacagtcaccctggtctggcccttcacagtgtagatgccctcagggctaagaacctgagtggttctaaaagtagtaaagatttgcataaagtaccacacaacacaccctctccacatagggagctcagtaggacataaagagccatcagaatccagccccgactctggagccaggagtcccttctaatatcagcatcatggcctggactcctctccttctccttctccccatgtacctcctcacttgctgcccaggttaatagagatttcaaataccagcctttggagggattcctgtgtctccctttctaattcccaacatgtgtctgttttttgtttcagggtcaaattctcaggctgtgatgactcaggaaccctcactgactgtgtccccaggagggacagtcactctcacctatggctccagcactggagcagtcaatgggggtcattatccttactggttccagcagaagcttggccaagcccccaggacactgatttatcatgcaagcaacaaacactcctggacccctgcccagttctcaggctcagtccttgggagcaaagctgcccagacactcttgggtgtgcagcccgagaggtgaagctgagtactactgcttactgcaccatagtcgtgcttggcacagtgacagactcagaagaggaaccgagacataaacctctctaggcccttgtgatatgaagatcatatgatcacgcacaccagctctcaaggcagcctacatgtggaccagccatagaaaggggaaggaaaggatctgaattgattcctatccctgcttaagccctgaagtgaaggaaatgtgagaatgatctgggaagaactggatcaaaaaaaaaatcagaagtttattgctttgtattctaaaaggagcactaacagctggatcagatctaaaggctgaggctaaatgcatttcctccagaaagaagcatcttcaaagtatggggtttctgagctaagagtaaagagaagaaactctacttttgtatatttctaaagtttgttttattgagttactttcaaagcaatacatgcctattatgtggaatcagaaagtattaaaaatcaccaagttctctgcaaagctaccttatcccagataatcaatagaagtacatttcttcatttggatgcattctctcatttttgttgtcaatattttcacaatggttatcaaaccttgtgctcattcctctggttttatacagctttttgctctgtcatttaatgttaatgtaagtagttttccatttatttgaaagggtaaaatatttgagtagttgctaattttatttttatttgaataccaatgaaaaattataatttggggtaattcaaattgcttgtcagacaaagatgtgacattgggctattattaaaatgctcctggtcttctctgtggatttagtgaagtcaaacaaaatgcctgcaattttctatggaaagccttgagtacattatgcctgacttcacaatgcagaaaatagagaaacaagaatttcctgctcatgtttgctggagcataatagattcaggtacgaggaacaacttatattgaaaactacgtcaatgtctccatgcatgtgttagaacagtacttcccaaactctattgtgcatacaaattatctggggattttataaaatgcagattcttattcagtgggtctggagtgaggacacaatctctgcatttctcacatgtgcctgccacacaaaatccacatatatatttgaataataacaagtccagccagcagtggaggctcatatgtgtaatcttagcactttgggaagctgaggcaaaaagattactcgaagccaggagtttgaaaccagccaagagcaacatagcaagatattttctctatagttttttttaaataataaaaaatgaattagccaggcatagtgctgtatgcttgtagccctaagtactaaggaggctgaggcaggaggagagcttcagcccaggagttcaaacctgcagtgagctatgatcatgccactgcacttgagcctgggtaacagagtgagaccttgtctctaataataataagaaaaacgacaacatatccataagactagtatcaaataaggagaatccttggcaggcaagaacctaggagaaatctctgacatagggaatttaccagcttgcatgatagaagaaccccacactccatggagggagatgaccagggaggacagctgcaaagctaggaaaggctcccctttctttgagagcaaaaacaaaagcaaacaaacaacaaacctgaccttccctctggctcctgtccaacactcttactggctcctccttcagcctttcctataatgtggcccatccttaccctctccccttccacatctctgattcctgaattcccttctttgttctctttccctttgctaccacccacttctcccctctaatctcttgagttaattatcaagggctttataacaggaaactcattggcattttttctgcatctgtccttgaagttgacactcatacttttatctctttcttgaacctctcagatatgcttagaactgaagaagcccgaagttgattgattctgttttttcacctcagccagcaccttcttcttctcctttccaggagaatctgtatttctctgtatttccagaattctctgtatttccagtgaatctgtcagacacagtaagtactcttcaaaggtttaatttctgacttcattgttctttgttctcgagatgaacttccttgtcccttctcctaagctacctgctctgtaaacaacttctcccaccagtcccaatctgtaactcacatctcctccttatttagaaagagtcctcttttactccttgctacccattctgtaaactgcccctcccacaaaactacccttcccacatttgccatgccctgacatgcccaaacataccttgtaccataatggactgcctctcccttcccacctaattagccatactcaattttaaacagtagccaatcaggtcagtttagattgtgtggtccaactccagccaatggggacaggacacagaagcagggactaaccacgttagggatgaaaaccccttccctcctttgtttggtgtgctcttgcagtggtcagaagtgcaagcggcactcttctgtagaaataagtttgccttgctgagaaatattttgtctgagtgctcattttccttgcgactctgagctcttgtttctaacaaaatagggggtcatctgggattcccattctcctctgaggaagggcctctgatcacctcttaggaggagatgcatcccactgcttcattgcagtggcctcaggggtaaggaatcaggacccacccagcatgataaataaacccagactctcagcaacacaggaagaaaaggcctacagttaccgtggcgaccaggtaactgtgcacagacaaaggtaagaaaaaccactagggcagtgaagtacttccttagtggtcaggacattctgcaggttgaaaatgtgtgaatgagatgcacaattaagtgcaaagtgagtgtggagtaaagtaaagggtgcaagaaatctctagtaagagaggttgagccccagggaaatggtgcaagaaatctctagtaggagaggttgagccccacgcacactcagcagggaaaggagagcgagaaacctccagtagcggggattgagcctccagggaaaagggtgcaagaaatctttaatacgagagattgagcccccattaacctccaagacgggagtgcaagaaatctctaatatgagagatatgagcccccattaacttccaggatatgaaataccctagtaaaacaagaactacaaagggcaaaggagataacacaattccctctgatagccttctaggtctcatgttaaaatattggagggataatgaaaggactaaacacaagaaaaagcaacaaatgatcaaatatgggaattgttttatttggaccaaagaacctattctcaaaccttcagttttctggccaaggtttggatcaaatgagagttggatttgtcaacttttaatagagtatgtaaatgacaaaagtcctgcttcccaagaggaaatagactctgctgtgtcttggtggcaggggccggtcctcctctacccccttaaaactagtaaggataagccagaaactaattcccctgtaggaactaaggccccacccctgagcaatccatgtgggatcccttagaccatctgcctccaccagatacccctaacttctctcaagcagccacccagacccttcccctgctcacattatgccctccctccttataatcctgactgttagggctgtccccaacctgaacgccctcctgcaagaaggcttcaacgtgagatagagcaatgtaaaaaggatattcaaaacttccctttcccctcctcctcaaaagagtctgccccaatcgtttttcccttaagggaagtgtttctaggaggagagggagttggctttgtaaatgtccccttaactagttcagaggtcagaaacctgagggaagaacttaaaccactattagattatccttttggggtcgtggatcaaattgaccaatttgtaggatcacaagtatacacttaggctgagctaatgtccatcttaagtgttctctttccgggggaggaaagaaccatgatacagaaggctactatgatagcctgggagtgcaaatatcctcccagtcaaaatacccctgcagcagaacaaaaatttctggcccaaaacccccaatgggataataacaatgcagccaactgagaaaacatgaaagaccttagggaaaaggtagttaaagggattcaggaatcagtgcctcaaacccaaaatatttcctgagcatttaatatacagcagggaaaagaccagggagccatggagtttttaaacagactcaaggaacagatgagaaaataggcaggcttaaacataaaggatccccttaggcagggatgttaaaactccattttgttactaatagttggccagatatcatgaagaaattacagaaaatagagacctggaaatatcggcctatagagggaacaagagggcagggagaggagagagaaagactgacagagggaacggagggagccagggagagagggggggagatacaaaggcagaaagagagagagggagggagagacagagaggcagatagatggagaggcagagagacagtgaggaaaagtcagagacccagacagagagggagagaaagagaggcagagggagagaaagaggacgaaacaaatgtttcaaatgtgaaaaaataggtcacttcaaaagagaatgtcctgaatgggaaaaagaaacaaaagtcatatataaaagcagatcagctaatattaaatttctgttaattccagaggcaggaacatatctattagggagagatttaatgctaaaatttggcttaggcctttatattaatcagggaaaatttctcatctccttaaacctactcaccaccacggatgaagagcgtatccatcctgacacatggtcaaaagaagaaaattgggggaaattacagttcctccaatcaagcccaaattaaaaactcctggggaggtagtaaaaaaccaaaatctttcttttgaaagctgagggaataacctcacagaccaaatagccaaacaagctgccatttcctctgaaacgcccatgtttcacctcaccccttgcctttctcccccaaccgccattgccatcttctcccctgctgaaaaggagaaattaataagaataggaaccaaggaaaactcagaagggaaatgggtgttaccagatcaaagagaaatgctatccaaacctctcatgagggaggttttatctcagctgcatcaaggaacccactggagacctcaagctatgtgtgatgcagttcttagagactatggatgtataggaatttatactctagcaaaacaagctacagatagttgtttaatatgcaaaaaaactaataagcaaaccctaagaaaaccatcctttggaggaagaaacccaggaaattaaggccattccaaagcatccagatagattacaccaaaatggcctcaataggtcacctaaagtatctaccagtaatagtggatcaccttactcgctgggtagaagctattcccttttcaagtgtagccaccagtaatgtagtttagacattaactgaaaatattatacctaggtttggattaatagaaaatattgattcagataatggaaactatttccctgcacatgtcattaaaaagctagcccaagtattacaaataagatgggaataccatatccctggcacccacctttatcagaaagagtagaaagaatgaaccaaatcctaaaaagccacctaatcaaactagttttagagactcgactaccttcctattgcctaattgagggtccgaactgcccctcggaaagatattggcttatctccttaagaaatgctatacgggttgccttatttacactccactgctgacattcctacatttgaaactaaagatcaatttctcaagaactatataattggtctgtcttccactttctcttccctcagaactaaagaccttttagcactgacaccacccttggagctcccagcacatcagcatcagcctgggatcacattctcatcaaaagctggaaagaaggaaaactcgaaccggcttgggaaggacactatctagtgcttctaactacagaaattgctgtccgcacagctgaaaggggatggacaccccacacacaagtgaaaggagtgattttcacagcgagagaaaaatgggccgtcaccccagggcccacccgcaccaaattaaaaagggctgaataatcatttgtttattttcccttttctttccaacagaaagtcacctcatcatcagtgtgcctcaaactaatcgtcccttaaccctccagttcgatgcttgttcagtcacctcatgtagagatgaacgagctcaaaggcagctatcaaatgtagataagtatctgtgtccgtaccgtagtgagtcaaccaagtataagtatagagccttaaaaagtccctgtggtgactggacagatgtttggtggaccacccaatatggagggtggacagccaggccccctttttcaaacaattctgaggactgaaacagaaactccaacttattcgtggtaccaccccaccaaattgtaagtcattgcagtgtaaccccttattgctaattatagataatccccaaacaatgacccaagaaccctccatattcgaatgatatgggttaggagcagatgttacaggacaggaccccataggaatcttctttctgaggttggctagaccatcagttaaaaacaataaagaaatccagacccagagtccagggaacctatgggagccaatgctctccccaaacatatcaggctcagcattctcttctcatctccagaatgacccaactaaggtaatggttgtggaggtaaaagatttaaagcagactacagctctagagacagggtacaaagacgcaaatgcctggctggaatggattaaatctcctgtccacactctaaacaaaagcaattgttacacttgtgcacatggcaggccagaggccctgattgtcccctttccacttggaaggtcctccagccaaccaggcatgaactgtatggtagctgtcttccaacaccccacagcctggggtaatgaattatgctgaactctctctctgctatttcctgaagtccagcaccctgtgggtcagcccctgagggccatccagcttctgtctcctgatgcaagtttcaccccatgtctctcacgacaaggggaaaacttagcatttcttggagacctaaagggatgcagtgagcttaagccattccaagagctgatcaatcagtctgccctgatccatccctgagcagatgtatggtggtattgctgcggaccattactagacacttccaagtaactggagtggcacttgcactctgatctaattggccatccctttcactctgacattttgtcaaccaaaaaggataaagacaaagcatcataaaacaaaagatgctcctcatgggtcctttgactctcatgcttatatagatgtcattggagtccagagaggagtgccagatgaatctaagccccaaaatcagatagttgcagggtttgagtccatactattctggtggttgactgtaaataaaaatgtatattggataaattacatctattacaaccagcaaggatttgttaactatactagagatgctattaaaaggatagctaaacagttaggacccaccagccaaatggtttgggaaaatagaatagcattagacatgatactagcagagaaaggtggagtctgtgttatgagtggaactcaatgttgtacttttatacctagtaatactgctcctgatggaaccataacaaaagcattacaaggtcttactgctttatccaatgaagtagctaaaaattcaggaataaacgatcccttcactaatttaatggagaaatggttcagcaaatggaaaagacttatgtcctcaatctttacttctcttgacattgtaataggtttgcttattcttgtagaatgttgtatcataccctgcacctgaggcctactacaaaggcttattgaaacaactctcactaaaacctttttcaaatccaccgcccccccaccttattcagataagctcctacttttagaaaaccaagcagaacaacagagtcaaggcatgttaaaaaggtttgaagaggaagaattataaaaatcaaaagggggaaactgtcagatacagtaagttcctcttaaaaggcttaatttctgaattccttgttctttcttcctgagatcaacttccttgtcccttctcctaagctacctgctctgtaaacaacttctcccaccagtcccaatctgtaactcacatctcttccttatttggaaagagtcctcttttactcctggctacccattctgtaaactaaccctcccacgaaactacccttcccgcctttgccacaccctgacttgcccaaacgtaccttgtaccataacagacagcctctcccttcccacctaattagccatattcaattttaaatagtagccaatcgggtcagtgtagattgtgcagtacaactccagccaatggggacaggacacagaagcagggactaaccacattagggatgaaaaccccttccctccttcatttggtgtgctctcgcagcagccagaggtgtgagtggcacccttctgcagaagtaaatttgccttgccgagaaatcctgtttgagtgctcattttccttgtgactctgagctcttgtttctaacaaatccagtgaaccacacaaatatactagccaattttctccaatccccaccattctgccttatgtgctgatctagtgaggaatcaaataggaagagagacccatggatttctatgcagcctgggaagtgagttcatggatgcactcagttgtaacaccagacacctgtctgccgtttgctgtttagcattcacagggcccagcagctgtgtcctcccagggtgcctggagcatcactgaccacaccctcctacctcccacccacctactcctcaaaaagaaaaatcagactcggcatcttatgtgaggggcacagccaggggtcaggatagatttccactgagtcccctcccctaagagacaccagggaagaggggttgttccgcctaatctatgtggctcaggaagcagagcactacagacatctctaccatggcctggaccctctcttcctcaccctcctgagtctctgcaaaggtggctgtgacatgactctgatgactggagaaacaccagggtcctttgtctcacactgagaaaattagtgacatggacacacattgagtggttttaaggaacagaaagtttaataggcaagaaagaagaaaacagctcccccatacagagggaggagggatcctaatggaaaatcccacatgcaatggaaaacagctgattatattgggaggctggaggaggcagtgtctgatttgcaaagggcccaggggattggtttgaccaggtgtgacattcatgcagcctgtaaaaaaaactggccctcccaccttagccttttaatatgcaaatgcaggtcaccatgatgtcctgcacatgtggcttttatctggaggctgccatgacacctggcacacgtggtgacaaaaagaggagggcgaaagccaccatattgggtggacctggcttctagccaccagcatttgcatatcagtgcttgccagtctggtttttcaagctgctttctgttagcaaagaaatggtttgggggtcgctttttattaaaggaaaattccaccgagaacttacaccatttctagctgcctaaaaattatttcttaatgactcctgttatttcccccctcaggagaagtaaacctaactgtcgttaggggatgttggacaacaattctttctggctacttccttctggaaaggggcgtcatgtaaggggacagcagttgggcctcctcctgaggttgatctaaggattctctgaagaatggcatgtccatgtgtggctctgtctgcagcattatttggagtttgattgcttctaggtgaaaagagataaatcttacaagaaggtttaaaatatagggttagaatatgagtattaagattaccactgttagtgggggtactatagaccacaactatgacagcagagtttgatacttgttagttacaccagtggattgtaatactgggttgtctccactagatgtcactgaatattaccagaaagattaatatgaaagtgacatttttccttgagaaaaccatacatttccccctttacttgccattagtgaatagttttaggcttagaccatttttataacttgcaatataattgggagaaatacattattgggtggctaaattaactttagtgttaatcttgacaattccttttctttaattattaaattatttcatgactttcacagaccctcttacaacatactcaaactttccgacttgtcctaaacatccttcctttaaataaccagtcatttgcttttaggacaagaatttcccacacaagatcttttcttatataaagttccttcttttataaccttctttctatagcttagagtgcaccatacaaccagtcttcaataaaaagtcctatcaaacttaatgatagtaaaactttcatgctatatccataactattactcctgctataagcaaaacagccttgactaaatctttcctgcaattgttaatcctgttataaggatgataattagacaagatgttacagcaattagaattttacaaccagaattccacattgtgagtgccatagtgtatagttctattgcaaatagtagtgtgactgtaacaattcccacaagactggcatagtaaataatttccattgaaaactttacttgccaagatataacatttccctttgggaatctacaaggttacaaatgcaattctatgaataatcaaaatctccctgcgaatatgcattaaaaagaagttctaatatttggtggcaaatttttagaggaaggggtacaaataataaaaagtggccgggcatggtggctcacacctgcaatcccagcgccttgggaggctgaggtgggcagatcacgaggtcaagagactgagaccatcctggccaacatggtgaaaccccatccctactaaaaatacaaaaaaattttgggaggctgagacaggtggattatgaggtcaggagatcgagaccgcctgtagtcccagctgctcgggaggatgaggcaggaaaatggcatgaacctgggaggcagagcttgcagtgagctgagatcgcgccactgcactccagcctgggcgacagagcaagcctccatctcaaaaaaaaaaaataaaataaatagctgggtgtggtggtgcatgcctgtaatcccagctactagggaggatgaggcagaagaatcacttgaacccgggaggcagaagttgcagtgagctgagatcatgccattgtactccagcctggtgacagagcaagactctgtctcaaaaataataaataaataaaaagcatctggtgaggtaggagtgggactgagtaggatgagtagccctcactcagttacttatcttttatgattttcagcttaagatcttctatttctccactttgatattcaggacgttcctctgggctgtcaggggttgctccctcaggcattcaggctttgacttgagtgtgatgtattcagaagttgacacctgtaacttttgctgccaagggggttgaaagagaacagtgtagggcccttcgcagcttggcttagggaaggagagagaggtgagagttttcactagtaccaaatttcctgggttaaataaaggtggttctatttcctggggctgggcttctgccagttgtgtcaatttctgttggaagtgaggtagagaggttacatgcttaaccaatttataggttttctgcctgaaaacagtctctgagcacattgacaaattttatcctttcctaagtgaaaagcttggtgaaggattttaagaactttccattggctggaggctggcaaatggagtttgccatcctctggctgtagccatcctgagagataaaaagcatacccttgagaagtggcctattctgtttctgcaggaaaatactgaggtttaatttctgttatggagcattcctagattagaagggggcttgaagtgtgttaatgccttgaggcttccttgcctttgacttagctgcctgattaatctatttcctttggctactttatttgctgccttttggtgttcctataatgtatccctgctatttctcacggcataaaaagtgaagataatagcctgctaattttctggtgatattttacaggaaatccattagtggtaagaggatgtctttccttttaaatggcagcatgagtatggagagctaagaaagcatacttggagtccgtgtaaatgttggctacctttcccttgcttaattgaagtgttctcgtaagagctattagttcagctaattaagtgcttgtgtctggggagagatgttgtttagagtgactactgcttatcctgccttatgtatttcttgctttaccggctgttagttaaaagcgccccctaaaggacagtaatcctgccacattacgtggggtgtaaacagttaagttctttcccaggattaatttggaggcttttctaactgtaaagctatcatgacaatggcttggaagcatgtgtaaataggtcctcctaactgcaactaaggttgagaaaaatattgtactagagtttttcctgagatgttccttatggtgatgctatgagaagaggggaggcctggattagagagaagaaaagagagagattggctttagtatttagaaggacatctactttccttcaatttccagaatcacccaggtcctggcaccctgttaaatgtgccacccatgtttgcaagcgtgaccctccaagccatggcaccagaggaactaagcttgtgggcctagtcgtgctaccccaagcagctctagtcctctgcctatgatttccctttgacttcctagacttgtgtgatctgtgtgtctcaccccacccccacccccaaaaaaatagatcttggcagaaactatatggaaggaaaggctcctttaatggagggaatgtgctagattgcctgctattatggcctgtgctaaagcatttacccttagaaaaatggttccagttaacttccagacttaaaatctccttactaattaagtactgttttaatcggagagagaacaggtgtcttaaaggaacgcggggacctaatggcgactttcctgctaatgggacagtatcggggcacaaattcggctgcagaggaattttactcctaatagttaaaagcagaattttcccgttcacaggagcagcataaatcctggtttccagtagaaaggtgcaaaaagaaaaaaattgagaagctgcggtgtaccgcggagatcagcaatgtgtcgcataaagaggattttatttccactaggtggcgctgttggcctagaaataccatgtgctcaccagaggaattttagggagtaacctcactgaggggcaaaggaagacttctgttcctagaagattgcaatggcattttcctgagctatctccccagttactacagcattttctgatcttgcctaccaggattacttccctacgctgtaaaaattcccgcacatttgacacacagagagagtaagagacataacgaccacggataaaaaaggaagaaggttctgcgacaggatagctagggatcctttaccaacatccagagcaggccgttggaggctgggtccagtcccgaaacctttgaataacaccaggctgtgccctggccagaaattctcagttgcttcagaacttttcccagcctcacgcgatggctaagtttccccatgaaaagaaactgatttgaagcatgaccaacattcccaaagacccgtgagtattgcgggttctccgtgttctgaccagcaagcctaacactcaagtctttagaacaacagccatgataagcgtatttagacggccaatggatgcccataattgatttgattttgattttaaaatagagaccaagaacctctgaatgacagaacagactttgagttcactcctctaatcactacgtcgatgaatgttgtaccttggattcccagtgaaggcaccagaaaggatacggctctgatgactggagaaacaccagggtcttttgtctcattctgagaaaattagcaacatggatggacatatgtggagtggttttaaggagtggaaagtttaacaggcaagagagaagaaaaacagctcccccatagagagggagaagggctccgaacggaaaaccctacatgtggtggacagcagctggttatattgggaggctggaggaggcagtgtctgatttgcacagggcccagggaatgagtttgaccaggtgtgtcattcacgcagcctgtaaaaaaactggccctcccaccctagccttttaatatgaaaattcaggttgccatgatgtcctgcacatgtggcttttatgtggaagctgccgtgacacctggcacatgtggtgacaaggagaagagggcgaaagccaccatattgggtggacctggcttctagccaccagcatttgcgtatcaatgcttgccagtctggtttttcaagccgctttctgttagcaaagaaatggtttgggggtcgctttttattaaaagaaaattccaccaagaactttcaccctttcttgctgcctaaaaattatttattaataactcctgtagtagctggagacaaggaggcagggatggcactgggaggaccagggctcttccttgctcccctggcttactgagccacctccctcaccctgtgtctctctcctgactctcagggtcctgggcagtcagaactcacttggtaacctgcacagtctgtctgtggctaaaccagtcaccatctcctgcactggaagcagcagcaataagggtcttgggattgtgtcctggtaccaacaatgaacaggaagtgtccccaaacctctgatccatagaagccaatatacacttttagggatgtaggactgattctcaagctatcagttttccaaaaaggccttcctgagcatctctgggctccaggatgagaacaaggctgatcactaatgttggcattagtgatcatgtttgtgatttgctataaaatcatccagcgatggagtaagatgatgggtaaaaagggttgaaagattaaacaagatgagtcacactgatgatgtcaaagctagctgatgggtgccaaggattcattagacaactctcagcatatttatataactcaaaaatttccataataatcactgcctaaaaaaatccatgtctgtgatgagaggtatatgtcctgcttttaattggtatgtaacctgattttaacaatgtggtatataatctgcttttaacaacgtggacaaaatgtaagcttacattctgacttcaagttgaagcccatcttctcctaacaggcaaaggaggagctggggtggaggctatgaaagggaccggagctcagcgtttcccaggacaaagaagtgagtgaggccggagtcccagcagaaggacgaggggctgtgagatgggctatgggagtgtgcaggggccacaacgtgcaggtcatgctgctggggccacaggattcaggttttatataaacaacaaggagccactgaaggtgtttaagccagggagtgacatgccacatctgaatgagaagcatctctctgaattccttgaggagacagtgtctgaaggaagtgagtgacctgattctagattatttactaaagcaccttgtaagtctagaaatccaggggccatttacaattagcacaagtgtagatgtgggctacattgaagaagtgatggtctcttgtcattcttcacagaactagaaaaaacaatcctaaaattcatatggaaccaaaaaagagcccacatagccaaagcaagactaagcaaaaagaacaaatctggaggcatcacactacctgatttcaaactatactataaggtcatagtcactaaaacagcatgacactggtataaaaataggcacatagaccaatggaagagaacagagaatccagaaataaacccaaatacttacagccaagtgatatccaacaaagcaaacaaaaatatagagtgggaaaatgacaccctattcaacaaatggcgctgggataattggcaagctagatgtaggagaatgaaactggatcctcatctctcaccttatacaaaaatcaactcaagatggatcaaggacttaaatataaaatctgaaactataaaacttatagaaaataacatcagaaaaactcttctagacattggcttaggcaaggatttcatgaccaagaacccaaaagcatatgcaacaaaaacaaagttcaataggtggaacttaattaaactaaagagctaaagaaaaaaaagagcttaattaaactaaagagctaaagaactaaagaaatcaaaataatcacttatagaatgatgaaatcggtgtctgggaatcagaacatggatgtgtgaatacagacagtgactggtgagctgcatggcaaaaggaacatcagcagagtaaacagacaacctacagagtggggaaaattcttcacattctatacatctgacaaaggactgatatatccagaatctacaaagaactcaaacaaactagaaagaaaaaaaaaactcatcaaaaagtgggctaaaggcatgagtagataattctcaaaagatgatatacaaatggccaagaaacatatgaaaaaatgctcaacatcactaatgatcagggaaattcaaatcaaaaccacaatgagataccaccttaccacctgcaagaatggccataattaacatataatagatgatggcatagatgcagtgaaaaaggaacacctctacactgctggtgggaatgtaaactagtacaaccactgtggaaagcagtgtggagatttttttaagatctaaacatagaactaccatttgatccagcaatcccactactgggtatctacccagaggaaaagaagtcattatacaaaaaagatatttgcacacacgtttatagcagcacaattcacaactgcaaaaatgtggaagcaaccaaaatgcccacaactcaatgagtgaataaagaaacaatatatatatgatgatatactactcagccattaaaaggaatgaattaatggcattagtagcaacctggatgggattggagacttattctaaatgaagtaactcaagaatgggaaaacattgcatgttctcactcagaagtgggagctggccaggagtggtggctcaagcctgtaatcccagcactttgggaggccgaggcgggtggatcacaaggtcaggagatcaagaccatcctggctagtgtagtgaaaccctgtctctactaaaaacacaaaaaaattagctggccatggtggtgggtgcctgtagtcccagctactcaggaggctgaggcaggagaatggtgtgaacctgggaggtggagctttcagtgggctgatatcatgccattgcactgcagcctgggtgacagagtgagactccatctaaaaaaaaaaaaagaagtaggagctaagctatgagaatgcaaaggcagaagtgttacgggaagtcagggaccccaaagggagggaccggctgaagccatggcagaagaacataaatcgtgaagatttcatggacattcattagttccccaaattaatacttttataatttcttacgcctgtctttactgcagtctctgaacataaactgtgaagatttcatggacatttatcacttccccaatcaatactcttgtgatttcctatgcctgtctttactttaatctcttaatcccatcatctttgtaagctgaggatgtgtgttgcctcaggaccctgtgatgattgtgttaactgcaaaaattgtttaaacaacactaaatctgggcaccttgaaaaaagaacaggataacagtgatgttcagggacaagggagataaccattaggtctggctgcctgagagccatgtggaacagagccatacttctcttctttcaaaagcaaataggagaaatatcgctgaattatttttctcagcaaggaacagccctgagaaagagaatgtgttcctaggggtaggtctctgaaatgaccgctctaggaatgtctgtcttttacagttgtagataagggatgaaataagccctggtctcctgcagcgctcccaggcttattaggatgaggaaattcccgcctaataaattttggtcagactagttgtcttttctcaaaccctgtctcctgataagatgttatcaatgacaatgcgtgcccgaaacttcattagcaattttaatttcactccggtcctgtgatctcgccctgcctccatttgccttgtaatattttattaccttgcgaagcatgtgacctctgtgacccacaccctattcatacactccctcccctttgaaaatcactaataaaaacttgctggttttgcagcttggggggcatcatggaacctgccgacatgtgatgtctcccccagacacccaactttaaaatttctctccttccctttatttctcagaccggccaacacttagggaaaatagaaaagaacccacactgaattatcgggggcgggttcccctgataagaagaatgacacaatggactttggggactcaggaggaaagggtgggaaggagggaaagtggtaaaaactataaattgggtacaatgtatactgctcgggtgatgggttcagcaaaagctcacaaatcaccactaaagaacatactcatgtaaccaaatatcacctgttgatattactcctatcaacattactcctacctgtgtctgtgtatctttgtcatgtgacttatcccccttgactttgtgcttggccctgttctcactttgagtaatggaacatttgtggaccttatgcaagctcaagtttaaatgtccttgcaccacttggtttgccctcttttgcaactctcattactaagatcttgtcctggatagtttttggcccttcaggctgggtttccaaataaacacgtgtgagtaataaatgctgatatttgtgactgttacatagcaatatatgaatgatacatctaacataaagcagacactggatattggtgtggtgagtgaaaacactcaggcttgtatgtatgtagattcctctcccacagagggcagtcatcaatattaccaactcaactaagaggatgattcttatttggtgcagtttctctaattccaagagcagtggagaagtctaataccagggcagtgagcacgaccatctgaacaactcttccttttatgctggccctgacgcatcctaacaggccaagaaacttggaagtgcctccctggaggcagctgggagagtgatgacagatcgggctacgtgggtgatttatttatattcttctattgtctaagatggatatgtttatttaaaattggaaataactgctataattaaagcattgaataaaactaaaattaagaattaaaaatttatatattctccaacatcctatcagtcaaagaaaattacaggtgggtattaaattgtcagataaaagaagaactttcagagcaaaggaaagaaatgaatatttataatctccaagcattgcatgtatattttctctaattctaccatttggctacattttaaggtgccctaaaatttgctttttttttttaaattttctttcgctttccaattctatctcattatcacccatgaagtcccatctttatttttttaacaacaaaatattaggagaaaattaatcatcatttaatccatttatttttatttatttatttttgagatggggtcttgctctgtcatccaggctggagtgcaatggcacaatcacggctcactgcagcctctgcctctggagctcaagtgatcctcccacctcagccttccaggtagctgggactataggtgtgcgccaccacacctggctgagtttttaaaatttgtatagagatggggtctcactgtgttgctgaggccggtctcaaactcctaggctcaagcaatcctcccacctgaacctcctaatgtgctgggattataggtgggagcaataatcatttaatctaaaattctctcagatgagtaggtatgggaaaatttttaaaaaaataataatattaaaataataatataatctaaaacctttttttcacaaatatatctcaggcccaaattttcatccgtccatccatacattcatcaattcattcactcaaccatcaaacatttatttatttatttttttgagacagagtctccctccattgcccaggctggagtgcattggctcgatctccactcactgtagcctccgcctcccaggttcaagtgattctcctgcctcagcctcccaagtaactgggactacaggtgcaagctaccacacttggctaattttttgtatttttagtagagatggggtttcaccatgttagccaggatggtgtcgatctcctgacctcgtgatctgcccacctctgcctcccaaagcgctgggattacaggcatgagccaccacacccagcccatgaaacatttattaagggcccattctgggtgacatattatgttaggttggactgtgagggtataaatacaggacaaatgagaagggttccttctgtcaaggagaacacactcgaagatactagaaataaaatagaaacttctacgctaattactaatacagagaattaccagatttttgaaagctcaactaataaagcaaccacccttttctggatatatcaagaaagtgtctgccttggatgtgggatcttagaaaaagaagagtaagtatggaggaaatgaggtcatctccaacagagggactgtgtgatagtatggactgcatatttctgtctcccccaaaattcttagattgaaaccctaaccccccatgtgatagtatttggaggtagagcctttgtgaaataattaggtttagaagaggacatgagagtggagccctcatgataggattagtgtccttaaaagaagaaaaagagactagatctttctgccatgccaggctacagagaaaggtgccatctacaaaccagaaagtggaccctcgccaagaaccaaatctgcaggcaccttgatcttagacttcccagcctccagagctatgagaaataaaggtttgttgtttaagccatccagtctttgctattttttttatggcagcctgaactaagacagcctggcaaacacaggaaaggaagctataaaagggcacaatgggctgggtgcagtggctcacgaatgtaatctcagcactttaggaggccgaggcaggtagatcacttgaggccaaggagttcgaaaccagcctggccaacatggtgaaactccatctctacagaaaatacaaaaattagccaggtgtggtggtgggagcctataatcccagctactcaggaggctgaggcagaagaatcactttagcccaggaggtggaggttgcagtgagccgagattgctccactgcacaccagcctgggcgacagattgagactccgtctccaaaaataaaaggcaccaatgactgtgtgttgagtgaccaattgtgttgagccatagaggaaagatgtaggcaccagtgacttgtccaggatcagggatgacacacttctttttcttgatagctattctgtcctctcccagacattttttttttttttttaacactgctgtcgcccaggcaggagtgcagacatggctcattgcagcctgaacctcctgggctcaaatctcccacctcaggctcccaagtagctgggaccacaggcatgtgccactatgcttggctattttttttttttatgtttcgtatagatagggtctcgctatgttacccaggctggtcctgaactcctggcctcaaatgatcctcctgccttggcctcccaaagtgctgagattgcaggcatgagccgcctcacctggcccctctcccaaactttcttttgaggttaaataatgtaaaaaggaagagtgtgtagaacaaaagtaatagctaatgtaaaaaaaaaagtttaaaacaaaaattatccatatctcactacttagagataaccattatatatattttgacaacaaatacccttctggatttctgcatttgctctgtcagatgttagttgaggtgggacagggaaaggggttaagggaggaggcaaggaaagaagggtcagaatgcaatttatcttacgaggcgttttcccatttagtaatacataatcaacatctctgcatgttttcaagtatataaagctccttagatcattacttattcatagtattacagggattctatgttttctctattataaactacatgttgttgaacttctttcaaactacatctattcatacagcaagtcatttactttgtaaaaattcctaaacttaaatatctggttcaacacaagtatgcaaaattttgtacagattttatttaccatagaactatggctacaaattaaatgaaaataatagtaataaattataataatataggagtcacctcacagatgtttccagtcacaaagtaaggcttttcctgctttgtacttaagttgaaatccccccaaagtgcataaaggcggatacatcctttctagggtacccttttcaccctgtagatgaaccctgacgtggccaactgatctaccgacagtagtacactctagatgtcttttattaaaataatagataatagagtaatccacaaactaggaccttacacacatacgcacagagcaaaagctcctgaggtgcagagcctacaggaaacctcatcaaaagctctgatggctcctgtcgatgagcacctttaggaggggctgctgttgtcttaagtcagaacagagatagtttgtgcctctccattttgaaatgctccagatttcccttccctgtcttggtctctcagagcctaatgtctgtgctggactagcatagtcagtctttggttatgtgtctgtattttctatttaaagtagtctaggctgggtgcagtggctcacacctgtaatcccagcactttgggaggccgaagtgggtggatcacaaagtcaggagttacagaccaccctgaccaacatggtgaaaccccatctctactaaagatacaaaaaattagttgggcgtggtggcgaatgcctgtaatcccagctactcaggaggccgaggcaggagaatcgcttgaacccgggaggtagaggttgcagtgagctgagatcacaccattgcactccagcctgggaaacagggcgagactccatctcaaaaaaaaaagaaaaaaaaaacattagtcggggtggcggcgggcgcctgtaatcccagctactcagaaggctgaggctggagaatcactgaacccaggaggcagaggttgcagtgagctgagattgcaccactgcactccaacctgggcaacagagggagactccgtctaaaaaactaaaataaaataagatactctaaagtaaattatttaaataattctcatcttaagcaagcagtttattcagcatgaggttcaaagtaaataacttcaaatcagatggtcatgaatataacttctttagtcattcaaaacactcagataaacaagacggataacactgaaatgaaatacagacaatgcagtggattttcaacaataactacaaaaaggactgaacaaagagacaaacaatgaatgtgggcttgcctaggaaatacagtagaaatgtcaaaaaaagttaaatgaatgagaggggtactacaatcctccaccccaggaaaccacagcaaggtgccgtggatcctctctgaagcctgacgttcaggttgttcatattttaggtaccctggacacttgctcataggccctgcaagaggttacagcagctgttccctcccacagggcaaagccagatctcacagccacctaggcctccccatgacagggagttgctccctgggacaaagaccagaataggaggaggagggagagataaaaggctcagatttgcataatgtgtcccacaaatacctaacctttatgcaagaggtgaggagggcataaaagagccattagagagtccaacactagctgtgaggccagtgggcccttggaacttcagcaccgtggtctagactcctctcctcctcctcactcagtcactgcccaggttcacagagatttcagatcagcctttagaatgattcttctgccttcttttgggagaaagtgggtctaggaaaaatagaatgcaaatatttttccaatccatagggaacaataagaggtatactagatgaagagtttatggtcaaatattttttcaaaaaaaaaatctctctatgatgtaattctgactgataatagcaaagaaaacaagctccttattttatataaaaaatttttctttttttttttttttttgagatggagtcttgctctgtcacctaggctggagtgcaatggcacgatcttggctcactgcaacctccacctcctgggttcaagtgattctcctgcctcaacctcctagggattacaacctcctagtagctgggattacaggcagccgccacaacgcccggctaatttttgtatttttagtagagacagggtttcaccatgttggtcaggctggtctcaaactcctgacctcgtgatccgcccgcctcggcctcccaaagtgctgggattacaggcatgagccaacgcgcctggcctaaaaaatttttcaaaacaatgcaagtttactacataaaatctggctttttttttttttttttttttttttaatgatgtggtcctgctctgtcattcaggctggagtgcagtggcacaatcactgcttattgcaggcttgacctcccaggttcaagctatcctcccctacctcaatctcccaagtggctgggaacataggtgtgtaccaccacacttggctaatttatttattttctgtacagcctggatccccctgtgttgcccaggctggtcttgaacttctgggctcaagctatccttcctcctcagcctcctaaaattccggaattacaggcgtgagccaccatgcccgacctagaagtatttgtttcaaggagcatatttaactacgccgtaaagaccaaatagttcagaagttagatgttacaattttagtctcttctcctacttcttcttttttttttttttttttttttttgagacagagtctcactctgtcacccaggctggagtgcagtggtgcaatcttggctcactgcaatctctgcctcctgggggggtcaagcaattctcctgcctcagcctcccgagcagctgggagtacgggcatctgccaccacgccggctaatttttgtatttttagtagagacggtgtttctccacgttggccaggctggtctggaactcctgagctcaagtgatttgccccgcctcggcctcccaaagtgctgggattacaggtgtgaaccgccgcgcctggctgttctttcacatattttctccatagttcagatcacaatgtatacaaatttttttcctgctagttttctttcacattactgcaatctatctcttttaaaaaaagtatatagtgcagctatttcagccaggcacggtggttcatgcctgtaatcccagcactttgggaggcagaggcggctgaccacttggggccaatgagtttgagaccagcctgggcaatgtggtgaaaccccatctctactaaaattacaaaaaaataattagccgggcgtgggggcccgcggctgtaatcccagctcctcaggaggctgaggcaggagaatctcttgaccgcaggaggcggaggttgccgtgagccgaaatagtgccactgcactccagcctgggcgacagagtgagtgaggctccgcctcaaaaaaaaaccaaaccaaaacaacaataacgaaaaacaacaaaaaaagtagattgtgcagctatgaaatgaaaagtacaaaactgttcagtttccaggcatttaaaattatttctggccaggcctggtggctcatgcctgtaatcccagcactttgggaggccgaggtgggcacatcacctgagatcaggagtttgagactagcctgaccaacatggagataccctgtctctaactaaaaaaaaaaaaaaaaattatttctactttacatttacattagtacaaccaaagtattgatgaattatcttacatactcaattttggatatatacataaacattcattctgtaaatttttattggatatgttaaaagcatcccatgaggccagcagtggctcacgcctgtaatcccagcattttgggaggccaaggcaggtggatcacctgaagtcaggagtttgagaccagcccggcctacatggtgaaaccctgtctctactaaaaatacaaaaaattagccgggcatggtggcaggtgcctgtagtcccagctacttgggaggctgaggcaggagaactgcttgacccctggaggcagaggttgcagtgagccgagattgcgccattgaactccagcctgggcagcagagtgagactttgtctcaaaaaaaaaaaaaaaaaaagcatcctatgaaaaaaatgaaattattacctttttattcatatattgaaataacttccaaaaaggcttatgccaattgaaactccttttaatacatcctcactgacagtaaacattacaatttatataatattcatcagtacgctaccattgctttaattcccatttttgtttttgctatggagactaaatattttgcatttatttaccaatcagctatatttattctttgtgaaatggacagggatttttttctttacaacaattttataatagtgcattagagatttgtcttagtaatctttttttttttgagatggagtctggccctgtcacccaggctggagtgcaatggtgcgatctcagctcactgcaacctccacctgctgggttcaaataattctcctgcctcagcctcccaagtagctgggattacaggcgcccaccaccatcatgcccagctaatttttgtatttttagtagagatggggtttcaccacattggccaggctggtctcgaactcctgaccttgtgatctgcccaccttggcctcccaaagtgttggaattacaggcgtgagccaacacacccggcccccgatttttcttagtaatctttggaaacacttcagaaatatttttaattagccctttcataatctcaggctataattttcctgtttatatgccataaaatgtgaacatgttacaccgtcaaataaaaaaagcaaggtgcagaagactgtgcataatataaatcagttatttaaaaaaaagaaaagaaaaaataagaaactatctgaaaggctaaaaaaagaatctgagttgttactttttcgatgtttgaagaatgtgaatatattatatactcaacattttaaaataaatgaactttaaaaagaatcctctcaaaatggtgtcagccacaatggcacaccagagagtgggaaggcaacacaatgaccattaactcagttttagctgccttccttgtatcataaaaacttctaatgttccattttccctgtggtaacttccaagatggcctccagtgattccccaccctctggtattcctatctgtatatggtccattcccacatagcatcagggttgctctgggtgaccaagagtatacaacagagtgaagttattttacctccaaggctattataaaaaacattgcaatgccttccttgttctcttttggatcactcattctgtaggaagccagctgacatgtcatgaggaccatatgacaaggaacagagggaggcctcctgccaatacccaagtgagtttgaaagccctagtcaagcctttcacatgatatggccccagtcaacatcttaactgcaacctcatgaaagaagctgagacagcaccactcagttaagtgaccccaaattcctgaccctcggaaaccatgagataacaaatagtggtggttttagttgataagtttgcagtaatatattatacagcaataggtaactaatacagattttagtacctggaagggaggtgctggtgtaatacctaaaatgtaggagtggctttgaaactgggcagtgggcagaagctaaaaaatcttcaaggagattgtcagtgcaagccttagtagaaaactggactctgagaaggctctggtgtagcttaaaatgaagtgaggaacatgttattagaaaattgagcaaggggttacgtagttacgtagtggcagaaagtttagtgactatcacctagtcaggtgaaagtagaaaatgtacctgagtcatctaattgagatttccagccagaatgctgaaagtgctgattggtttcttcttgctacttatagtaaaatctgaggggacagaaacaagctaagggaagaagtgttaaacaaaaaagagccaagagccaatacctgctggttttgaaaattcccagtctttccagatggcaaaagatgctaaaattaactgctcccaagcaaaggttatatccagggcactaaagaaaggtgcagaaatatgaaagatgagggtaaaaatcctttttactttttctttgagacagagtttcacccaggctggagtgtaacggcttgatctcagctcacggcaacctctgcctcccaggttcaagtgattctcctgcctcggcctcccgagtagctggagttacaggtgcaggccaccatgcccagcaaatttttttttttttttttttttttttttagtagagacggggtttcaccatgttggccaggctggtcttgaactcctgacctcaggtgatccaccagccttggattacaagtgtgagccactgcacccagtcagagggtaaaatcctttaaggctctgaaagatcaaaaatgatgcttcagagtacagtagtcccctttatctgtggttttactttccatggtttcagttacccacagtcaattgtggtccaaaaatattaaacggaaaattccagaaataaacaattcataggttttagtttatttatttatttatttaatgacagggtcttgctctgtccttcaggctggagtgcagtggcgtgatctcggttcactgcaacctctgctcctcggcctcaagcaatcctcctacctcagtgtattgagtagctgggattacaagtgcccaccaccacacccaactaacttttgtatttaagtagagatggggtttcactatgttggccaggctgttctcaaactcctgacctcaaatgatctatctgcctcagcctcccaaagtgctgggattagaggcgtgagccaccacactcagccaacaattcttaggttttaaattgcatgccattctggttagtgtgatgaaatctagtgcagtggctctgagttccattcaggacataaatcatcccattgaccagcatctctatgctgtgtatgctatgctcttgtggtgttataatatacattggttttgtccacagttcataactcccacagcccttgttacagtcttttgttataatgttcggtgttaggcctcagaggtaggcttctgaccttctgccatccttttacctgccccaaggcaggactctaatctttctgattgtgggttctaagaccctcccaagagagaatcctgccctatactctagcgggagagaatgcttaagtcatgaagcttccataaaaacccaagaagactgggttcagggagcttccagttagctgaacaacacttggaggttcttggaggttggcgcactcagggaagccatggaagctccatacctctttccacacaccttgccctgtgtgtctcttcatctgtatcttttgtaatatcctttataataaacctgtaaacgtgtttcctcaagttctgtgagctattgtggcaaattaatgaaatccaaagagggggttgtgagaaccccaacttgaagtcagtcagtcagaagttcagtatacccagacttgggagtggtgtctgggggtatggggggaagtctggaggaccgagaccctaacctgtaggatctgacactaaactgttccaggattcctgacactcagagactatgtgagttaatgtttaagctgttagttttgtggtaacctgttatgcagcaacagataacacattcccttccctgtttgcaaagcacacaatcccacccatcaaaaaacatggaaaaatggtactaaggtttcgatgtgtatgtttatacacacccatgcacacatccctcagacagcttttctgtcatttctgacattgtgcctctttctactgttttggattctatcaatccctggataggatcaaggaataaccccatcccattcacatccaaagttctaagccattagcccacatacatgaatacaggggaagatacaaatgagtctaagttataactagagcaggggtcagcaaacttttttctataaagtgtcaggtagtaaatattttaggctttgctgggtgtatatgggtctctggctctaacaatgttttgaaaatttaaacttagcctaaaagccacagtttgccaatgcttgccctaaagctaagaaagacttgtgtcttagtggcagtcttgccacacattgataattgttctaatttcaatctcataaccgggaaggaaagagtctaaaagggctaaccactgaaatggaatttactttatttatatgatgaatgcttttaaaagacaaaataactcacttatataacatttgtctgtttttttgagagagtctcgctccattgcccaggttggagcgcagcagggtgatctcggctaagcctccaccttccacctcctgggttcaagcgattctcctgcctcagcctcccgagtagctgggattacaggcacacaccaccatgcccagccagtttttctatttttagtagagacggggtttcaccatgttggccaggctggtctggaactcctggcctcaagtgatccgcctgctttggcctcccaaagtgttgagattacagttgtgagccaccataccagcatttgaaagaataaaaatcactatgggattaagtaaactcaattgtatttagaatttatcattcttttccatagatgttatcatgaataattacaattgcaaagtacatataactttgtatgttcctttcttattttgcattatagccaaataaaattgtgtactgcaatagctcctataatcactacttttgataactgaatactgtttgtagtaggtatatatttaataatttgactttcagtttggtttccaagttttgggttttttgtttgtttttgaggcagcatctcttgtcacctagtggtacaatcataactcactgcagacctcctggactcaagccctcccgccccatcctctcaagtagctggtcagactacaggtgtgcaccaccacgtcttaattttttttttttgagacgcagtttcactcgtttcccagactggatggagtgcaatggtgcaatctcagctcactgcaacctccacctcccaggttcaagtgattctcctgcctcagcctccccagtagctgggattacaggtgcccgccactacgcctggctaatttttgtatttttagtagagacgggttttcaccatcttggccaggctcgaactcttgaccacatatgatccacccacctctgcctcccaaagtgctgggattacaaacatgagccaccacgcccagctggtttgaatcctttgttaaagaaaattaaaaaataggttaggcatagtggcacacacttgcaatcccaacactttgggaggccagggcaggaggactgtttaagcccaggagttcgagaccagcctgggcaacatagcagaaccctgtctctaccaaaaaaaaaaaaaaaaaaaaaaaaaaaacctcacaaaaaacaatgctaaagaaagcgaatgagatataatgaataaaaacaaaaatagagaaaacaaaactaaagcaaatggggggttgcttcttggaaaaagtaaatcagaaacattgataaaaccaggacgaattaatgacaggaagaggaaatacactttaatattagaaatgagaaaggaagtgggattccgagtagttaaaaccatatcctatcccaaacagaactacttttgcttcaggaaaggaaggtttctaacaagaaagctgtaagtgcaaccaagtaaaaacttgggttagtaaagaaaatgattgtcttaatagatgttgtaaattataaaactaaataattctctttaaagattctaaaaaatagaaatagaaactttttttttttgagatagagcttcgcttgtttcccaggctggatgcaacctccgcctcccaggtacaagcgattcttctgtctcagcctcccaagtagctcggataacaggcatgcgccaccatgcctggctaacttttttgtatttagtagagagggggtttcaccgtgttaggctggtcacaaactcctgacctcaggtgatccacccgctttggcctcccaaagtgcagagattacaagcatgcgccaccacacctggccccaaaaatggaaatagaaattatttaagcaatatacttattacctttaagggcaaatcatttcttattaaagccaagaacaaagaagcccattaactccatcttaaatattgtttagaagttctggctgtagtgccgggcacggtggctcacgcctgtaatcccagcactttgggaggccgaggcaggtggatcatgaggtcaggagatcgagaccatcctggctaacatggtgaaaccccgtctcttctaaaaaaatataaaaaattagccgggcgtggtggcgggcgcctgtagtcccggctacttgggaggctgaggcaggagaatggcgtgaacccgggaggcagagtttgcagtgagccgagatcaggggccactgcactccagcctagctgacagagcgagactctgtctcaaaaaaaaaaaaagttctggtggtagcaataaggctaaaaatgaacacaagtggcaaaaaggcaaagattatacagtggtactaaataaaaattaaaaactaaaaataggccaggcatggtggctcactcctgtaatcccggcactttgggagaccaacgtgggcggatcacttgaggctaggagttcaagaccagcctggccaacacgatgaaacctcgtctctacgaaaagtacaaaaattagctgggcatggtggcacacgcccatagtaccagctgctaggaagaatcacttgaactcagggggtggacattgcagtgacctgggatcgcgccactatactccagcctgggtcacagagcgagactctgtctcaaaaaacaaaacaaacgtcccattttacttatggtggaaagacaatacagcaacaatacagcaacagcatttttttcacaaaacattttattactataattgatattttacttataatttttggcaacattaataaaataataaatttcacctgaaagaacaagcgagcaaaatagacaaggaaattcacaaagggcaataacaaaatagtaatcttgacatattcaatatatttgtaaacaaaacaaagtgacattgccttaaaaatatatagaggtatcaatagaaaaacagagaaagctcctgaaagaactcactatattaattttcatttggttgcaggcacagaaattgactcaagctagctcaattctaagacagaagcaaagcccttgatgctgatcgctttccagctttttcatgaaaacctaggaaatttaaatactttgaagaggaagaaaagagtggggagagagtaaagtgcctttaagaggaaaagtagaagtttttttttttttttaaagggagatctcattgtcagtggcattttaagagccttgaagctcaatgaaccaaaggaagtgtcaaacaattaagtgaggtagcaagccatgcaggcctaggggaagggcattctaagaaagacaacagcatgtgcaaagtctttggattgggaagaatgtgatttgcttaaggaatagcaaggccagtgtgtcaaaatagtgcgtcattggggaaaacagtggagaagcatgacagagaatgaaaaagagaggaaggaggtaggcaggggccagatcactggaatctacagttggcaattaatgaccatatgtactccttaagagcatgctttaatgaaactgcaaacaacagtgttgataataccaaccaatcactcaacatacaactaaaacacttcatatttttaccacagaaacagaatacgggaggtaagtatgaaaagtctgtagatctatttatacacagtgggagtatctacctgagacaagaaaaactggcacacacacacccacttgcacacacataccctttcttcaactaaagaaaggattcaggctgtaattttagcaaagtgtcttaacccaagcaacgtaactgaaaagacctagtatagtgttcaaggtgcaaatcaatcaaatgagtgtccggcaaataaatacaacagaatctatggatctagagtcagaaaattttctaaaatgtagataatatactcacaacttctttgttatctgtactgccttctactctaagagggatgctaagctcttaattatctcttcccggatttttgtgaaagcttaggaaatttaactagattgaggagggaagaaaggagtggggagagataaggtacctttaaaaagaaatcaaggaaaaagggagagatttctccagacctatgtctacagccaagatggcggattccttgactggtgaagacaggctgctgggcaccttggtcaggggtggaggaacaaaggatggcaccagaacacaagcagggagacaactccgggagtccacagaggcagccaagactgctgatgttcaggaaccaatactcaaaaggtactccagaatactgtgaaacagcccctggggagagcaagggaaaaagattcacccatagtacagattagataggatagatcagatgaaggacattaactctaagtcttaaaacttattgaattagagagacatttcttgcacactggtgtgtgtcaggtaagacccaaacagcattagtgtcaaaaaactgggaaactatacatttaacagaatagctgcaagctgtaatacattcatgtccaaagcaagacataaagttgcaagcttcacatgttcaattagggtaagatatatatgcacagaaaaatataaagccattatgggtttaaattcagtcagtcaccctgggctatttttgtccactgtacctactgttgttgggacagtcctcattccagcttaacagtgggaaaactaaatttagcccagtccaggaactggacagacaccacttgtttggcccttttcagttaaaactatgggtccagtacagttcaaattatagatattagggcttcttccccttgggaaacttgctttacagctgtggctgagaatatggccagttcattctccactaacggctagccagaagggagaggagagggaatgaatcaaattcacctttagatcacagaacaggaagtcagctagtaccaggcaccattctattaattttattgctatttcacctcaaaccaatgatacatgacggctgtttgatgtctgcaggggcccttcaccaaacaaaaccattttactttgaatggtttggcttccttggatgttttcaggtaggtaaagatactctgaagcagtgttccttttgacctggccccaagactagaatgaatgtgtgcctatccttcaactagaacaaagaaccactgctctccctcaactaacctccgccttcttggtctctgctcacgcagcagcttctctttcaattccacatcctggcttttcagaatcttttcaggttattttatgccagcacagcagaggcacttctgggaattcggcagcaagtgggccagggcataacaaagccattccagtctgactagagttaaccatgaaatgctgaatgcatggaaaaagctgtaaagaaaactaagtatttcaaaaattctatgaattctgtatatagaaaaaagagctttcaagcttaggagtaacatgaaataccaaaacaataaataggtgccaggggcagtgactcacacaacccagcacttggggaggctgaggcaggaggctcccctaaggtcaggagttcgagaccaccctgggcgacataacaagattccatcgctacaaaaaattaaaataaaaaactagctgggtgtggtggctgcgcctgtagtcctagctactctccaaaggctgaggcggaggaatgcttgagcctggaagttcaaggttgcagtgagctaggatcacgccactgcactccagcctgggtaacagtgagaccctgtctctaaagtaaaaaaaaaaaaaattaaaattaaaaaaataaattaatacctttctctctcacacacacacacacaaacaccttttatgtgttaagccagatacagttaacatgaaaaccagatgttttaaaataatacctcaaaattcagatcaaataatatatatcctgaatcttgtttaaaaagtcatatataatccactagtttcactatttttggtgctactgaataatgtatggtttgtattttttgttttatgaggttttttaatttggtttgaaatacttgctttagatttactgaaactagaattaatgggacttttttgaaattttgcttttagacctggggagtgatggttcagagtcagatgtgctcacagttatggatgctacatccactgatcctggctgaagaggttccagtgacacttgaatagtaacttttgtttcaggaggtaatccttctagttgcttaggcttcttaaacatttgatgacactgggtcttgtgctccattttctccttgaaagttaaaaactgtagccggcacttggaacactggtgtgcactctttccccagtggcccctataatgacacatgtatggtgttgctgttttgaaaattttgagacaaaagggacaaagcaaattctttgtgttttcatggcacgttctaaaatgtgtttctacatcagcaaagaccgacgatctataatggcaaacctggcacacatagggcatttcgccaggcttatgatggtccttcatgtgttgtaagaggacctgatctgtttcaaatgacaattcacagattttacagacagtagagggctcctgggcagtgtggacattttcgatgtgacactgtagctggaagggagtgggaaactgccggtggcagtgctggcaggtggtgtggttttcccagctgtcgttcctctgcttctcaaattccaaatgatgcttcacgtgattcataaacttaacattttttagaactttcacgcagctgaggcatttaaaggtggtgtgagtcttctgttccggctgcccttctcctttatgctgtccatagtaaaagtcactaagtaacacaatgggattttctttcttgggatcaaaggtcttgttttgacttgttagactcaaaatgtctgtttttgccaattcattttccctatcaagatttgtatttataggcttgaaatggatattgtcctttggaaaagctgctggaaaaggtgctccattctgaacatggcttaatgaggtatgaacattatttgagggtgtactttgctgagtattcattgtatgaaaggtatctgaagggaacgaagctgaagaatttccttctataattccatccctgagtttagcccttttgggatttatgctgtttacttcgaaagtggaaagttgctttgatacacgaggactttcatttatacctcctactgaaagtgctgtacttactggatgatgcaatgaatctgtgaatgtaatcaaaggagaaggtaattctgaagagttattaggcacaacttgtggtgaactatttctataatcaggtttagacaaaggctcaataataataggactatctgttgatctcgattcaagttgggaagctggcaggacggtcactgcttctgatgtaacggtctcatgacttttaggctgcaatttgcgagcagtatcttttctaaggtgatcatacttttttctccttgaccatgaacccggggtgactctgttcaaaatgtttgaaacgactggttttgaatttgaagtcaccccaacaaagattagctcagcatcttcatttacatgttccacaccaacaaagatgagctcagcatcttcgtcatctacttgtttggtttcttgtatgttcttctgtggttcaggctctttctcttcctcacatgattgttccattttctaatttttttattcctgaatggtggggccacaagtcccaatgcttcctttatataaactgccacctaagtacaaacatacatcagtaagtacaggaaaatgcattaccttatttaattttcctccaaaacattgtttttataaaccactattttacccacaaggacactgagactgaaagaggataaataacagcttaaaacctgtgataaaagatcaggttcctatgaatctagaatcataactttgctgtactgattgtgctctattccattttaaaaaaaaaacctaccagcagctaatcactaggcaaaattatatggaaaagacacacatttttatgagggcatcattgtgcagtgtttagaaacatgggctttggagttgaagagtaagctggaatccttagtctgccacacaccagatgcttcctctttagcaagttttttacttttaaatgtattttgctatcttaaaggcaaaaattcttatttcttagacttacagtaatagctggttttttaaaagcaccacctattcaatggcagcttgatttgtagtggaattggaagaaaattacaataaatgaaaatatctcaattgattcatatatagtaatctcataaacattaatatagaaaagaggtattaaatttatagagttagagtacctacacataaccaacaaacagcatagcacaatgtcaattgccaggcagataatctcatcccaactcatggccttaattataatccattcagtaatgcctcctaaattttcccctccagttctgacttacccactgaacttaaacacaacagtgcttcctcctcaatctcttctccacatagcaagcagattgattgtgttaaacaaagtcagactgtatcattgttcagctcaaaaccctccaacggctttctgattaactgagagtaaaagaccaagtattaccaatgcctagaagactacactaccaaccccacatactgctcctgcagttatctcatactactctccactatccacttcactgtagtcacactaacctccttgctatttattttaattttttaaattaaattttatttttttgagatggagtcccgctctatcacccaggtatatatttcagctcactgcaacctccaccttccaggttcaagtgattcttgtgcctcagcctcctgagaagctgggactacaggcatgcaccaccacacccagctaatttttgtattttcagtagagatcgggtttcaccatgttgaccaggctggtcttgaattccttatctcaggtgatccacgtgccttggcctcccaaagtgctaggattacaggggtgaggaactgcacctggccctccctgctatttcttgaacatactaagctcttttccttgctcaaagcccttgttccttccaatatgaatgatcatttgggtatccgcatggctagctcctcactgcccttagggctctattccaagtatccctctcggtgaggttcttaaatattccaaccaacctctaacccacattcctaatctcttttcccttttctttcatccccaaagccctatcaccatttaacatattacgatcctatttatcttgattattttctattgtccatccagtggaacataaaactcaaaagggcaggtattctatcttttgttgactgttgtatgcccagcacaaagaacagtgtctggcacaggacaggtgctcaacaaatacagaatttgttaaatgaatcaataaatatcgactctccttcataagatcctttatttttaaagaagattatgctccattaattccacattttctatgaatttactctgagaactttatccattggaaattccgtaggccaataaaggacttaaagctagctttttacaaatatttgaccacaaccaatagtttaaaaaaaaaaaagtgatatggagtccaattacacaagcacatacacataaataataactacctttactacacaggctgcattctaaaattttctatttcatttttcttgtctttttcttttttttttttttttgagacggagtctagctctgtcgcccaggctggaatacagtggcgcaatctcagctcacggcaacctctgcctcccgggttcaagcaagtctcctgactcagcctccagggtagctgggattacaggcacatgccaccacacccagctaatttttgtattttttagtagagacggagtttcactgtgttggccaggctggtcttgaactcctgaccttgtgattcaccagcctcggcctcccaaagtgctgggattacaagcatgagccatggattacaagcctgagctgtgcccagcctcatttttcttaaactaaccacagacccacaaaatcagttaagcctcatcactaggtcactactagttgtttcaaaaactggtctaatgctagcaaaatgtacgcactagaaaccaaggttcataactcaccaatttctaaaaacatatcaagattcactgtatccccatgtggacccttcaaatcagcataatccaaagcataaaaattaaattgacatctaataaatgccatgcacatttgttttaattttaattaggatatcagtatctaattttggaacatatagacaatatttattcctataaatatgtgtatcaccttggaagtgaatttaaaaaggaatacaatattaagtaagcattgtcaactatatacaaactggtgtatcatgaatagtgatttacaacttaattagtagatatataatgccagaaaaaatataaggcagatatgaatacactgctctctggagtcaactaaaattggtttagtctgtctatatacaacttcaatcgcctaactccaggatgatgtcacctagcccagtgtttcctaagcattactgacatttgggactagataattctttgctgggggctgtcgagagcactgtaggatgtttagcagcatctgtgatctctacccactagaaaccagcagtagtcccccagggtggcaactaaaaatggctccaggaattaccaaatgtcctgtgggaaaactcctgcccaaatccaatcttctcaggatcacttccacatttccagtaactaccttctacataattctaaatgtattttctaacatcctctctaaagaaaatatctggccgggcacggtggctcatgcctgtaatctcagcactttgggaggccaaggcagttggatcacaaggttaggaattggagaccagcctggccaacatagtgaaaccctgtctctactaaaaatacaaaaaattagctgggcctggtggtggacacctgtaatcccagctacttgggaggctgaggcaggagaatcgcttgaatccaggaggcggaggttgcagtaagccaagaccacgtcactgcactccagcccgggtgacagtgcgagactgcatctcaaaaaaaaaaaagaaaatattctaattcacaatcattaatattctccaatatcctaaaaaatcagactataatctgacaacatggccattagatttatctgaagattaattagtttattattgttattattttttctttttcaagacggagtcttgctttgtcacccaggctgaagtgcagtggcatgatctcggctcactgcaacctctgcttcccaggttcaagttattctcctgcctcagcctcccgtgtagctgggattacaggtgcgccaccacgcccagctaatttttgtatttttagtagagacggggtttcaccatgatggccaggatggtcttcatctcctgacctcatggtctgcctgccttggcctcccaaagtgctgggattacaggcgtaagccaccatgcccggccaatctgaagattaatttttaaagcccccagaagtttatgatttactaaagttatatggagggtttgtagacagagttagcactaagatgcctaattcctgaattctggttttgtgctctttctgctaaaactgacttagtgcacacttatttctgatgatattgctgttaactgcttagtctttaagaattaaagtgtctcattggattcattttttcactctctattttgtaaacctgttcaaacctcctctacctcccagaaaatgtcaaagtaccttataagccattttaaataacttttagagcatcactcattctacctctcatgtccattcctattaatggcccccagcccaggccgcaacttctaggtttaggtccactggttacttcatttttgtacacttgtactagaccctaaattgttctgtctcttttctctgtccttcaaattatataacacaacaccacaagatggatcttaaaacacaactgtaattatatcactcttctatccctaagcgttaaatgattcctccaattctagagaatattttaggtatacataatttgtgttatgctatgggctgaactgtgttccccccacccccaaatttgtatactgaagctataacccccaatgtgatggtatatagagatggtggctttgggtaataatcaggttaagatgtattcatgaggatagggccctcatgatgtgattggcgcccttataagaggagatatcacagaccttgcttcctctttctgtcatgtgagaacacagcaagaaggctgtcatccaccagccaggaagagagccttcactaaggaaccaaatcgtccagcatcttgatcttgaacttcccagcctaaaaatgtgagaaatgaattcctgttattaataaaccatcaaacaagtaaagaagaaaaacttaaactgggttctaatgacactgctggacttcctaaccagttgctcttggttagatttttggctgttgtccatactgattaaccctccatccaaccatcaatcaaggtgaaaaagaggaatagagcaaggatcaggaacaaagctaataagttaatgaacaagttcattaagaacaagagtagcattagaccatgagagttttcttctcctctagatgtccagagacccttctctacaaatgtccaccaatggatgaatgaatgcttattttccaatttgccagaatcttgagatactggggtagggaggttagacatgcaaagatatatcagatctaacaggtttgtcctcaaaaatcaattctcacctcccatgatgggagaagccaataggagggcttcaattccaaagaaagctgagagatcagtggatgataacccaccttccagattatttctatgcattcaaacaatggcccttctactagatcattgttttttgttttttttgagatggagtcttgctctgtcacccaggctggaatgcagtggcgcaatctcggcccactgcaatctctgcctcccgggttcaagcagttttcctgcctgaggagctgggattacaggtgcgtgccaccacgcctggctaatttttgtatttttagtagagatggggtttcaccatgttggccaggctggtctcaaactcctgaccttgtgatctgcctgcgtcggcctcccaaagtgctgggattacaggcgtgagccaccgtgcccagcctctagtaaaccattgttattaccacacacgagtttttaaccacacacatactcttctgaggaaaggcttccccaaactattggtccttatgatgagatctggccatatatatttttcttctgaaccccaggattgtggggctgtcacatttcctctaacagtacaccttaggagctcccagacttgaagaaaattggctgtttcccacatttgaacattttccactttttccctcagtctacctttttgaattgatttctgactacttctagataacctttttccattaatgaatattgagtgcttattgtgtgccaggcactgctttaggcacttgagagaaatcggtaaacattaacagacagaaatgaacaacaaaaacaaactatttcaacagaaggaactaacaaacagtccagtggaggaagaaagatagtaagtataataaaaatgcaaattctctggtgaactggaagatgacgttatagaattaggaaaaaaataatagagcaggcttagaagttgaggaggtataagagaattgtaattttacgtagtgtagtcagagtaagtctcatggagaaggtaaatttggacatacacttgaaggggataaaaggtcagagaggtagcaagagtggaaatagtagtaaggatctgtaaattcttcatttttctctcagtttagtctgtggcaactgtcatgtcttttgataaggaacgaccttggtttaatagttactcccctcctagactctcaggctagattttttttttttttaattgagacggagtcttgctcttgttgcccaggctggagtgcagtggcacagtcttgtgcacagtcttggctcactgcaaactctgcctcccaggttcaattgattctcttgcctcagcctaccaagtagctgggattacaggcgcccaccaccatgcctggcgaatttttgtatttttagtagagatggagtttcaccatgttggccaggctggtctcgaacccctgacctcaggttatccacccacctcggcctcccaaaatgctgagattacaggcgtgagccactgcgcctggccttttttttttttttttttttaagatggagtctcgctgtgtcacccaggatggagtgcagtggcacaatctcaactcactgcaacttctcctgagatgcttgtgcctcagcctcctgagcagctgggactataggtgtgcgccaccatgcctggttaattttttgtatttttattagagatggggtttccccatgttgtccacactggtctcgaactcctgacctcaagtgatccacccaccttggcctccaaaagtgccgggattacaggcgtgagccactgcacctggcctctcaggctagtttcaaccctattttacactcctctaccatcctcagcttacttttgaaaaagtatttattaaaaaatatttatgaaaaagttatttttgttttatttagttgccctgggatggaatacaaatgtttgctgtagttttaaggatcctataaaactcccatttactgcaaggatctctgtttaatgggcattcaattctaagatagcaaacgtgtagagttatttgtgggggtgggggacaagtttgagaaagaagcagtggggtgaagaaagtgataggcaagggaagatggtggggataggtaccataggagtcctggtggcctaaaatctaatcacagaagttactcaagtgggactgatgcctgaaaaaaatttgtgtgtggctataacagtgagtgggatctactcttttttttttttttttgagatgggagtctcgctctgtcacccaggctggagtgcagtgccgtgatctcggctcactgcaacctccacctcctgggttcaagcaattctcctgtcttggcctcccaagtagctgggactacaggcacatgctaccacgcccatctaatttttgtatttttagtagcgacggggtttgatcatattggtcatgctgctctcaaactcctaacctcaggtgatagacccgccttaggctcccaaagtactggaattacaggcgtgaggcaccgtgcccagcctgggatctactcttaagcaacagagaaaatcagtcatttttccccttttccttcccttcctcctatgagcagaatcttggtctccatctttaaaaaaaaaaaaaaaaaaaaaaaaaggccaggcacagtggctcacacctgtaatcccagcactttgggaggccgaggtaggcagataacctgaggtcaggagttcgagaccagcctgaccaacatggtgaaactccatctctactaaaaacacaaaaatttgccgggagtggtggtgggcgcctgtaatcccagctacttggtaggctgaggcaagagaatcaattgaacccgggaggcggaggttacaaaggagatttgacagggtggcagttcaaactaaaagtggtctgatagttcagagtcaagtttcttcactaaagctgagtttttaaagggcttgaagaatgatgtaaagaggggttgtggaggaccacaaaaaaagacaactaaaaaaaggcataacaaagtcaacttattaaatgcccagcaacagggtgaagttaaggggaatggtggaataaagacctacaaatagctgctgcttcataaaagcaaagagaacactagcaaaaactacaaaaatcacgtttttcagatcctggaaattaacgaaagcttgtaaaactcaaaagattttattacaaaatggcttggcggttcctcaaaatgttaaacatagacttatgatcccacaaatctaagtatacactcaaagaaataaaggtactcaagtacatgtatacatgtttatagcaacaactcataataatcaaaaggtggaaacaacctaaatgtccatcaatggatgaatggataaacaaaccatggtatatacatacaacagaatgtttattcagccataaaagaaacgacatactgatacatgctacaacagggtaaaccctgaaaatataccatgtaaaagaagtcagtgacaaaagctcatatattgtatgatttcatttacaggaaatatcagaaatagataaatccatagatattaaacaaagatttgtggttgccagaagataggaaagggaaaatggtgagaaactgcttaatgggtaaaggggttttactttggaatgatggaaatgtatcagaactagatagaggcagcacacgtacaatattacaaatgcactaaatatcactaaactgtttattttaaaatgactgatgttatgtgactttcacctcaatgaattattttttaaaaataaagagggtatattactaccaaccacacagaaaaaaagagaattataaaggaatactatgaaaaattatctgtcaacaaattagataacctagatgaaacaaattcctagaaagacaggaactaatgaactgactcaagaacaaacagaaaatatgaatggatccaaaacaagcaatagaattagtaatcaaaaaacttccccaaataaaagcccaaaatcagatagctatgctagtaaattcttaacgtttttaaaagaattaacaccaatccttcattaactcttccaaaaattagaagaggagagaaaactttgcacatctttctatgaggctagttattactcttacaccaaaatcaaaccaagaaatcatatataaaaaaagaaaactacaggccaatatcctttttttttttttttttttttttttttttggagacggggtctcgctctgtcgcccaggctggagtgcagtggcgtgatctcggctcactacaagctccgcctcccaggttcaggccattctcctgcctcagcctcccgagtagctgggactacaggagcccgccatcacgcccagctaatttttttgtattttttagtggagacggggtttcactgttttagccaggatggtctcaatctcctgacctcgtgatctgctcgccttggcctcccaaagtgctgggattacaggcgtgagccactgtgcccagccaatatcccttacagaggcaaaaatcctcaacaaaatgttagcaaacaaaatctaacaacatatataacgattacataccatgaccaagtgggatttatttaaaaaatacaaggatggttcattctatgaaaatcaaccaacaataattttatttttattatttttaattttaattttttttttgagtcggaatttcattcttgttgcccaggctggagtgaaatggcacgatcttggctgaccacaacctccgcctcccgggttcaagcaattctcctgcctctgcctcccaagtaggtgggattacaggcatgcgtcaccacgcccagctaatttgtttgtatttttagtagagacatggtttctccatgctggtcaggctggtctcgaactcccgacctcaggtgatccgcctgccttggcctcccaaagtgctgggattacaggcgtgagccaccatgcccagcctataccattttaataaaggacaaaaactacacctgcctgcagaaaaaacacttgacaaaagctaacatccttttatgatttgaaacaacaaaacgattaggaatagaaggaaactttctccaccagacaaaggcatctgtatgagactcacagctattatagtatcatacttaatggtgacactgaaagtacccctgcccctaagatcaggaacaagacagatatccactttaaccacttcaactcaacaccgtactagaggttctatagccaaggtaattaggcaagaaaaggaagcaaaaagcattcagattggaaagcaagaagtaaaaccataatggagatgacaaatacaaataactcaattttttaaaaggccaaagaacttgaatagacatttctccaaagatgatacacaaaagaccaagtaaatatattcagtgtcattaatcataaaagcaatgcacattaaaaccaccttgagataccacctcacacctagtaggatgactactattaaaaaacaaacattgttggaaagaaattagaatcctcatgcacagtcactggattgtaaaatggtataactactatggaaaacagtacagaaatgcctcataaaattaaaaacagaactactatatgttctagcaatcttacttctgggtatatatctaaaataattgaaagcagggtctcgaagagatactggcacacccatgttcacagaaggactattaaaatagccaaggggtagaagcaacccaaatgtctacccaaaaatgaataaacaaaatattatatatatatatgcacacacacacaatagaatattattcaacctcaaaaaggaagaaaatctgtcacatgctacatgtttgaaccttgaggatattatgccaaataaaataaaccagtcacaaaaagacaaatacttttgtatttgtataattccacctatatgaggtaactaaaatagtcaaattcatagaaacagaaagtagaggccggaagcagtggctcacacctgtaatcccaggactttgggaggctgaggtgggcagatcatctgaggtcaggagttcgagatcagcttggccaacatggcaaaaccctgtctctactaaaaaaaatacaaaaattagccagatgtggtggcaggcacctataaacccagctacttgggaggctgaggcaggagaattgcttgaacccaggaggcggaggttgcagtgagctaagatcacgccactgcactccagcctaggcgacaagagagaaactctgtttcaaaaaaaattagctgggcgtagtggtggcacacacctgtagtcccagctactcgggaagctgaggcagaagaatcccctgaatctgggaggcagaagttgcagtgagtggagatcgcaccactgcactccagcctgggcaacacaccaagactccgtctcaaaaaaaaaaaaaacaaaaaacaaaaaacaaaaaaccaaaaaaacaaaaaacagaaggtagagtaatggttaccaagggctaggggcagaggaaaagggtgagtctgttgtttaatgggcattgtttcagttctgcaagatgaaaaagttctagagatctgtttcacatcaatgcttgaaactactgaactattaatttagaaatggttaaggtggtaaattatatgcgtttttaccacaataaaacaattcattttaaaaacaggccccaatcggcatggtggctcacgtctataatcccagcactctgggaggccaaggtgggagaatcacttacagtcaggagtttgagaccagcctggccaacatagcaaaaccctgtctctactaaaaatacaaaaattagccggcatggtggcacgcgcctgtaatcgcagctactcgagaggctgaggcaggaagaatcacttgaatccaggaggcagaggttacagtgagccgagatcatgccaccacactccagcctgggcgacagagtgagactctgttaaaaaaataaaataaaataaaaaataaaaaataagctagacacagtggctcacgcctgtaatcccaacactttggaaggctgagatgggaggatcgcttgagcccaagagttgaagatcagtccaagcaatgtagtgagaccccttctctacaaaaaatttaaaaacacaggcacagtggctcatacctgtaatcccagtattttgggaggctgaggcaggaggacttagtcagctcaggaattccagaccagcttgtacaacatagtgagaccctacctctacaaaaaattaaaaaattaaccgggcgtggtagagtgtgcccgtgatcacatcactgcactacaaccttggtgccagagcaagactgtctcaagaaaaaaaaaaaatttaaatttagctgggcatcatggcacacgcctgtagtcccagctactcaggggtggaatgaggcagggtggcagctgagatgggaggatcactggagcctgggaggtcgatgttgcagtgggccataattgtgtcactgtactgcagcctgggcaacagagcgagaccctgtctcaaaaacaaacaataaaaaatgggcgaaggatttgaacacttctccaaagatacacaaatggccaagcagcacatgaaatgctgctcaatatagtcattaaggaaatgcaaatcaaaatcacaatgagctattacttcacatccactaggttagttataagcaaaaacaatctcaagcgttgcagaggatgtgcagctatctgaaccctcaaatactgctggtgataatataaacttgtactttggaaaagtttggcaattgctcaaaatttaaatatggcgttaccatatgacccaacaatatcactcctaggtatatacccaagagaattgaaaatataacacatatataagctagctggaatatagccataatgctgctacaaagtgcaaacaaccgaatgtaaattaattgataaatgaataaacgaactgtggtatatccgtacaatgaaatactattcagccataaaaaaactaagtacaaacaagcatacaatacggtgtaccttgaaaatacactaagtgaataacaccagacacaaaaggccgcatattttattattttacttatacaaaatgtccagaataaggcaaattcatacagacagaaataaagtagcagctgccatgggctcgatgaagaagaatgaaaggaatatagcaggtttgaaaaatggcccccaaaatatcaggtcctaatcccttaagcctgtaaatgataccttatttggaaaaaggatctttgcagatgggaaaattatcctggactatacaggtgggccctaaatgccaccacaaatgtccttgtaagagaagcagagggagatttcacacatactctaggaaaaggtgatgtgaagacagaagcaaagattagagtgacatggtcacaagccaaagaacgtcacatccacaaactagaagatgcaaagaatggattctccgctagagtttcccaggggaggacagccctgccaacatcttgatttaggtcttgtgaaacttattttagacttctgacctcccgaactaagggagaataaatttttgttgttttatgccaccaagtttgtgataatttgttatagcagctatggaaaagtaatatagggagtgactgctaatggatacaaggtttctttagagttgatgaaatgtcttggaattagatattgctgatggttgtacaattttgtaagtatataatactaaaaaccattcaatttcacaccgcaaagggtgaattttatggcatatgaactatatttcaaagaaaaacaaatgcctagtaacaggctggtataacccgccatctcccaacaactgctgctaaattttcaaagcaccattaagcagactcaattcgtagcaaggataatggaacaatgcaagctcatctagcgaacaaaaagaattaagctagtatcaggtggtcaatttacaaactgtagtgggagtcatacattcccaaggatggaacagttatatctccttgcagagtgaactcttctccgataccaaggacttggaagaccaaataaattatacgtaggattaccaaatatgctggtatgaccaagacagttatagtttaaacttctatctctgtggaattatggatagtgccactcttcaatctttaataagtccttcagtttagatgataaattacatagtcaacctagttataaggaatctagaggttgtgaaaagctgtgagagcatattctatgcagaccacataggtcctatcatgactccctatgtaacttgggtctctgcgactgggaagctcccagggaaaaaaccccagttaagacttctgcagagcattcacattttgtttcaaacttatacaacactaatgctaaagctcaactctcagaattgtattattcagtattatccaaataactgattaatttacacactgaagggaaagaacaaggaatggacctatacacacttgtagtttacaagtataagaagctaacaaagaataagattaaaataacttgtgccaggccgggcatggtggctcacgcctgtaatcccagcactttgggaggctgaggcaggtggctcacgaggccaggagtttcagaccagcctgaacaacatggtgaaaccccatctctactaaaaatacaaaaacttagctgagcgtggtggcacacgcctgtaatcccagctactcaggaggcaggagaattgcttgaacccgggaggcagaggttgcagtgagctgagattgtgccactgcactccggcctggacaacacagcaagactccgtctgaaaaaaaaaaaaaaaaaaaaacaaacaacttgtgcccacattaactaggtgttaaaagccaaaaggtgaaagtcactattctcttttcacatatcaaattgaccctaaggtaatattgctgcattagaactgagctggtgggagggatgttaagaaattagggagaaattgttaatctacagaaagaccatcatataaggttctgtgtgtagccaaacatacacatttgatgttctgatgtttgctattttagtggaactatagctataaaatgtattcaatcagtagaattaaaacatatcccagtccacaaaaaactaagagagaaattatacaggaatgatcaagaatctgcacagttctcataatctcattactagagagaaaaggagaaagggaagcatcaaggtagtatttgagacgaatttaagaagaccactcattcaataaaagtttggtgggccaacaaggtgccatgtattggtctggtgatatagcagtgatccaaagtctttcacttcagggagctgacattccagaaggagtagtcagaaaataatttttttaacaaaagtaacatggttatataaacactagggagaaaaataaagtaggaaatggaggcaggttgatactcacataacatgaatatggctgtctggggaagaatactccaacaaagggaacagcaaacacaaagcctctgagactggagcacttaacacatgcaaggactgatcaataggctaacacaggtggaccaatgaaaagagtgacaagttagaaatgagataaaaaatgagctgtttgtggcaaaggaaagccaagatcatgtaggccattctaaattcttcagctttggccaggtgtggtggctcacatctgtaatcccaacactttgggaggccgaggcgggtggatcacctgaggtcagaagttcgagaccggcctggccaacatggtgaaaccccatctctactaaaaatacaaaacgtagccaagtgtgctggcatgtgcctgtagtcccagctactcgggaggctgaggcaggagaattgcttgaacccagaagacagaggctgcggtgtgctgagatcatgccactgcactccagcctgggtggcagagcaagactccatctcaaaaaaataaataaaaataaaaataaaaataaaataataataatacaaaaattagctgggtgtggtggcgggcacctgtaatcccagctacttgggaggctgaggaggagaatcacttgaacccaggaagcagaggttgcagtgagccgagactgcgccattgcactccagcctgggtgacagagcgaaactccatctcaaaaaataagtacataaatagacaaaaaataaaaacaaattcttcagcttttaccctgagtgtgatgagagattactggaaggctctgagtgagaagtaatatgatctcactcatttcattaggattgctgtggttactgtgtggagaatagactttagagagtaatagtggaagcagaagacaagaagctactgaaatattataaacaaaagatgatggtagtatcagacaggatggagaaatagagatactaagaagtcggactctagataaaaatctagaaggcccaattcattgatggattgggtttgggatgtgaaggagaggaggaggacacacaagaggtaatgctgagcaggtaaatctatgagatcagagcccaaggaaagttccgaggtaggtacttaaattttgaagtcttcagtatgtagcattatttaaaacacaagactggatgagatcactcagggaaaagaggtctgagatctaagctctggggcattccattgattagaggtcatggagatgagaaggagctggtaaaggaaattaaaaaaaaaacaattattcacagccattcaggtgggaggagaattgagaaagagaagcatcccagaatccaatggggaggagaaaaggaactgtaatatatgctgccaatagatcaaataaaatcacgaaaatcaactaaaactgaccaatggattaagcaaagtggaattcattggtgaccttgacagcagtgggtttaaggaagaacgagaacaggagatagcaaatacggacaactctggagaaattttcctgtaaggacaagcaaatacaaattaaaacaagcagatgggagatgtggcatcaaaaacgagatctttaaggtgaggtgatggtacaatcagtatgtttgctatattaatgatctggagagatagaaaacttaaccctagacaaagagaagtcttgctagaataatatccttaaataaacaagtgcacatgtagaggttctggccttagcaagaagtcaaattattcacccagagtaacaggacaatgctttgagatcctatggaaaagggttaaatggtggataaatggttgcggtggccatcctccaagatggccctaaatgaatcccacttcctggaattcacatagttgtagccctctcccactaacagggttggcctgtgggatcaagcacatacagcaggaagtgatggtatgccacttcagaaattaggtcataaagactctgcccttcatcttgggtacaaggtctcttgaatcatttgctctgaagtaagccagctgctgtgacatgaacagccccatggagaggcccacagagcaaggaactgaggcctcttgccaacagcccagtgagtgagcttagaggcagatgatccaaaccaagtcaattccgcagagactgacaatccagccaaaggtttcactgaaacctcatgagtgaccttgagccagaaacagccagctaagccactcttggattccagaccttcaaaaactatgaggtaataaatttttttttaaactactaagttttgagacaatttgttacacggcaatagataactaatacaatgggtctcactgagctgtaatcacaaattgctgggcacacaattcactataatctcacctactggcatgcaatgacttcagatgacctcccctgtcctgctgcatgcagttacctcatgaaatacagtcgctgagaaagagggtaggataaaaggagtcagctttatataacttaacatccctgatgctcttttttttttttcaagagatgtggtaaaagaatgccactaccaccctctcctttctcaacaaagcaatttagagggttcccgaatgacctacatcaacaattggcctgaactaatcaaacgcatcattcagattccctcagtaaaatattgaataccaaacagctatgcttcagcaaaggaaagggcaagggagcgaaactgaaggacgaaaatacaactttggtcctcatcagggagacttctcttttcttacctcaggtttattacaacgcaacttttaagaacttgagctattccaggcagaaggtcacatccttgaggtaaccagagagaagcattagttacttacatgtcacaagaatattttcgatcccactgcctgacattgccatttaggtgtttatcaatcatctcacacttaaccagataagtgaactgaactcctttcccccagatctgttcctccaatctaccctaccttagcaaaggaaaacgtcccacccgccaactgcccaaatcaaaagcctgcaaatcacccgaggtcctggctctcacgggagggactccattagggtcccaggggctgcattaagagtcccgacagcgacgcagtaaatgagacaagacgctgcggtaggggagagagacccatacattcaaatgccttaaggggtctgggcctacaggtctccagaactggggagggcctggggttacaaagcagttttcagatttttaaatacattgagcgccaaaagagaccccgcgggggcgatgggggaggggagcgcactgggagccaggaaaggccccttctccaggaggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctccggcagcgcacggccaagcgcggtgtcgcgacccgcagggctgcggctcgccatgaaatccctcaagtctcccctcagggaacgctgaagccgcgccacgcccccgtccttaccagtccggatcagctgctgttcgcgagctgccggccacgcaccagccccggaggcgctcccggggcacagccggcggcgactacgcctcctcaggcccccggcgccgccgacgcgcacgcctccacacgcgcgcgtccagtggagacctgcgattggctgccaggtgccggcgcgagatcggcgcggctccgagctaggagcatgcgcgcgctctgacgcccctggtggcgacggctggacgcggggttaaattgagaaggaggagggcagcagcaatacccctgaggccttgaaaggatcttgggttccggatcacggttccaggcagtcagggttccagagctgagggggtatccaagcagtcagggttccagagctgaggagcatccaggcagtcagggttccagagctgaggggcacccaggcagtcagggttccagagctgtcgcagccagggcttggggtggggggtaggcttccagtccatcaggggatggtttgcccaccagaaggccagctgttataattctcaggtgtggtccctttgttgactatccatgcttaagggattgtgaggaaacaactgaacctaacatctgtcctcttctagttacatctggggccagttgaatccagcctgccacctgtttttgtacagctggcagcaagctaagaaccgatttcacgtttttttaatggctaaaaagagaatattttgtggcatgtgaaaattatatgaaattcaaaattcagtgtccataaataaagttttattggaacaacaaacatgcccattcctttcggtattatttatgcctgttttcctgcttcaacagcaaagttgattaattgccagagaccatgtatgaaaagcttaaaatatttactgtctggccctttacagaaagtttgcccactcagtttacttgcagctttgattttttttttgaattgaccaattctgccaaaagtctattttagcaatctttttggggggcgggtaaatcgcttttggtttaattaatctataatgttattttcttatctattttatctatttcttccattctgttattttcttccttcgtgacttcataggcttgttctgttacttctcattacaacttttggagaaaaatgcctacctcgtttgcttgtaaacttttttgtttctcttgtatttaatgctataaatttacctttaagtaccagtttaactgtgtctcaccagtccgcttggtaatatgttcattatccttcaattagatatgtcctaattttgctagttgttagaaatgcttgttccctggtgccgcaaagaaatagcacttgaacataaatttaattttctcagcaaggccattttcactttctgcagaaagggtacactcgccagcagttttgccacgagagtaccccaaacaaaggatacagggttatttataacctgacgcatccaccctactgctgtgtccggtttccattggctggaacaggacctcacattctgtgtttgtcccgattggctaacaacttagaactttctaaaagaggcaaaggcagaggagaacaaaggaaggaggatgtaacttgtagaatgctgagaaaggtaaaaacacctccaaataggaagaggaacaggctatgacctaatgcttgcttggaccagtataagcatgcaagggcaaatatttaggctaaattgtgggagctaagaacacaaagtatattaatttctttattacggctagcagatatctaagaatgttagcacaggtctttgaataaattttacttctaagagaagttactatttattcgtaattagacagggaggaaagtctttgaagaggaacctctactttattttttacatagtgattctttctaacacaagggttatatagtatatgttatttatttttgaaatctatgagatttttaaaagattttttaattgtattataatcaaatcacatggcctaaatattactcacccttgcatttgaagatttctgttcagtgaagtgtaccatagtcaaaatgaagagatcatagatgtaaagaagatatttgcagtatctaaaatgtatatatgaggctgatatgtaaagatatttgcattatctaaaatgtatatatgaggctgatatgtaaagaagatatttgcaatatctaaaatgtacgtaagaggcctggcacggtggctcacacctgtaatcccagcatttttggagaccaaggcaggcagatcacttgaggtcaggagttcaagaccagcctggccaacatggtgaaaccccatttttgtacaaaaaatacaaaaattagctgggtgtggtggcacgcgcctgtagtcctagctactcgggaggctgaggcatgagaactgtttgaacctgggaggcagaggttgcagtgagctgagattgcaccactgtactccagccttgggcaacagagcgagactccgtctcaaaaaataataacatgaaaaataaatctatgagaaatgatcttcttttggcttcataataattccaatgtccatcagtaaattagtatcaactaagctccaggctttattcaaatgtcactagtttttcccatcatcctttttgttccagattcccacccaggatactgaattgtacttggtcattttgtgttcttagccttctgtggtctgtgacagtttcttaaacttttcttgcttttcatgaccttgacaattttaagaagtaaaggtcaggtatttttcagagtgtctctcaatttaggtttgatgtttttctcatggttacactggggttatggtttttagaagactatcacagacatgatgtgtctttctcataatttctcatcagcgatccatgctatcaataagacttcctactggcttctccgctgtaaattacttcccccccctttcataccttattctaaatcttgcctacatgcaggaaggccgtgaggtctcattgaaggaaaattatctacacaagttactttgcaattcttctttaaggaagatttgtctcttcttcctttagttttaaattaatcaaaaatagctttttagttttaaattaatcaaaaataaaataaaaaatttagtacctcagtcatacttgccacatttcaacagatcaatagtcacctgtagcatattggacagagcagaagtagagcattttcatcattgcagaaagatctacggacagcactgacttagatcattagtcaacctttcttcttcccaaatatatgcatttagaaatataaattcccatgaaatgctttagttccatcccataaattttgtggctgttttcaatatctttcagttcaacattttccttttttcactgcaatttcttagaggagctatgggttattcagaatgaggaccaggactggggtgagataagcaaggaggctgaggcacattaaggagagacccacgcccagcttcaggtatggcatattgtcaccttaggttccctgcttgcctcaccctagtcccagccctgtttagaaatgtattgcctaatttaggaactttgggttttttttcagtgatctttctgttactgatttgtaagttgattcccgtgtactcagtgggtaactacaaagagccccacagctaacatcacaattaaagtaaactattctacctgagtttgagaccaagaaaagcacacccatgaaagccacttcaattcgcaaagcatttggaatagccaaggcaattttgaacaccaaagttggagaaatgaaactaccacatggaggattatgcaaagctacaataattaagatactgcagcattagcacaaggatagagaacaggacaaatgaaatgaaatagattccagaaacacatatatacaatcatacctgattcacacagtttccacggcaatacagtagggaaggagtggtctttttagtaagtggtgctgattgattttgggtatgtatatgaaaaaattagtcttcatgccttatcacaccattaacaaaaaatcagtttgagatgtctcatcaaaacagtaaagcttctagaacatagaaggaatatctttatgtcgtttgtagacaatttcttaaataagactcatgaaagataaaccataaaaccacgatttagatccaaatatgggacatttccagtgccccagcacccttcccagtcgacagcccagtttttaaaaaggtaggagggggcaaaacttgaatagacatttaataaaaagaaatactcacgtggccgataactatataatctcaaggtccattaatcctcagggaaatgcaaattaaagccacaataaggtaccactacaatttcaagagaagggcacttactaaaaggactgacagtaccaagtgctggatcagtagcagtggaattcgcagtatcggtggtgggaatgtaaatcgtttcaatcactctggaaatgtatttggcagtatctacactagacagctaaatatatgcagttccagcacttctcatagctatatacacccacgagaaatgattacatgcttaccaaaagacacgcacaagctcatagcagctttattcaaaattgccaaagaatcagcctcaaagtccatcaacagtgaaataaatttatacaaaactgccacagtcactcaacaaaattctacccagcaatgaaaaagaatgtgctactgctacacacagcgaaaatgcatctcacttattttatttcattttactttattttgagacagtcatgctctgtcacccaggctggagggcagtggcgcgatctcagctcagtgcaaactccccctcccaggttcaagcgattctcctgcctcagcctcccgagtagctgggactacaggcgcccaccaccacgcttggctaatttttctattttatgcagagaaggggtttcactatgttggccagcctggtctcaaacttctgacgccaagtgatccacccacctcagtctcccaaagtgctgggattacaggcatgagccatcacgcccagccatctcacttattttaaaaagccaaagacaagaatctttgtgtgattccatttatttaaagttcataaacaagaaaaacctctgaggtcagaataagggatgccttgttgggagcatttgactgggaaagggctcaaagactttggagctacttcttgacaatagggagctgatgagatgtcactgtgaaaaacaacctgacagttgatgacattgcttgctagcatctacagccacaatgcacatatggcctagcctcacttctgcctttcggaactcctggaagtcagtcgaacatattttcagctagaatccttgctgcaagggagtctggaatctctagtgttcatagccgtcttctttttagtttttacaggagaagactgagggtcagtgttgctaacaataacggaagccataccacttgatcctggctgaactgaagtttgaataataacttttgtttcacgagggaacccttgcagttgctccggctttttaaatgtttgatggtccttggttttgtgctctatttcctccttcaacgtcaaaaactgtagccggcacttggaacactgaaggaccctccttctgctgtgcctccaacaatgattcatgtatggtattgcagttttgaaaagtttgagacaaaacagacaaagcaaattctttgtgttttcatggcacgttctaaaatgtgtttccacatcagcaaagaccgacgatctgtaatggcaaacctggcacacgtagggcatttcgccaggcttatgatggtccttcatgtgttgtaagaggacctgatctgtttcaaatgacaattcacagattttacagacagcagagggccccatggcgatgtgtacactatcaatgtgacactgtagctggaagggagtgggaaactgccggtggcagtgctggcaggtggtgtggtcttcccagctgtcgttcctctgcttctcaaattccaaatgatgcttcatgtgattcataaacttaatattttttagaactttcacgcagctgaggcatttaaaggtggtgtgagtcttctgttccggctgcccatctcctttatgctgtccatagtaaaagttgctaagtaacacgatgggattttctttcttgggatcaaaggtcttgttttgacttgctagacttgaaatgtctgtcattgccaggccagactcatttgctctctctggatctgtaagattgaaatgtgcctttccattagcatcaggccaaggaaatgttactccattctgaacatggtttgatgagttgcagatcccctgtgagggtgtatttgtgcttattgtagaagacatatctgaagggaccacagctaaagaaggtacccctgggattccatccctgagtttaacccttttggaatctctgctgtttatatctgaagtggaaagtcgctttgaatcaggagaactctcatttctgcctcctccagagaccatagctccaactagacactgagtccctggggggagcgaatctgagtaattgggagaaacaacttgtggtgagctcattttataaccaggttcagatgaagacttcatagtgacaggactatctgtcgatcgcccctcagacagagaaacgggcatgatggcttttgccatagaggtcacatgatttgcaggctgcgacacgtgagcaggatattgacggaagtggcctttctttcttcttgactttgagcctggggtgactctgttcaaaatgtttgaaacgactggttttgaatttgaaatcatcccgacaaagagaacttcagcatctctatgtacatgctccaccccaacatagatcagatctggatcttcatcatcctcctccctttgtttggattctctcaaattcttctttggtgattccactttcttacacaaaaagatatctcccattttcaatttactttttgcttgaagccactggtctcttcaacttccagagctgtctttttacaaattgccacctaagtgcaaccatgtgacaatagtcaatatttatttcgaaagacaaaatcattactttattgtatcctcccttaaaacactgagataaccatcaacatctctattttacacgtcagaaatgaggcttgaaacattttaaatggcataataatttcaaatttacctgtctctcctcccctggtcttctgcagttgtgaggcaaaggaagcaagatttcaggaggtgcagatggaacatctcagagtgcttgcctctaaattttgcactctagatgcctcactcacctcctcctcatcccacaggtactctctcagatgtctaaggtttctaaccaacttgaacaaaacttctctcaaaaacattctgctcctagcctgggcaacatagcaagaccccatctctacaaaaaaatttaaaaattaaaaaaaattagcttggcatggtggtacacacctgtggtcccagctacttgggaggctgagccaagaggaacacttgagcccaggacttcaaagttatgttcatgccactgcactccagcctgggcaaccaaatgagaccccatcacacaaacacacacacacacaaatcacaacacacacacacacacacacacacacacacaccctttgctgttcctgtaatgttccttttctcagtaaactcagttgctcagtctacaaacttcagagtcatcctttgccagactttctctcatacactacagccaatcaattagcaaagctagtctgctctatcttttaaagatatccagaatctgactactctcttccacatctactgccacctccctgatggaaggtaccatgttctctccctggatcactgcagaagttgccagtcttaaaagttttgtcagatctccccatggtggccccaatgcccctgttaaaatatacaggggagcaagtatattttgctcttaagtcttcaatgactttccatttcattcataggaaataccagcaaactttaaatttctccatggaaccttaggtcatcatcgcccttgctaactcctctgttgctctgatgcagccatcctgagctccgtgaatctggaacacaccaggcctttttctttttcagaacttttgttgttcccggacattgcgtgcctctttccccagattaaccccatctgggctcctggtctgcctcagtcccatggttcctcttcagcaaggcttacctgaccacaatatcaaaaatcacaacctccttaactcatatgttcaaaccctcaatgttatttttcaacttagcatttatcactgcctaccacacaatatgtaaaatatatcttgcaagcccaggagtttgagattacagtgagctgtatcatgtcactgcatccagcctgggtgacagaggaaaggaagactctgtgtcttaaaacaacaacaaaaaatgggacaggtgcagtggctcgtacctgtaatcccaacactttgtaaggccaaggcgggaggattgcttgaggtcaggagctcgagaccagcctgggcaacatagcaagacccatctctacaaaaaatttaaaaatataacttgtttcttttctgtgtttacccactaaactgtatgccacatgagggcagggagttgtgtttcatttactcctcagcttatagagcaatgtctgtcatactgtgcatgctaaatctttgttaaataaatagtagctgttattaatatgatcatttaggtgtaccagaggctctaatccattattccagattctctaagcatttaatgaaatccaaatccaaatgatttaatactgttgtacaagggagaaggtaaacctgtgtgtatgtgtgtgtaaattgaaacaaaagttttgtcaaatactctaataccttcaccttaccgcaagggataggctctgataccttctatgccatattttattgattctaaggtataggcttagatttccattttaacatctctaaatcagattgcatctcatcatagcatctcatcaatataaaatacatttcacaatttgtttttgcagtatatatttttatttcatagtggaatcaaaaatgacatatctcagatccttttgtgaggataagcgtgatgcttgggttttcactcatgtgagatgtgcttccctcaaaccttgttatatcagcatgtttaacatctgatgtaaaaaaaaaaaaaaaaaaaggagagtaatgtatcttttataattgatggcatctttttttttttttttttgagatggagtctcgctctgtcgcccaggctggagtgcagtggcgcgatctcggctcactgcaggctccgccccgcggggttcacgccattctcctgcctcagtctcccgcgtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcatgagccactgtgcccggccaattgatggcatcttatagtcagtgaaaaatcctatttctttttgtaagctgacagcccactaaacttgttttgtagttctctaatggatatcacctacattttggcaaacaatggtttaagacagaaattggaaaattggcccttcccctgtttttgtacagtcaggaagccaagaatgtttcttacatttttaaggtattgttttcttactttttttttattaagatttttttaaacttgtacatttttagatttgggggaataaacacgcaaaaggaagcggggcgcggtggctcacgcctgtaatcccagcacttttgggaggccgaggtgggcggatcacttgagctcaggagttcgagaccagcctggccaacatggtgaaaccccttctctactaaaaatacaaaaattagccaggcatggtagcagatgcctgtagtcccagctactagggaggctgaggcaggagaatctcttgaacctgggaggtggaggttgcagtgagcgaagatcgcaccactgtgctccagcctgggtgacagagtgagactgtctcaaaaaaaaaaaaaaaaagaaaaaaggaatattttgtgatgtgaaaattatataacattcaaaatgtcagtgttcactataaagtgttgtggaacacagccataatcatttttttagtgctgttgtccatggctgctttcacacttctatgacacagttgagtacagtagtacccccttatctttggggcatatgttccaagacccccgaagtggatgcttgaaactgcagatggaaccaaattcaatatatactatattttttcatatatgtacatacctatgatcaagcttaatttataaataggcacagtaagaggttaagcataacaaaataattataacaatatactgtaataaaagatatgtgagatagtgcgtggtggctcatgcctgtaacctcagcactttgggaggctgaggtgggtggatcacctgaggtcaggagtttgagaccagcctggccaacatggtgaaacccatctctactaaaaatacaaaaattatctgggcatagtggcgagcacctgtaatctcagccacttgggaggctgaggcaggagaatcacttgaacccgggaggcgtgggttgcagtgagccgagatcgcgccgtggcactccagcctgggcggccagagtgaaactccgtttcaaaaaaataaattaataaattaaattaaaggtatgtgaatgcaatctctcgctgacaaaatatctttatgtactgtagatcttggcaaccttagcatacgattttgttttctttccttattatgttaaaaactttcccattttcacttaaaggaagcaagcactttacagcttctttttggcatatttcaatcgccagcattgctacccttgtactttggggccattattaagtaccataagggttaattgaacacaagcactgagataccaccaggacagtcactctgataactgcgaccgctcctaagtgactaaggtacagagagcgcagccagccaacagcatggggactcaggacaaagggaggattaccatcccagggcagggctgactcaagagcttatcacactactcagaagggctggcgacttaaaatttatgtattgcctatttctggaattttccaattaatattttggaacctcaggtaactgaaagcacagaaaggaaaaccctggataagggaagactactgtagttggagcagagaattgcaatacctaaaatatttgccatctagtctttcacagaacaagtttgccagctctagttttagaggagcaaaatgaaagatagcaaatttctcagctcaccagttcctaaagttgcgagtgcatccagatgattcagtgcagctcagtatgttccactctgggccacaagggaaagcgaagctggagcttccttgtctccacctccgggagaaatttgtccagagaccggcagcactgcttccgcaggcgaacaacgccgcttgctcttcaaagtcctttctgaggccagatcagaaggtcccactccttttaagccccttattgcccaatcatttttccagtcacgtgtctgaagcagtttatcctgattggattttcagttgttgtccagcttgattgccaaaagttttcctccaattgctactcaaaggaaagaatgagggtggggcttcagggctgctttccaggttgattgagctgctgatgggcatcctccctcctctctctcttgttcagagtctaccactttctctgcagtgtgcctgggccctcagctattggggatgagaagggatgcggagtgggaggcagtccacatgtctgttccaacaaagctcagaggtgagcgagttaaaaagcagatgtctttccagtaggagccccaggggacagggtgggtctcacagcccttgaagaccgagctcccgtaggagtttccaggtgtccaaacagggtcctcactgtgagtcttcaacagctttctccaagcagcagcccactcccttcttaatccatttccaggggtcaaaggtctatcctggttccctcccatgccctctcacttccttccctctgtctctccctcctccctcctccttcactaccccctccctggaaccttctcagctgaatttcaggcccaccctttcactctctttacaggctttgcaacacagattagaaagcgggggagggggagcctcaagagtcccttgacaggtaagaaatatttatatttccacccccattccaacgcaatgcaatcaagtctcaaaattaaaacgaaaatcatttgcaaattaaaatgttctaaagtaccatctcctgataaaactttaaaaatacctttctgggccggatgtggtgactcacatctgtaatcccagcacttttgaaggccgaggcagcagatcacatgagcccattagtttgagaccagcctggccaacatgatgaaaacctgtctcttattctttataaagtaaaatacaaaaatttcctgggcgtggccgtgcgtgcctgtaatcccaggtactcgggaggctgaggcagaataatcacttgaacccagtaggcagagcccaaggtggtataaaagtgtgtgacccatggtctttattcttgtctagggactggggaaaggctgcttgagggcattgcaagtagccaagagcatgcccctggaaaggaaggtgaaatgaggcccgctactgaggtacacctgtagtcccagctatcaaaggctgaggtgaaagatctttgagcccaggaaatccagacaaacctcagcaaaatatcaagacctctgtttctacaaaagaaaaaaaaaatttttttaattagccaggcattgtagcacgtgcctgtagtcccagctacccgggaggctgaggtgggaggattgcttgaaccagggagatcgaggttgcagtgaactatgattgcatcacatactttagcctggatggaagagagagaccttgtctcattcattcattcataaataaataagcaagcaaagtgaaatgaagtgcaagacttagacagtaaagttctaacaggggccgggcgtggtggctcacgcctgtaatcccagcgcttaggcagaggcaggcaggtggcttgagcccaggagtttgagattagcctgggcaacctggcaaaaccgtgtctccacaagaaaatacaaaaaattagcctgggtgacagagtgaaaccctgtctcaaaaaaataaaaaaagaaaaaagaaaggaagacagagaaagaaagaagtaaagaaagagaaaaaaaggaaggaaagaaaggaaaggaaatgtgtattctgcagaactgatattcactccttcctcttttccagaagcagaatcctgctaggaagattccaggaagcctaggcagtggtcaggggctggctcaggtataaagcaggcccttcccctgagacagaaggttgtggcaacaatgcttgtgggaggtgagaaaattgagaggagtgtctagaaatagctcggagttgcatcttattttcttttgctcagttttaaaagtcccaaataagaccacatctagctgttctaaccaagctattctaacccactaatctagtaaaaataaaatcacatggtctgaatataaatttgcatcaggatacatgcctttcctatgaaacatttatgtttccttataaaatgtatcctccttttctgcagaaaactaactgtaatgcatccaaaggtcacagaatgtggtgaaacatcctcatcattgatttttaaaaaaatttttatttatttatttatttgttttttgagacatggtctcacattctgttgcccaggctggagtgcagtggaacgatcatgcagtcttgatgtcctggacccgagcgatcctcccacctcagtctcccaagtagccaggacaataggcagatgccaccatgtctaactgatttatttttatttttgagtagagatgaggtctcactatgttgcctgaactggtctcaagctcctgagctcaagcaaacttcccacctcggcctcccaaagttctgggattacaggcgtgaactacccgcaccctgccctccataactgattcttttttttcagacttcactctgttggccaggctggagtacagtggcgtgatctctgctcactgcaacctccgtctcccaggctcaagcagttctcgtgcctcagcctctcaagtagctgggattacaggcatgagccaacacgcccggctaatgtttgtatttttagtagagacagggtttcaccatgttggccaggctggtcttgaactcctgatctcaggtaatctgcccacctcggcctcccaaagtgctaggattaaaggcgtgagccaccacgcccagccatagctgattctttatcagtctgcctttgggaagtttccactgggaaacactctccaggactgtttcggaccagccccactttccaaacaaagaattccagtgatgagattaaagcttgtcacaatatgtttttcaaatgactggtagaagcagaccttaagattaaaaaagaagaagaaaaaatggctgaaatcttgaatcctttattgctttaaggcacagaataggaaatggatggcgcgtcgggaatggatgcaggtcagggacagaccatcactcatgccaccttgctgtgtttatgaaacagagtgctagaagttaaatttgggggatgcacaaagagatgcctaatcagatgaactcagagttggaattgctgtttgtgagacagttacatcaaaggaagaaaagaaggagagaagaaaggtgactatcaggagaattttccagccagaagaaagacacagaggcacaggcatttcatggcctgaaaaaggaagagcacagagacaagtgtggctccagttaaaggaccagcggagatgaaagatgaggtcagtgatttgggtaggggacatagcagttaagatattgttggtcaaggctgggcgtggtggctcacgcctgttaatcccagcactttggcaggccaaggcgggtgaatcacgaggttaggagatcaagagcatcctggctaacacagtgaaactccgtctctactaaaaatacaaaaaaattagccgggcgtggtggcgggcgcctgtagtcccagctacttgggaggctgaggcaggagaatggtgcaaacccaggaggcggagcttgcagtgagccaaggttgcaccatagcactccaacctgggtgacagagtgagacccagcctcaaaatactactactactaataataataataataaaaacaaaacaaactaaaacactcaggagagattagtggtctaaaagcatatttttacaatgtattcagggttattccattgtttcttaaaaactacctttgggagcatctccccaaacttagtttggaagtgttttttctgggttgcaataaacaagcaaacaaaaaactaccttttaattaaaagtaatccttaaatagagctaacaataaaatcaaacacacaaaaaaattatccattttaaaattttttttatatgaagtcttgctctgttgcccacccaggctggagtgcaatggtgccatctcggctcactgcaaccttcaccccccgggttcaagcaattctctcacctctgcctcccaagtagctgggactacagtcacgtgcgagcacacccagctcatttttgtatttttagtagagacagggtttcacaatgttggccaggttggtcttgaactcctgacttcaagtgatcccctgcctcagcctcccgaggtgctgtgattacaggcgtgagacaccgcacccggccaaaattcatccattaattgtaaagtaaatttcccttctgccccagatcacagttacctgtctctattcccaaaataaatggctgtgtagaatttctgatgtgtccttcaatatatattctctgcatctacatacacttaccttcccctacctttttatgtaaatgggtgtttattattcacatactccgtattaaaattgtgatttattaacataattttactgacattttaatttgaatggagataaatttataaaggggattgatgattaagattttatgtttaaatattcggaagcaaacagtaatgcatcttatcttctgagtaggatgtgggttgaaactgcaaaggcaagcatgagatgtttcattaacacaaagccttgagtgctccaaacccaaaagtcaaagcaacttatcaataaatgccaaaggatgctattctgacatatctgtgtgctgtggtttgaatgcagactccaaatctcatgtgtgggaaacttaatttccaatgtgggactattgaaaggtggggcctttaagaggtgattgaatcatgagggctctgccttcatgaatgaattaatccattcgtggattaatgggttgatgggttaatggcttatcatggaaggggagctggtggctttataagaagagaagagagacctgagccaacatgctcagcctccttcatgagatgccctctgcggcatcaggatgctgcagagacccccaaccaggtaagaaggcttttaccaggcatgccccctccactttgggcttcccagcctccataactgtgagaaattcattttctttataaactacccagtttcagatattttgttgtaagcaacagacaacggactaagacactgtgttatctaattatgtgattcttgttttactatttatttatttagccacttgtcagaaaaatttttttttttttgagataaagtctcactctgtcacccagactggagtgcagtgctgctctcatggctcactgctgcctcgaactccctggctcaaacgatcctcccaccttagtttttcaagtagctgggactactacaggtgtgcgccaccatgactggctactacttttttttttttaatattgcccaggctggtctcaaactcctggcctcaaaagatcctcttgcctcagcctcccaaagtgctggcattgtaggtgtgagccaccacacccagcccaccaaaagttttttcagacatgtacctgagtgattaagagtttaggattggctgggcacggtggctcacgcctataatcccagcagtttgggaggccaagacgggcagatcctgaggtcaggagttcaagaccagcctgaacaacatggagaaaccccatctctactaaaaatacaaaatttgccaggtgtggtggcacatgcctgtaatcccagctacttgggaagtctgaggcaggagaatcgcttgaacccgcaagggagaggttgcggtgagccgagatcgtgccattgcactccagcctgggcaacaggcaacaagagtaaaactctgtctcaaaaaaaaaaaaaaaaaaagagtttaggatctatattcgctctgcctgggtccaaatcctggatgttattaactgtatgactttgggcaagtttattaacacctccattttaaaaaaatctgtactaggaatataataataaatgcataccctctcaggatttgattaaatggaataaaatatatagaattcctagaacagtgccaggagtttgaggccagcctgggcaacatagtgagaccccatctgtacaaaaaatacataaaaaatgaggggggaatagcggtgcacacctgtggactcagctacttgataggctgagatgggaggattgcttgagcccgggggccaaagctgcagcagtgcagtgactgcgtcccagtaatcccagcactttgggagggcaaggcaggaggatcccttgaggccaggagttcaagaccagcctgtgcaacataaagagactccatctgtacaacaacaacaaaaattcttacgcacttagtatttgccagatataatgccaatttctagggcacaaaggcaaatggtaactacctccctggattgttgtaaaaataaagcatgcaaaacattttgtgcccccaatgatcccttcctcatggtgtccccacacttttattttgtgctgtcacaatgagcagggcaccaccaggatactgggaaataatgacgtgtgatttccaagaccaggtcacaaaaaacattttgccttgccctcttgaatcacctgctctggtggaaaccagacaactgttatttatgtcatagcattcaagcggccctatggagaggtccatgtggtaaggaactgaggcttcctgccaacagccaagtgaaagagccatcttggaagaggatccgcctcccaagttggccaagccaacattttgagtataacctcataagagtctctgagccagaaccacacagctaagctgcagtaactttgaagtaataatgatttattgttgttaagccactaagttttgggataatttgttatgtagtaatagatagctaatacagttgtgcttattacgtttggtactcgttactatcaccaccacatcagtgcattgtagaaaacaaattctatgtattaaactgttttgtttcccctctggattaagctgggctcacaaggggaaaggtgcccaccagagtttttttcttttttatgtaatcaagtttttaaaattttattctattctactttatttttttaagttccagggtacatgttcaggatatgcaggtttgttatgtaagtaaacatgtgccatgatggtttgctgcaactatcaactcatcacctaagtattaagcccaatatgcattagctctttttcataacgctctacctccctcctaccctcccgtaaaaggccccagtgtgtgttgttcccctccctgtatccatgtgttctcattgttaagctctccacttataagtgagaacatctggtgtctggttttctgttcctgcattagtttgctgaggataatggcttccagcttatggatgtatagtattccatggtgtgtatgtaccagattttcttttttcttttctttttttttttttttttttgagacggagtctcactctgtcgcccagctggagtacagtggcatgatctctgctcactgcaacctccgcctcccgggttcaagcgattctcctgcctcagcctcccgagtagctgggattacaggcgcataccaccacgcctggctagttttttgtgtttttagtagagacggggtttcaccgtattagccaggatggtctcaatctccttacctcaggtgatctgcccgcctcggcctcccaaagtgttgggattacaggcgtgagtcactgcgcctggtcagtaccacattttctttaaccagcctgtcgatggaaatttgggttgattccatgtctttgctactgtgactagtgctgcaatgaacatacacaaaattatctgaatgattgcagtaaacatcatatatttgtttgccagctaccataataaaataccatagattgggtggcttaaccaacagaaatttattttcccacaattctggaggctggaagtccaagatcaaggtgttggcagggttggtttcttctgaggccttggcttgcaagatggccaccttcttgctatatctttacatgatcattcctctgtgcgtgttcgtgtcctaattttttcttcttataaggacaccagtcattttggattagggctctttcatatgacttcattttaatcttaactgcttctttaaaagccctatctggaaataaagtcacattctgaggttactgggggatagaattacaacaaatgaattttgggaggacacaaatcagcccataacacatcattgccagcatcacatgtggagcattcaactggagaaactgccctaatttctcatttgaaggtctaaacatctcttttatcaaaataagccaggttctattaagaaggctgaatgtgcatctggctcgatcaacaggcgtctggctgcttcaaatgcttgatttttttcattctcagagaatgaaatcaatgttgaaatattgagtatattctatacaaaatcttcatgtcacaatgaataagaaaagtagttttttttgagacaggatcttgctctgtagctcaggctgcagtttttggagtgcactggtatgacataactcgctgtagcttccatttcttgggttcaagtaatcctcccacctcagcctcctgagtagctgggactataggcatgtgctaccactccaggttaattattattattattatttttgagacggagtctcgctctgttgcccagcctggagtgcagtggcgccatctctgctcactgcaagctccgtctcccgtgttcacgccattctcctgcctcagcctcccaagtagctgggactatagacgcccaccaccacacctggctaatttttcgtatttttttagtatttttttgtatttttttaatagagatggggtttcaccatgttagccaggatggtctcagtctcctgacctcgtgatccacccgcctcagcctcccaaagtgctgggattacaggcgtgagccaccgaatccagccactccaggctaattattttattgtatttttagtagagatggggtcttgctatgttgcccaggctggaatcaaactcctgggcttaagcaatcctcctgccccagcctcccaaagtgttgggattataggcaccagccactgcacccagtcaagaaaatattttctaatactgaatacagctaaagaatggatggtaaaccattattgtccagtcaggatcactgtcatccaagtgggacactcagtatttgagattctgggtggtgctataatacttgttgccttggtatctgagtgagcacttagtctaagtataataattttctggaggagtatattagggttctccagaaagacagaaccaatagaatggatgaatagatagatggatagatagatagaaagatagattgatagggccgggcgcggtggctcacacgtgtaatcccaccactttgggaggccaaggcaggcagatcacgaggtcaggagatccagaccatcctggctaatgtggtgaaaccccatctctactaaaaatacaaaaaactaaccagacgtggtggcaggcacctgtagtcccagctactcgggagctgaagcaggagaatggcgtgaacccgggaagcagaacttgcagtgagccgagatcacgccactgcactccagcctgcgacagaacgagactccgtctcaaaaaaaaaaaaaaaagaaagatagattgatagatagatatgtgagtatgtgaggggatttgttaggggaactgtctcatgcaattatgaaggctaagaagttccacagcaggccatctgcaagctggagatcctgggatgctgacagcatggctcactctgagtccaaaagcctcagaactagcggtgtaattctcagtccagtgctgaaggcctgagaagctagggagtgagggtgcactgctagtgcaagttgtggagtccaaagaccagagagccttgagttgtgacatctaagtacaggagaggaagagtgtatctcagctccaaaaggtagatcaacacattcacctttcctctgtttttgttattttcagtactggcctttggatggcacccacctacatggagggcagatcttccccacctagtccactcacactcatgcgttaatctcttctggaaacacagacacacccaaagatagtactttaccaggtttttaggtattctttaatccagtcaagatgacacctaaaattaaccatcgcaagggtatattcaatctgaatggccaaaattatctgatagagccttcagatacttgtacttaacagatgtactcttgggattaaatgagtttatgctcaagaaatgatattagccaggcataggggtgcatgccgttgtcctagctaccgtggaggctaggacaggaggagcattgcttgagactgggagcttgaggctgcagtgagctgcgatggttccactgcactccagcctgggtgactgggcaagaccccactgcaaagagagagaggcagagagagagagtagaaatggtatctgttattttacattaaaagttctggaataggggagtgctatggtctgaacgtatccctccaaagttcatgttggaacttatgacccaatgtgatagtattaagaggtggggcttttacgagatgactaggctattagaggcctacccttatgatgaatgaattaatgtccttatcaaaaagattccatttccactatgctgagagcggaaaacaaacaaacaaacaaacacaaatgaggttccacacagcactcatcctttttgcccttccacccttctgccatgtgaggacaaagcagcaagtctccattttggaagcagagagcagccctcaccaaatctgaatctgttggtgccttgatattgaacttcctagcctctagaactgtaagaaatgtttctgttttgttgttgttttttccgagacgaagtctcgctcttgttgcccaggctggagtgcaatggtgtgatcttggctcactgcaacctccgcctcccaggttcaagggactctcctgcctcagcctcctgagtagctgggattacaggcacgtgccaccacgcctggccaatttttgtacttttagcaaaagtggggcctcaccatgttggccaggctggtctcaaactcctgacctcaggcgatctgcccacctcggcctcccaaagcactggaattgcaggcacgaaccaccgctcccagctgagattttctgttctttgtaaattacccagtctcaagttattttgttatagcagcaaaagcaaattaaagaaggtataatatcaggctctcttctgattccctaggctctgctgcacgaattgttatttccagaagttcccataggaagttctcaggaaatgaaatggatatgaggtaacctcatgtcggggagtcagtctatggaggatcataatcatacaacaacatggtccacccttgctataatctattttttttttttttttttgagacggagttgctctgtcacccacgctggaattcaatggcgtgatctacgctcactgcaacctctgcctcccaggttcaagagagtctcctgtctcagcctcctgagtagctgggaccacaggcacacaacaccacacctggctaattttttggatttttggtagagactgggtttcgccatgttgcccaggctggtcttgaactcctgagctcaggcaatttacctaccttgccctcccaaagtgttgggattacagtcgtgagccactgcacccagctgttttctgttttctgacttttatttttgagacagggtctcgctctgttgcccaggctggagtgcaatggtacaatctcggctcactgcaacatctgcctcccgggttcaagtgattctcctgtctcagcctccacagtagctaggattacaggcgcctgccaccacacccagctaatttttgtatttttagtgaagacatggttttgccatgttggccaagctgttctcaaactcttgacttcaggtgatccgcccaccttagcctaccaaagtgctgggattacaggcacgagccactgcgcccggccttgttttctgttttgtttgtttgttttttaagagatagggtcttgctctgtcagctaggctggagtgcagtggcacaatcagctcactgcagccttgaactcctgggcccaagaaatcctcccaccacagccttctgagtagccaggactataggtgagcactggttaaatttttaatttttttttgtagagacagagtcttgctatgtagtataggctggtctcaaattcctagcctcaagtggtcctccagcttcagcctcccaaaatttgggaatttcaggcatgagccactgcatctgaccgtacaaaatgttaataaactggccaggtgtggtggctcatgcctgtaatcccagtactttgggaggctgaggcagggagatcacctgaggtcaggagtttgagaccagcctggccaatgtggtgaaacccccatctctacagaaaatacaaaaattagccaggcgtggtggcccatgcgtgtaatccgagctacttgggaggctgaggcaggagaatcgcttgaacctgggaggcggaggttgcagtgagccgagatcagagcactgcactccagcctgggtgacagagtgagactccgtctcaaaaaaaaaaaaagttaataaaccttttactcctggcctcaagtgttccggctgcctcagcctcccaaaatgctgggattacaagcatgagccatttatttttctttttttgagacgggagctcactctgttacccaggctggagtgtagtagcatgatcacaactcactgcaaccttgaactcttggattcaagtgatcctcatgcctcagcctcctgagtagctgggactataggtgcacactgacatgctcagctcattcaaaaattttttcataagagatggagggggggtcttgctatgctgcccagcctggtcttgaactcctggactcaagcgatcctcttgccttggcttcccagaatgctaggattacaggtgtgagctactgtgcctggcttttgatttttagacagggtcttgctctgttgccgaggctggagtgcattggtgtgatcatagctcactgcagccttgaattcctgagtttaagtgatcctcctgcttcagtctcccaagttgctaggactacaggtgtgtgccaccacgcccagctactttatgaacgttttgattccaaagtctgaaaaaagttttccagattcatctccaggtcaaataatgtccctgctgtcaggcatcctgctttagaagcaagatgtagcatttttcttcctttacttgcagcaggcagctaataactgttatcctgtgctggaccatccatgttctacgcattctaacatgtgctttacataaaaaattagcccaagtgaccctcactgtgacattacacggtacgtattattaatctttttttttttttttttttttttgaggtggggtctcactttgttgccaaggctggagtacaatggctcatgcctgtaatcccagcactttgggaggttgagttgggaagatcccttgaacccaggacttcgagactagcctgggcaacataggaagacccccatctctagaaaaaataaaaacatagccatgcatggtggcatgtgcctgtggtcccagctacttgggaggctgagaaaggaggatcacttgagcctgggaggttgaggctgcagtgagccatgatcatgctactacactccagcctgggtgacagagtgggaccctatctctaaaaagagagagagagagaaagagggagagcttttaaaaaatggcaaaatgtgcccacagctgatgggcctatttttcttttttttttttttattgagacggagtcttgctctgtcacccaggctggagtagtggtgtgatctcggctcactgcaacttctgcttcccgggcttaagcgattcccctgcctcagtctcctgagtagctggaaatacaggcacccgccaccatgcctggctaatttttgtatttttagtagagacagggtttcaccacattggccaggctggtctcgaactcctgacctcaggtgatccgcctgcctcggcgtcccaaagtgctgggattacaggcgtgagccactgcacccagccaatttctatttcttatagagcttacggtaggaggcttgaagatgggaacagaagaaaaaaggttgaagggcccagctgctgtgtgttgcaagacaggaaattgctgacagtctgcaatgccagcagcctcatgggtggttatcaccaggacagaggcctcagaacaggcaggactgggtgtgctggcactcacggctacgtgcagatagagcccgcccctgggccttggtgtgtgaccttcttcccaggtgcttctttgggaagctgtacagtgagggagatgaggcagactaagggcaggacacactagcataggagcggtggcagctaagtaggctgactgcccagggattgcagagttcacctgcacagtatgacatctctcatccttttggatagattgttctataaggtggcctccacctacccccaactcccaaatctgacattcattcatctacttcccctgaagtgctccctagcacttgccatgagtttgttcactcttgggaccccaaatccaaggcatctcactggctgagattcagtttaccacctcattgatggggggactcttatgtcacagaagtaattttctcactgataggacccaagatgtcgtcctatttttaatgtgggtacaaatactaagtaaatatgatcttagtgttttgccaaaaggaattaagatgtttttaatgggtcacaaattcagaaaggggttggacctggtgggacaggttggtgaggcccagaagctccacttcaagtgcagtactggacatccccttccagtacgggaggtctgacttgtgcagtcaagcccaatactggcacagccacaggccagggatggaggcttatgagtccactggaaaacagggaggactgagtccagggtctcaagggtttagtagtgagggctcctgtgaagaacccttcactcagtggtgttcattaccggccccttccttagtatgttccaggccctgaggatgtaccttgcatgctctgaccctttgaacaccaaagaaataagcaaggagataacagatgccccaaagagatgaatggtgtcatgagatctgggggctgggaccttgtccagcctaaaggtgtaagtaccatggatgagcagtgtcttatttaatcagcaactagagatttcctgaggtttaactgggaaagcaggttcatatactacaagacaccaggtgcttcacattgcttctctttattttcaacagtttctttacaacagtctacacagggattaactcctacatgtacttcccaagccagaatctccctttagaaattcagattctatttctaactctataagatgtatctccccaaagatcacattaactcctcaagtcaacatctgcctatccccaacttcccctttttttcctcactgaacatttgtctgaatgttttttcctcactgaacatgttttcctcactcacactgaacatttgtctgaaactgtggctgctttgttgcttcaagatgcatgcacatcctggctttagtgtccaagtatgcagaatgaagcatttgatatgtgcacccagctagttaggcatgaaacaggggcacaggatgggctccgggtcatagaaggttctgtccccacagtgaggacaggggttggcactaagccagaccatgctgggccgccccaactcacacagcaactccctgagcctggcatgcagataggcaagcctctccaggtggagggtaccatggatgtcctcataactctccagggggacaggatacagcacgtgggtcagattgctcagcccgatgaggtgctgcaggagactctgcaaggcagatatggagatggaattcccgtagaagcttaaggttgtaagctgggagcagtggctcagggaaggcaggagggcaaggagctgatcatccgtgatcccacactcatcaaagaccaggtcctggagggtggcagaggctctctccagcagagcttggaggggctcgggacttacatcggtcagcatgaccccacttagactcaggacacttagctgactgacgctgggactctgggacagatgcatcacatccccttccgaaagccggcagttagttattgagagggtttccaaggggttcatcacgtgcctgcaaatagacaaagcagttagtgctggggaatggtggtagtggggtggggagactggagagaggcccatttcaccaaaacccaaagtcttcctgatgatggttaaccgccaggatgccatgctgtaaaggagcattcaaggagtacaagttcaggtttagtcctttctccatcatttgctgtgtaagtgggtcaagtaaacaaagatctcaaacactcccttggctgatctgtgaggcagggtccaacacagacctcttaggtggtgtgagcatgaattgaattgagagcctgatttgatgtctcaagcaaggaaaggcatcagtgaattttagtatttgaagatacaactgaaaatactttctttcaactcgggcttccttctgccactgcctgggccccagtcacctctatctctgtgcctgatgaagctactagggagtattcacagtggacaaactggggcaaggtcagcaacatccaaagggggttcccaggctgcagggctaccttaggtcactgtatcatcagcaaaccacctatcaatttttgcaatttctctgttgttccttctcccacatctccagaatcctgcatttcccacctattaccctaactggaattctaaatcaccctttacagacaggaaatttgaggcaggtttagagggagcagctcatgttgagaagctggtgagcgcacagcttacaatttcaaatctcacctttgatgggctttcccttcttcaatgccctccttgcttacttttgatcatcttaggcatcacttcctaaggaagaatgcctaaagccacccttgccaggccccaacctcccattacagagttttctaacaaggagtcactgttaatagcatctatcctaatgtatacctctaacccttatgagtagtagttatgtgataccatgcttggggacagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagaggaggagtctacgcagattaatcatctggcccaggtaaggagaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctctgtgctcaaaccatctacttttcgcttctttgtcatgggctgagctgcttctggctctggaaatgagtacagactggccctgtttccagaccatacagtccagaagtcctgatgagagttcttccgtaaatccagcacttgaagtttccacctcctgtggggaaaaacaggtaattagctgagatgatgctttaagatcaactcaaaataagaccatgagtctcataatgtaggtaagaaccaaacagacatccaccttagatctgcacttttacttcgtacttcaggcatcagctgctccctttcccactaggatcctgggatccttcctggtccccaattcccaccccaccaggaggaagcaggtgcatgttccttcagacacctctgcattttaatcagtgccccatgtccagaagcccattccaagagtgacccctgcagtagccccaaggcctccctgaacttccttgctggcaaccatcagagcctctggcccagccttaggcgctccatgctccctgaccccagctgcatcctgctcaggttcccagggccccacaccaagctgctaggtcacccttacctggggcgaacctcctgggcaaggagcacatcaagtccatcaagcacagctttgaaggtctccaggtgaagatgttgtcccttcatcagcactcccagagggaggcaggtgaagggccaggcctgcaccattgccttcagggtctggctgtgtctcccgtcaaaggctgccatgaagagtggcgggaagagctccctgggcagcaactccagggcggcaatggccagggcctcatccttcagcaggctctgccctgccagctccacaagtctccgtgggcttgtccacacactcatgctgatgtatcggctctgaatggaaccctgaggaaacatacagggaacaaggcatccctttcagcccaagcataagcaactctatcttttcctcacccttctgagggaccaacttagggccaaagtcactgtgctagcaacagcaggggagttctcagtttaccccgattccactctgcactcggtggccacaaagccacagctctgctggcaccaggatgaacatctcatcaagtgtagaggaggggacaggacggccactggcaccatcttgtatctacccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaaaaacattctgagacatgtattttaagtgcgtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtatacaatacattattaactacagttaccatcttgtatactagatatcttgaaaaagcctccaccctccagcacagtggctcatgtctgtaatcccagcattttgggaggccagggtgggagaatggtttgagcccaggagttcaagaccagcctgggcaacacaaggagacctcatctctattaaaaaaaaaaaaaagaaaaaaaagaaagaaaatgtctttaattccaaagcatctgaaaagaaaaagaaaaaaatctatggaatattttttaaccttttagttaaaatggaatattttttaaccttgtagttaaaatggaatattttttaaccttgtagttaaaaaaaagcctaactagtaaatcactgatttaaaaaatcataaatgatgcaaattataattgcttgccacatactatttaaattgtaataaagtaaaattcaaagtagatgtcttttattttccaaaaaaaaaaaaaaagccgtttaagaaattatttttaacatatacaaaatggcagaaatcaaaatgtttgggattcaatataaataataaatgttccaggtaatggttatactaattaccataatttgatcattacatactatatatgcataaactgaaatttcacatgtaccctataaatatgtacaattattgtgtatcaattaagaaatcaatccaataaccaaataaaaatgtttgggattaaggcaaaactacatttagagacaagaacaaagcctgttcctttgtaaggaaagaaaaaggaaaaccatctaagcagcattggccctcatggcccgtggagaccctgaggtgacagtagaaggaggcagtggccatagcctgaggctcccgactcaccagacccagctgtggtgcagaagccatctgcccagacctctgggaagaccacaacattgactccatggcctctgggtccctcctctggcccctctgaagctattacaggcctttctgggcatacctcccctttcaactccacgctgccaacggaagagccaaatctaattacattcctggatctccagccagtgaatcctgatggggttttttacttacttcaggttcaactgattgaatgggatgtctatttacaaaaaggaaagaaaaagtgaacaaaaccacccagagagtataactgttaggggaatttttggccacatcaaaattacccaaatagtccagttaagatagctttatgaagagcatcatgacatcaccccttcccactcccaaacaatccccaagtatcaaattgtcacttataccccatgttccctaacacagcaaatcacatgcctatccaaggaaaaagggaggaacaacagaggggtggctggtcttccagactttgaaagtcaaggctgtcctgaaggaaggtgggtcaaaattacactacaattaggagttagtcagaagtaaggctgggcatttgtaatgggactgagtggattaccacaaagacagataggtttttttgggggcggaattgaaagactttggcctggatggagtagagaaattaaaaaggggaatggctaaggaagatgaaagatagttccagtaaagccaaggtaatcactgaggcagggagggagttcaatcttcctccctccctagagggaaagggtgttttctcccagaaagtcaggatcctcttggcaaacagccttgacaagattaaatctaggaatgtgggctggagaggtgggatagagagtaatattggtgaccaaacctaggacagcaacattttcaagtctgaaagaccttgtggtttcttaggaatcttggagccaggaaagaaataaacaagggctgaaagcacacatccctgcaattaaagaagttgtcagaagaccttctctttatggttaggtgtcctcttccacactggggctgttcacaagcagcaggtcaggcctttaccacaaacataatctccaatggccagccccttcctaagtattactaatgtttccacacttcaagaaaacagctgttctttcttgcccctaagctgctcaggtacagagattctggtcagcgagatgcaatcaggcctatcaattagactcagtttttctctatttccatgctaggcacagtgcacaaatacattttccgtcacaaaaaattgaagttatatttggcatttaaggatctgcttagggatgattcctatcctgggcctgatcacccactggtgcttttgaagttttggaacctctccacccaaagaattctccaggccattctctgcctcatgcactgtgaagtccctacaattcttatattctactggcaagtgtccagctggaatgtcttgcggcctgactttgtttactgtggcctgcgtaaggaggctgtaattcgttgaaggatgttttccattttggttctctctctggagactttctcctacttttcaccctcaacacctaatggcctttgtgaaaaccgggttaaactacaatttgttctacatttcctttaattcccaggcaatcatcttcactcatcagctgcgggagactgagattagtaataaaggtcattgtcaatgtccctaattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccaagcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttaaggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggcactggaggaagcagcaccaggggcacatttgcacaaaggtgctgtccttcctcccagtataagggagaagtgaaaagactggggcccagcatgactcctagggtccagacatgaattggggagatatttctgcatgtcctgtctactggttcttatggtccttgtgggctgcacaggccagagtggcctctgagctcatcaggtgggtggtctgcaccctcctctctagtcatagaatcccagtggggacccccgaagtatctgcaccaggtccttcaggtgttttttttggagtgcagtggcgcaatcttggctcactgcaacctctgcctcctgggttcaaacgattctcctgcctcagcctcccaagtagctaggattacaagcacacgcccccacacacggctatatttttgtatttttagtagagatggggtttcaccatgttggccaggctggtctcaaactcctgacctcaagtgatctgcctgtctaggcctcccaaagtgttgagattacaagagtgagccaccatgcccagcctctttttcttttttagagacagggtcttactatgtttcccagactggtcttgaactcctgggctcaagtgatccacccatttcagcctcccaaagtgctgggattacaggcttgtggataccaacagcacccgagcacggtcccacagtccaacgcactgtgccgtccttgagcctttagttccagcacaagtctcccggcttcaacccaggttgcatgttctccctgatctccccaggtggcacccaaggatgaggcagtgcaatcttgttgctcacttcccaggaccgacacttacccctaatggcccaagcccatggggcagtgagatcaaagcctcctggagctcatactctctgacaccactggaagtgtgggcttttgcgtctgattaccccggggaaaggttctgaatgtaatcgtggctttggcaataaggtccacaatgcattaagatttttttttttttttggaggaggagtttcactcttgttgcccaggctagagtgcactggcaccatcttggctcactgcaacctccacctcctgggttcaagcgattctcctgctcctgtctcagcctcccaagtagctgggactacagatgtgggccaccacgcccagctaattttttttctatttttagtaaagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccagctaactttctgtacttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggcttctctgagcacctcagacagctcaggggaccttcttacccacaaacgccttcgttccattttgaagcgacttaggctggcctcaggacctccaacgcttggatttctaggtctcagtcacttgttgccacgcacgtctgagagtaataatcaaaatgctccaaaaagaagaatacatgtataatatttacgaagcaacggcctcctgtgaaaacctccgcaaatactgctgaggaaactgacaactggcgactcaatcccgccctttcagtgcaaatctctggctccaaacctgagcaccagtgtttcctgggctgaaccagggggcaggaggaacaacagaccatgtggttggtcacaagtgacccctgtggtcaaggaccctgactacggtcttgcagcgacatttctgcctctgctcccgccttcctaggacgcctacgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggctcgaacttacgtttttcctcagagagttcaccacaccgcgaagttgctggaaggaaagaacgagacaatggctcagctaagcgccctagccgctgcgtggggcggggggggcggcggtgggggccggggggctgggcagcctggtctgaccaatccccgtttctcagtccttccagggcaaaatctcacgagatccagtgaggtcgcccagagagtcgagaggggcttgttttcaaagactgggaggaggaggggcagtgggggaggggcagtggggggaggagcagaggagaagggagcaggaggaggggaaaaggggagaggaagttggagagcagaggaggctgggggtggggagcagatgggggtggggaaggaggggagatgggggtggggaaggggggcgggaggagggttaggaatgggggaaggaagacagggtgggggaggggtgggcatgggggaaggaagacagggtgggggaggggtgggcatggggaaagggagacagggtgggggaggggtgggcatgggggaagggagacagggtgggggaggggtgggcatgcgggaagggagacagggtggggaaccgagaagaaagacagtggggggggatggaggaaggaacacagggtggggtggggggtcgggatgggggaagggaaacaaagagtggtggaggcgtggggattaggaacggagacagagggtgggggaggggtggggtgggggaagggagacagggtgggggaggggtgaggatggcggaaggtagacaaggcgggggaggggtggggatgggggaagggagacagaagggggggaggggtggggatgggggaagggagacagaaggcgggccagggcgggaatgggggaagggaaacagggtgggggtggggatgagagaagacagaggttgggggaggggtggggatgtgtaagaaaaacaaagggttggggagggggagggaaaagaggcagagagtgggggagggggtggggatgtggaaagaaagtcagaaggtggggggtgaggggtggggatgggtgaatacgtgatggctgcggcctttcccaccagacagtagggtgggggcagggtggaaaaagggggtgcggtgggcgaatggggaggcggggggctgactgggagtgtgggacggggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccctcgactccccgtgtttccactctccacagaaatccacgcattcacgcccctcccctcccccgagcctgcagaggactccgccctgctttccctacattcagggctgctccttttgtcgccaatacaaacctgttgacaggtcacgcctgggaagcgggtggggtgtcccggagcggtgctgaggcgctgcaggcccggcttctggctgcgggggagctgtaccctgaagcctcgccggaactcgcgtctggggccagcagggggcactagagtcaacagggactgtatgcaaaacccacttcctcccaggccctctagggggatggtcaggcttctgcagagatggggaggatcctttcctggtaaggggagagggacgggctaggagccaagcggaaggaccccgtgttcaaggcccttcaagggacgggacaggcgaggaatctctttgagtcttttgaattgttttatcagtcaggcctgggaagtactccgcctccacaaactctgttttcctgaaaggggtcgggggggggaccccaacatctcctgccacaggctatgatgggcatggtggctaagagcaacaggccgcgtggtgaggctggctttttgtggctctgccctgccattccccgaggcatccccatgccagtgaacagagctgcgggttcccagctgcacagatgaatgcacgaacaaaacataggtccatacaaaggaagtcattgcattgatccagattcgacctgggattgtcgcataaaacagggctgataaaaaccgtcgtgttttcaccctggaaacagagactcagcctccccctctttgcttgaggcattcagcaaaggtttgtccttgagtggctgtggatgctcaaggacttacgatttctgactttataaagtttagggtgaaaacaaaaaacaaaataaggagaccattgttttaaagtggccgttgtagctaattatctcaagaaagcaaacaggctggtactgaaagttacacaggcgggcggctccctgggagggttgcccagctctccttttctgagacctgagcagggagcagccagaggagcttgaagggatggtgttcagggcatgggaacaggctgcacacatcttcacggagtacggtgcttgtccagtttgagaagggaaagaaacgggagcagagggctgatgagaaggcagcagatggatagtgcgggattgaaaaggggatccatttgaagactggccaccattatttattttcatcatctgattgctgttgctccattgagatcgatgcgtggagaacaagttggggagtggaacaaatggcagggaggggagagaagtgagtgaacatgaccctggtccagcctcataggacagagcgtggtcatgaagtccacagaggaggacaggtagggaggaatcatggcatggccaggttgtagggcaagaggcagagaggagagaggattgtggaggatgcctgcggagtgccgactgtcagtcgaggctggtcctttatttatttattttttttttttgagacggagtctcgctcttgcccaggctggagtgcagtggcgcgatctcggctcactgcaagctccgcctcccgggttcatgccattctctcgcctcagcctcccaagtactgggactacaggtgcccgctaccatgcctggctaatttttttgtttttaatagagacagggtttcacgtgttagccaggatggtcttgatctcctgaactcatgatccgcccacctcggcctcccaaagtgctgggattgcaggcatcagccactgtgcctggccaaggctggtcctttcttttatggcgatgggtgtttgaaagttgcacataccaaaataaactcactatttgttgacccaaagtaaaaccctgagggtatgaaagggaagggctcatgcttacatggctgagataaaagctgtctcaggaagctgggtgtggtggctcacccctgtaatcccagcactttgggaggccaaggttggaggatcccctgaggccaggaattgaagactagcctgagtgatatagcaagaccccatctatatttttaaaaagggttggctgtctcgggacttttcgaaatagccctgcaagacattcctgttttggaatcacaacaatttagataagatgcttttgaaagaacacctgcctaggcacagcgtctccaccaatgaactgatgccaactgtggttttgagtcttcataaccggtgaactgtttgcaagcagcttatttaaatctctttttttgccaatacaaccttccctttgccctcccctcttgagatgcatatatggcttgccatagctgagcatcttaggttataatgctttttctcttttttaatttttttttgtaaatttatatttatttttatatttatttattttttgagacagggtcttgctttgtcacccaggctggagtgtagtgcataatcgtagttcaccactgcctccaactctcgggctcaagcagtcctcccacctcagcctcctgagtagctaagacaacaggcatgcaccaccatgcccagctaatttatgtatttactttattaaaaattttttttttttggtagagagagtctcactgtgtttcccaggctgggcttgaactccaggcctcaagtgttgctcccaactcgacttcccaaagtgctgggattacaggcatgagccaccatgcccagcgtataattttgtattctaattcctgaataaattcaacaaatttggaggtgttttttgtctgatggttccttttggtcgacaactggaatgggagaggaacagtgtgagggcaaacatcaagtgctttgctgagctccgggtgctttttttggataagacacagaaaatacaataagatgtctgtaatgtttgatttttttccaggtttcttgaggtataattgacaaataaaaattgtatggattcaaggtgtacaattcatatacattgatccacatataccttgtttgatgattaatcaaattagttaacacatctttcaccccagcagtcaatgtgtgtgtgctctgttagcaaatttcaattaataatatagcattattaactatagttactatgctgtatattagagtctcaggatttaccatcttataactaaaattttgtagcctttgaccaacatctctcattcctcccacccacagcccctgggaactaccattctactctgcctctatgagttccactttttgtgtttcttttttccctttcctttaattttttttgtatttgttatattaccaaaccatgtcaaaagagttccactttttagattccacatattattagctcgtacagtatttgtctttctgcatctggcttatttcacttaacataatttcctccaggttcattcgtattgttgcaaatggcaagattcccttcttttttatgactgatgatgtctgtctgcaatatttgaaaaaaaaatgcagatcacgtgaatgattgtctaatgtaattctattcatgtaaaattgtgtatgaccataacagtcactcattcattgcttcgagttctttacaatcggatgccatattcctggggctctgctaggcctgaaatggggagtaggagttacaaggttcctgggatatcagtaattcatatttgtgaatgtcttagataagtgggctaacatgtacagaaaatggtcactaaaatgataacactgtttgttataaaatacttttctgtattctcttgaactttttttttttatcatttattagactgcttcagctgccataacaaaatatcacagactggatggattaaacaacaaaaatttatttctcacagttctggaggctgggaagtccaagatcaaggtgtcagcaaggtgggtgtcattctgaggcatcttctcttagcttataggctgaggccattttgcgttgtgctcacgtgacccctttgtgcgcatgtgtggagagagagcatgggtgcttcttcttataaggatgctgaaagttatgagaacccgacccttgtgacttcacttaatcttaattacttccttagaggccccatctccatatacagccacaatggggattagggcttcaacatatgaatttgtggtggggggacgcaaacactcagttcataaacatatgatttttttttccttgatcggcaatgaaaatagaggtatcttcattttggaaagtgagagtcaacctgtgctgaattagagtgatgacaagagatactttaagactgcaatgagggaagcaagggatggggacgcatttgacagtctgttctgctgtgctcctggaagtgagagaggctgagtcgggactaacctttgcacggatgagatagagaactgagagagaaaagtatgtatttttctatgaccacctaaaataaacctggagttgaagggaccagcactctcaacctaaccattctgggaataaaaatcatagagacctcgctgattaatggaaacaatttgcctttcgattttctaagcaggtgaatgcaaggagtttgtgaactttactgctgttttcgtgtttttttaggtgaagacactgacagtaagaaaaggcaaaccacaggtccaagacaaagtggtcaagtcaagaaggaactcaggctgtgtagtcctggtgcaaggctccttgcccccagcgtggggtcacactggctggctgtgctcccacgacacttagtgcatactgggctcctgacttaataacacgtgtttgaaatggcccctgattcccaatctgctgcaggattctgcagatgcgcaacaggccacagtggaaggtcttggagagaattcagagtggcttgcctacgttcccatgaccgtttgtcctaatgggagaatcaccattttggaaaattcttttggaggccaggcgcggtggctcatgcctgtaatttcagcactttgggaggctgaggcaggcagatcacctgaggtcagaagttcgagaccagcctgggcaacatagtgaaaccccatctctactaaaaatacaaaacttagcctggcatggtggtgcacacctgtagtcccagctacccgggaggctgaggcaagagaatcgcttgaacctgggaggcagagattgcagtgagccaagattgcaccactgcactccagtctgggcaacagagtgagactctgtcttaaaaaaaaattcttttggggctagctgtgaatgagctcagagggaaaggcaggagccttcaggtagggagcagcatgattccaccccagattcaggcctcctgggtgtacagagggcaggaggatcctccccaggtatgtgagaggaagggaagatgaggtgtttgggtcagtgaacacactagaaatccaggtgctcactgatggattgtgcttggcatctctgttctgccaatccagcctcaaagcaactttggaagaggatttatgcgcttcacacgcttccagcttgggccagagcatctgcacactcccctgggtataggcctccagggcttggagcaacggaagagctaagaattgtcagtgctcaggaggcagattttcagggaggatcctcttgcatctcaggacatggaaagggctaacagagccttaagtgtcctgtcccagtgctggggtctcagaaggcagctctggggcatctccaccatggtctgacttctgctgcttgaaaccattctccctcacggcacaggcaagagtcctcaaggaagagcacctgggcacctgggttgactcttcctctctccaggtggagagaaccagtagagtttacctggggtcatgctctgagttaatccccctctgcatttctttctcttctcaggggcctgggctcagccttgactcagccttcctcagtgtctgggacttggggtaaacagtcaccatcttctgcactggaagcagcagtgacattgagggttctaaccatatctcttcgtacctacagtgcccaggaactggccccacactcctcatttattatgtccattctcaacccttagggggtcccagcttgattttcagtctctaggtctggcaacacggccttcctggccgtctttggcctctagcctgaagatgggcctgacagtcactgtttgttctgggacaaccatagcatttttacccacatgtgctccaagtccacggggaacagagaccaaatctgccatgagtgaccagtgtcacagggcttcacaccagtcaggcagtcagatggtggtgtttgctttcatttctgctcatcatcccaagggggtggacgcttcaggaatgggaccctatgcaactctcattgctctttataatgatgtgggaaagagaaaccatctcccaggggacttggctttgcaaaaatgaaaataaaagctccctcctccctctgtgcagtgaatggcctctgaatgcagacttggtctccctcttcagtggcaaggttggaggaagaacaacagcttcttattgcactgagacaactcaggggccacctcatttgaagatgtgcatcagtgtgagcccaggtattcctgtactcaatgatcgaggtctctctccttaccttgtctccacctggatctgaccaaagtgactgagatgatccaggttctagttttctcttgctgtgtaacaaatttctgcaaacctagcaccttaaaataacacccatttatgatctcccagttttcctggatcaggagtctgggatcagcttagctgagtcatctgttcagggtcttcccaacctgaaatcagggcattagcttggctgtgttttcatctggaggctcaactgaggaagattctgtttccaaacttactggcagaactcacttccttgctgctatatgactgaagccaaggttttggggggctatttgccgtcagtgcccgaagctcctagagttcctagaggtcacccatagctcttttgccatttaatgtaacctaatgaaaagagagatattccatcacctttgccatatttattggttagaagcaaatcacaggttcttcttgaattcaagtgaagagattgtgcaagggtatgactcatttggggtcaccatagggtacatcctcagtaattgtgtgcagtcaggactaggggaggagattctaattatacagagaagacttgtgccttctattcagaagttaagaagacatcctttactttttaagacactctgtcattttattcattgatttttagtggtgttctagaaagcagattttccaagcgtaaagcacaataatgaaatggcagagctgatgacagttcagatgctattagatgggtgtgcagatctaggtttagagccaagggatggagtagtgtctcttggtctccactgtggagaggccccttgggaaaacccaccacccccatttctcctcactccctgcctggacccatggtctctgcttggtctggcctatgctattaaaaatatacttcaatgatgatacttatgtcttgtgtttctctacactctttgtctatttgcagtggacagcacactgcatgctgatatcaaaaattattccagcaaattcaaaaataagacagtaaaaagaaataaaagacagttttacaatggaagagacagaaatgaatagttgcacttatgtttgatttagctgttaaatctaagagaaccaactgcgaatgagtagagaaagcggtcgttgctgcatactgaccattactagtgtgagatactgggggagctaggatggcctcctcttcctcttccttctcttgcctctcctcttctttcttttttggtaaatatctttcctagatcagcggttctcaaaactttcggtctcatgacctaatcacctcccagaggccctacctccaaataccatcacattaggggttaggtttcaacatatgaattttggggggacacgaatatttagtctagaatgctttttcaagaaaaggaggacagaaagatcatactacagtggcttttaaaaattagatatggacagcttttgtttctggaatatgtcagtgtgctgttgtgcaaagcatcccgggaacaacacctcagaatgtttcctttctgtgcctcagtaagacttgaaggctggtagggtagcctgagtcgtggctttcaatgatattcaggtcctaattcctgggacttgtgaatactgcctgtctttgtccgttttgcattgctgtaaaggaataaccgagtctgggttatttataaagaaaagagttttatttggctcagggttctgcagactgtacaagaagcatggtgcccacatctgtttctggtaaggacctcagaaagctttcaatcttggtggaagggggaggaggcatcacatggcaaaaggcagaacaagagggagaggagaggtgccacattcttttaaacaaccagctctctcatgaatgaactcactgatctccacagggagggcaccaagctattcacgagggatttgcccccatgaccccaaaacttcccaccttctttttctttttcttttttttcttttctttttttttttggagtctcgctctgtcacccaggctggagtgcagtggcgtgatctcagctcactgcaagctccaccttcccggttcacgccattctcccacctccctagtagctgggactacaggcacccgccaccacacccggctaattttgtttttgtatttttagtagagacggggtttcaccgtgttagccaggatcattctttttctttttcttaacctctgggagcacagaacataacataggatttggaggggacaaatatccaagctatatcattactttatatgagaaaaggggttttgcagatgtaattaaggatcttgagggagacattatactggattatgcaatgggccctaaatgtagtcacagatgtcctttcgagagggaggcagggggagatttgaggacagaaaaggagacatgaacagcggtgggatgatgcagctacaagccaagcaatgccagcagtatctagcagctggaagagtcaaggaaacagattctcccctgggacctccagaaggaaccagtcctgctgataattttatttcagttctgtaagccttcttttggattttagattctcagaactgcaagaaaataaattgctgttattctaagcccctaagtttttgacaacttgttgtagcaacaatgggaatctgatatagctaaggtaccatacattttgacatcttctctatatatggtaccattctgatttgtactgtgcaaggcttccttgccctctcactggtaaaccttggtatgcaggaaattatttttgtacattctccagtatattaactttggttataggtgatacattatatctattgcaaattatcattttgtctcctaatttgcatcaaccatgctgcttgtgtctatttatgactgattgtgtaggaaaattcttcaagaaaaaatcaaataggatggtaattcctgcatcttggaatgcctaaaaatcttctggcaataactgattacatagagaaaccatctgtttacttccttcaggaactacctggcaccttctagtgctttcccttgtggaccacaggtgatggaggctgggccctaatccagcacacacctccagtctagcgggcttctggtccagttatttacctacaggtattttattgatgttattcttcctctgatgacacgctgatttcaaaacatgcctaaaaccaaagacacaggatctttgaagtcccttccctcaaatatctgaggcttttccccaattgagcagcagttcacatgcttgtaagttttaaatgtgttaggcattttactggaaatgctttatatgcttcacactccacaggacttcttattcccagctcattgattgaggaaagtgaaatctgccatttgctgatgggccaatgtcaaggccaatgtcccagatcccctgtcaggacaaaagtgtgatgcagccagaagtcagccctcacctgcaaatgctctcctgaacttgcctaccctggagggatctgctcaccaggcagattccaggcgatgcccaaagcactccctaataaaactctgtgtgctcatctccgccttaacttctgtttccaggagacccagcttgtgaccattgtttccaggaagattaccaattgtctctgtttgccctggaccgaaggttttcccaggacatagatctttcagtgctaaaacaggacagtcctgagttatcttaggaccaggaatgtctatgaaaggagacacttgagagatgggattctggagccatggagaccccaatatgggggagttggaggtaggggcgcgagggtagatgcgcatatagcccctaccatggtggagcaatgcagtgtgtaaactttttaccagtggtgaatagggatgatttacctataggaggaaatgaaaaagcaggaccatgagtcagacatttgagagacgtgaagaaaacagaacattaaaggaaccaattccacagctttctctgttggaacagtgtggtagtactgatactaagtgtgattgatgatttgcaacagataaaatgctggaatgattaattagcaatgaaaaactagaagatgtggggcaacaaggctccagctccatcctcttagggtaccagctgggctcaagaattgacataaaacagattcgcaggagacaaaacatacaaatttacttaatacaagtttcacatggcacaggagccctcacaaggaaatgaagacccaaagaagcagttagagtcagttacttatataaggaattggtcaaagaatagtcagttgtgaagaaacgactaaaatatgtggggaaaaaagccccagaatctggtgtatccaaataggactccactctgatgacaggtttcttgggctgagattcctttgagccccatccaacttcttcccagctgctgagaagagaaaatcttttagaggcttcctggaattttcccagtccacactgattttgcttaaaagataaaagttattataataaggtctgttcagcagtatctcagttttgacttctcatccctgaggataagaatgttgcttttccttctagcatagggagggacagggtttttcacatgggacttttgtcttctgcttttaagaaacagaaaacagcagaatgatctttttgcaactggtgttttcaagtgccttttacttaaatagtcaatttgctagaccggtacttttttatttcttttcttttttttttattatactttaagttttagggtacatgtgcacaacatgcaggttagttacatatgtatacatgtgccatgttggtgtgctgcacccatcaactcgtcatttaacaccaggtatatctcctaatgctatccctcccccctccccccacaacaggccccagtgtgtgatgttcccccactgtgtccatgtgttctcattgttcaattcccacctatgagtgagaacatgcggtgtttggtttttcgtccttgtgacagtttgctgagaatgatggtttccagcttcatccatgtccctacaaaggacatgaactcatcaatttttatggctgcatagtgttccatggtgtatatgtgccacattttgttaatccatagactggtacatttttaactccatcagagcgcaagccaaaaagcttcctcctgggctgaaaaaaaaagcttccccctgggctgaaaaaaagcttcatcttgggctggaaaagctttttggcttgcactcttcctctgggcctgagccttccctgccctctcatctgcttggacagagggcagggaagactgaagcccagaacttaatcctaagtgtagcagaccatcgggaccctgacagggtaacagtggggtactgagtcacgggacgaggccatctggattcacgcacctgaaaatcttgatgtccttgaattttccaaacctgcagaagtggccctcccttactcattgaaacccatgtctcccttccttttgcctgaagatgatgcagagacctctgacctgtgagattgtatccaccaccacaagtgtccccagaaatctgccaccacctcctattaagaccaaaggaccaataactagaattgagtcccaaagaaacctggcaaggaatgtgatagacctgctgcagaactaaggagctgcagaactaaggagctccagaaccagccaacacgtgcagtgggccccaggcgagtgtgtatggggctggattctgagggtgtaagatcaaagtgcaaaacctaagattggattggggagggtttatctgctggaagcactctcctgggacgcaggctttaaccccctagcaaagacattgaggcattctgcaagcccgccgcaaggattgcccttaggaggacagagaaagcaatggtccgtaccaagcaaggtcataatgccagatgtgctgtggcagatggtgggagaggaatcaaaaggtcctgggaggccaggtgtggtggcttatgcctgtaatcccggcaccttgggaggccactgtgggagaatggcttgaggctaggagatcaagaccagcctgggcaatatagtgagaccctttctgtacaaaagattaaaaaaaattagtcaggcatggtggcacactcctgtagtcccagctactagggagtctgaggtaggaggattgcttcagcctggggagtttaagactgtagccagctgttccagcctgggcgacagagtgagaccctgaaaaaaagaaagaaagagagagaaagagagagagagagaaagaaagagagagatggagagaaagaaaggaaggaaggaaggggaagggaagggaggaagggaaggaaggagagaaagaaaaaagaaaagaaagaaagagagagggagaaagagagaaaggaaggaagggagagagagagggaaagaaggaaagaaaagaaaagaaagaaagagagagagagagagaagggttctgagagtgcttagctggaaaggcaataccaggtactcatggacatctccccaagtgagagaattctcaggagggcctggggactgcagtctgtaattgattgataagcggtgcactggtgagagaaatccagcatccttgagaaactcagtgggtagttctctagaccaggccagcaggggaagctggtaaggaagttgatagcaatacggatggaaggaccatgcagtgatagtgtcacattgtcagggcttaagcataggagccaggtgtgtggcaaaagatgaagtggcagcaaggcacctgacattgaatgatggagtcagtcagtatagcatggcacctctcggggcaagatgcataagccaccaagaaagggacagcttctaatctttttagcttattttttatttttttgttgagatgggggggtctcactaggttatccagagtagtctcgaactcctggcctcaagtgatcctcctgcctcagcctcccaaattgctgggattacaggtatgagccatagcttccggcctagcttttaatctatattttcagagggaagtaaggaagaagggtcaaaccccattaacaagtttctgaaagagcctaacttgcaatgtctagtcattccagagtaggatatttaccccaaggattaattcactgtagttgctgtgataaatgaccaaaccataaactgagtgactaaaaacaaagacctctaaatgattacacctggtatctttggaggagccattcaatctactatacgctgcttccaagtccttgtagaaaaacatacggaaatcatgcatcatcccatgggtggaagacctcgctccaggttagtgaactgctctgatttgtgactccaaagatggacattggtgacagcaaaaggaggacccagaatctcgtgtattcaaacagaactccactctcatgagaggtccttggatctagacccttgggtcaagcttcctctgagcattgtccaacatcttcccacttgctgagaaggaagattctttatgtgggccctggaatagcctcagtccagcctgatctctctctcttccctcctgaagttttatttcaaacattttgagactctaaaagggtttctttgtctcatttctctcctccagtcctactaccagggttgtcttcaatttatatccaatgtttctctggcctggaactgagacctacctcccaagcagcgacccgacccgtggagtggggtccctggggcaagcgaatggtcctttgcctggagaacctgggccagcagtcatggcaggtgacacattccattctggggcgaggaaccagggagggagcactgcatagatcagaagggtaaacaaggggagggagaaggagcaaacttagatttgggagggaaagagggaagggtgcagaggaagcagaacacggatgactgggcctccttcagttgttcttgtgactagaccctcccatctaagccaccaggggacaggaagggtatgagtttgaggactctaatggccccaaggtactactgtggtttatcctacttgtaggcggtcccaagagctttgttctctccagggactcaaaggggatgaacttgcaagtcttttgtctccactcagtgccttctctgattaggccaataaacatccccaggcctcagtctcaggccactgtaggggctgaggacagtgagaaagatgtgtgagcatccaccctttggagaggttgagtaggaatgagaggtcccctgccttgcctttggtccttgtgaaggaagatgttggatatttcccagcttggctggaatccgttcctcaccctccccattcagagcagggatgagtaagtcctccgctttctccgcaaccacaattgtgtttttcaggaaaggataaagtgggaaagatcagatcccatgcctcttcctcctctaagtcatgggatgactgcagagagtgagcaagagggtaaaaacagtgcactgagtgtgatgtttgctaaaggaacagataattgcatcaaaacctatttctagcagagttgtggtgcttgcctataatcccagctactaaggaggctgaggctggaggattgtgaggccgggagctcaagaccagcatgggtagcatagtgagagctcatctctaaaaaacaaaacaaaaaaccacacttatttctaattgtctaattggtatccactatcagacctttctgggaagttttttttctaacatgcctaaatgtggcttggagactgtttgggtgaggccaatagcttagccttcctacttaagttgtctccttcattcattcaacaagcaggtattattgagtggattgttgggtgcatttgtgtgtcctcagtaggatgcaggcatgcaatacatgaagatatgataattccagtcagaggaatggcctgtgcaaaggccctgaggtagagagaaccttgataattgaaagaacagaaagaaatccagtgggactggggaaagagaggaaggagatgagaggggagttacaggcagccaacagatcatgtgcagacagatcacttgaaagcagaggcaaatggctggatgtttttgttaatgaaaagagaatttatttgaagatcttccatcatttttacatgaagtgattgatgtgttaaatgaatgaaatttaacattcatggtgtatgaaatttatggaagaaaaactgaagcaggcagagcattttatggcctttgggcacaagagagtgaagcttgtcccatgtagagtcatggagagtgactgggagattcaccattagagttggcagattggctcttggattgaatatggggcatgaagcaaagagttgttgactcctggaagtttgactttgtcaatggcgtggctactactttcttttattaagagagagacagatgggagagcaacaggtttgagggaaacacataaagtgctttgtttggactcatggggattttttggagaagacagacaagatacaagtaacaagatgatgatgtctgtaatatttgggtacaaaatgcaattcataaacctgattgtataatatgatcctatttatgtaaaatcatatatatttagttaccttgattcaatttatacatcactaattgtttccagtaatattaaccaaaggtctactatatgccaaataaccttttatggctagagatagaaaaatgaacaaaacttactatgttcatccttatggaagatacataattcatatttgtaaacatcacatttaagtatggcaagaaatctggtgggatggttcctaaaatgaaacaatagtttcataggtttgtgagaatttaggtgatatttctacttaactttcatgtacactaaaaatttttcctataactcaaaaaaattttttggaggcagattagcaagatatttattttggaaaagcaagagtcaatctgaattgaactggagggatgctgagagttctagaacttcatagagagaaagaaaactgagttattgggtgggggttacacctatctttttgtcttttcttttctttctttcttttttttgagacagggtctccctctctcactcaggctgaagtgcagtggtatgatcttggctcactgcaacctctgcctccctagtagctgggaccaccacaggcatgcaccaccatgtccggctaatttttaaaatttttttggtagagacagagttttgccatgttgcccaggctggtctcagactcctggactcaagagatccgcccaccttggcctcccaaagtgctgggattacaggcgtgaaccactgcgttgggccgcttatcactttaatgtctaatgagaggcccctggagctggaacccttagccccagcctgacccctgacccttctcccatgtcctcaaattcaaaaactcacctctggctgtccattcagttgttctcaagtctgactgtgctctttgtccttcatgaactagaactagtctttctttcaaaccattttgatgagctgatcaatgtctcctcataccatttttctcattcagccttcctcctggggttggttttatttaccatctaacaatatttctgtaaccctgagcctctagagctgcctcaggtgcactaacgctgtgactaggctgccctgggacaagctaagaggttctgcgggggagggtctgggcccctggtgtggcagaaggtgcatccatcctggaggaagccagaggaccaagggccaggagcctgggggggattagaagggaccaggaggcctggtcctgagctgggatgggaaggaacgggaaggggcaggagcaggacagggatttccagatccactcagccgcctccctggggcttgggctcctccatctgaggccaccagggggcggcaagggcttggatttggggaagggaattgctgtggtttaaccagggagtgtatgaagctccatgggctgcttcctcctgagacccttctaagggagaagtggggagtggaatgtccaaaatatgttgtgtcccaatatgttcgtttctagaaaggctaataaatagcctcagcccccagcctcagagcactgcatagaaagaggacagaggtatttgagggtcattctgagagaacctagaaggtattgagtgggaataaacagtccccagctctgcctttggtccctgggaaacagagtgcctggatcactccacagtggtcatctgggatctggtccgaggtctcttccttgattctgttccctgagccttttttattctattttggatcagatccatgcacacgtagctcagagttgtgcccaagatttcataaggaatttacagggttttttccccctcaaacttatttctctccacagtctgcccattatttatggttccccagactttcccttttggtcttctggtgaaaaaactgtgactttaataagcctgcggtgctgtgcacttcctgcaactgagtccgtgtccacaccaaacaccaagaggacaaagagtaacaaaggtaaggggattaagtgccactgtcttggaaatcagctccaaagatgagaaaagaaagtccgcacagtctctactgtccctgctgtcaccacgaagaatttcctggaggctggatcatgtagaatggagagaagaacaaacataagaaaaggaaaacgtggacatttcaaatttgccctgagcactaggggtttcctttctcatcttcaagccagaacagtggagcttcttctggaacttttgtggctgcacactggtaccccttccaggtattggtctgccctgagtgcaggccacaggacactgggggaaaatgggaagctctctgctggtttgattttactaaaagtgctagtatctcccctagtctgcctccagtgatttgcttttccaagtaatcaaattgatgctccatggattctgtcccaggttttacagctgggcttggagaaaatgtggtatatgccactgcatccgaaatggaacctgaaaacagtaataatattctaaacgtgaaaattaaatcaatctgaatcacaggcagtggaaaacatcaaaagatgaaagagttttaaaagtgatttgaggaaagaaacagggagaaatattttcacattggttctatgtttactctatttatcttttttaatttaattttaaaaatagagatgaggaggtctcactatgttgcccagccaggctggtctcgaactcctgggctcaagcaattcacccgcctcagcctcccaaggtgatggattacaggcatgagccaccacacccggcccctgtgtttcttatgtgctccttgattaagaagagttgttttttgtttttgtttttgttttttgttttcttgagatggagtttcacttttgttgcccaggctggagtgcaatggtgcaatctcggctcactacaacctctgcctcccaggttcaagcgattctcctgcctcagcctcccaagtagctggattacaggcgtgcaccactacaccagctaattttttgtattcagtagagacggggtttcaccatcttggtcaggctggtctgaaactcttgacttcaggtgatccacctacctcggcctcccaaagtgctgtgattacaggggtgagccaccatgcccggccaaaaagttggtttattgtagcttgtggatacagtgagatggaagaaaacccagaaagcagaaataacacttctttgtaatatgaggaaaaaaataaaagataaagttgaatgaaatatttcatatatatatgtttcatatacatgtttcttatatatgtttcatatacatgtttcatatatatgtttcatatacatttcatatatatgtttcatatacatttcatatatatgtttcatatacatttcatatatatgtttcatatacatttcatatatatgtttcatatatatattgcaacatatatatgcaatattcatatatatagccatatatatgtttcatatatatattgcatatatatgtttcatatatgtttcatacatatgtttcatatatatatagttttttacagagtcttgctctcttgctctgtcacccaggctggagtgcagtggcctaatcttggctcactgcaacctctgcctcccgggttccagtgattctcctgcctcagtctcccgagtagctgggattacaggaacgcaccaccatgcctggctaatttttgtatttttagtaaaagtggagttttgccatgttggccagtctggtcttgaactcctgccctcaagcgatcctcctgcctcagtgtcccaaactgctgggataacaggcgtgagctatcacgctcggtctgaaatctttagataagtatgaagtctatataaaaaaaaaaggctcttactaggctagaaatggcccattttagaagctttcattttccacctcacactcatctctctatagatcctctgcttgggcagtgggtggaccttgtggtcctcagttctcaggctgagaaccagaggctgaaaaggacaagtcacctgctcatgagtgggaagggcaggattgggagcagcggactgtggctccattgctccttgtttcctccacaggcccctcccacgtgtgcccctgaatgacctagaatgactaatgtgctcaagggatttgatgctgcagatgcttcggcatgaagggtgggggtggggatgggacaaggctgcagctgaagagatgggagaccaacaacacacagcaggggtttccatggggtgggcacccccatttcctcacagtttagagagcctggaggtgggtgccaagcagagggcaccatggcgtggcccaggcctggaggttcacagagacacaggcacaacacagcagagacactgagggccaggagctcactcagatgagggacttcagcagatctttctctcttgaggaaattaggtacaaaggaatcaagttcctaccatcagaatagacaacaagttttaatctcctcagctgagccccgctgtcgagggaagcagaagtctctgagcccggcccaggtgagagtggggtgaggagaggagctcagggtgcagatttgcatgaaggccccaccctcctctgaggcagaggggataagacaagtctgggggtaggcccagcgctggggtctcaggaggcagcgctctctcgggacgtctccaccatggcctgggctctgctccttctcaccctcctcactcagggcacaggtgacgcctccagggaaggggccttggggacctctgggctgatctttggtctcctgctcctcagactcacctgggcccagcactgactcaccagagtgtatttctccctctttccagggtcctgggcccagtctgttctgactcagcctcgctcagtgtccaggtctcctggacagtaggttactatcttctgcactggaaccagcagtgacattgggggttatgaccttgtctcctggtgccagtagcacccaggcaaagcccccaaactcatgatttatgatgtcgctaattggccctcaggggcccctggttgcttctctggctccaagtctggcaacacggcctccctgaccatctctgggctccaggctgaggacgaggctgattattactgcagctcatatgcaggcagctacaatttccacagtggtccaagttcatgcgtaatgagaccaaaacctgccctggtctctcaggctctctctcgctatgaaggtgcttccttaccctgtgcagaagagggtttcatgcaacatggccttgagaatttcatccactctcagcccctctcccctccaacaatgaaatgcaaaagaaacatgctctctggttaattgtctagggacaatggcagcttcttcttttcctgtgtgatatggtcctgcatggtgactctttccaacttttcaatggcagggacagagcaataggatccatctgctcagtaccatttctgcagttttctatgaaaccctcacattaaatgcctccatctcccacactgtgctgactggcctgggtctgtgctccagaaataacgtcttactcaactccatatccaccacgctgtagtaaggatggctgtctttgctgggttatttgttcctctgcaggtctcttcccaaagcaacaccaactgagagaagatctgaagatgttgagagagtgagcataaaagtaaagggttttatttatttgctttcttttttttttaactttgtttttatttatttttttgatacagagttttgctcttgttgcccaggctggagtgcaatggtgcaatctcagctcactgcaccctctgcctcccgggttcaagcgattctcctgcctcagcctcctgagtagctgggactacaggcacgcgccaccatgcccagctaatgtagagatggggtttcaccatgttggcctggctggtcttgaactcctggcctcaggtgatctgcccacctcagcctcccgaagtgctggcattacagacatgagctaccatgcctggccttgtttttattttttagagttcctttgtctttgacccgatgtctatctatgggggcttagccagggcacatttgagtgattgttctttgcgagaacattgttctttgcagatcattaaacccctgtcctggaaacagtcctgtacttagactgtctccctgttagcatgggctctttcctaaatgatccacaggaaagcttatttggtggatgggtcttctgttcctcaaggactctatgggtagtttattttcaaggtgagccaatactgtttctagctggaatctcatttaatctcataaccatgagaattaattttttaaacctgcagggtgttctctagccattttttaattttctttgattttgtgagccacttttaaattataatcatcattaaaccttaaaacatataaacttcaattaagcagattatatattttattttattttttgagacagagtctcggtctgttgcccaggctggagtgcagtggcacaatcttggctcgctgcaaactctgactcccgggttcaagtgattttcgtgcctcagcctcccgagtagctggaattacaggcatgtgccatcacgcctagctaatttttgcatttttagtagagacggggtttcaccgtgttggccaggctggtctcgaacttctgacctcgtgatccacccgcctcggtctcccgaagtgctgggattacaggcatgagccatcaagaccagccacatatttttaaaaagtacattggttattatccacatacctttggactgctataacacaataccttaaactggtggcttataaaaacagaaatgtatttcttacactcgtggaggctgggaagtcttaagatcaatgtgctggcagatttggtgtctaatgactgtctgcttcctcatagaggccattttctcactgtgtccttggaactgaggacaaagcagctcctggtaaagttcagatgtctgtttcttgcaggaaaatttctctttacagtgatctgggctactggctccaacacacgcacccagatggatttctgagccggtcattgaccattaccattttaatattatctcaaattataaacattatctcaactattgtttaatataatatagcacataaatgtttaaagcatacatagcgaaacaagggtcttacattcaaaactgtcatttccccaatcacccatctccttgtccaccaagccccagtgccaccacttagctcattgctcctttggcttcactttctggtgctcttgcaagtgtctgtcatgtgttacaaacaacaacaaatagtcctccaagaacgtttacctccatagaatccctatcctgtttcctgagtggacatttccatttttaatctggcaaagatcagtcagccctgattagtgttttaaactcatatccatctctttctagaaaaacacactaggttaagcatctctctgtggatgggggaccctcatgaaggcacacagctctgagctgaggtggcctcaatgtgtacaatggagcaagacaaagaaaagtcccatgttctgtgtgatagacagacaggcactgatgagaggtctccagagctggcgcccttagtctaatcttgactctagtcctcgtctttccgacccttaaacactagaattcctggtctgcattccattaggtcattcttaaatctagtgagctgtatctccttcatgcaatgtttttctttcactattattttcagctttattgacatataattgacaaataaaaattctatatatttatggtatacaacttgatatattaatacatttgttgtacattgatatatttgttgtgaaattactgcaataattgtgtgaaatcacaatcaatctaattcacataaaataaccttacataattatcatcttctttcttttttttttttttttggtgagaacacttacaatctaccaaattagcaaatttaaagtaaataatgcaatattgttaaccatagtcacattgcggtacattagctatctagaacttattcatcttgtatcactgtactcttttataccctttgataaacatctccccatttcccttttccctccccagtcctgacacccaccattttactctctggttctatgagtttgaatattttagattctacatgcaaataagatcatgcagtatttgcctttctgtttctggcttatatcagttaacataatgtcctccagctttatccatgttgttgcaaatgatgggatttcctttattttttaaaacttggcaatatttgtgtgtgtgtatgtgtgtgtatgtatgtatgtatgtgtgtgcatgcaccacattttctttatccattcatttgtcatcagaaatttaggttgtttccatgtgttggctattgtgaataatgttgcaaaagacatgggagaacagatatctattcaagattctgatttcattttgttttgagatatgcccagaattggtattgctggattatatggtagttctatttttaattttttaaggaatccccatacattttctacaatggctgtttagtttacattcctttcaacagtgtacaagagtttcttttgtccacatccttgccaacatttgttatcgtttatctttttgataaattacaggcacgtgccaacacacctggctaattttttatatttttggtagagacggggtttcaccatgttggccaggctggtttagaactcctgacctcaagtgatccactgcctcggcctctcaaagtgccgggattacaggtgtgagccaccatgcctggcctattttttctatttctataaagaatgacatttgtgtattgataggtctagcattgaatctggagatcactttaggtagtatgaacatttaagaatattagttcttccaatttataaacacgagatgtcttgatatttatctgtatcttctttaacattcttcatcactgttttataatttccagtgtaaaactctttcacctccttcgttaagtttattcctaagtactaattccttttgtaaatgtgattgctttcttaattttattttcatatatttactgtctgtgtgtagaaacgtcatcaatttttgtatgttgatttttttatccttcaaatttacttaatttagttttaacagactttttgttattgtggagtctttaggtttttctacacttatgtttatgtcatctgcacacaaagattaggattttaatccttcttttccaatttggatgcgtttcatttctttttcttgtcgaatttctctggttagggattccagtgcaatgttgaattaaaataagtggagagggggcatcttgccttgtgtgggatcttaggggaaaagcttctgtttttttcccattgattatgatgttagttgtgggcttttcacatatggtttttattgtgttgtggtaagtttcttctgtacctatttcattttatttttgtttttttaaatatttattttataatagagattaattttgctatgttgcccaggctggtcttgaactcttgggctcaagcgatcctcctgccttagcctctcaaaatactgggactacaggcatgagccactgtgcccggcctatcactattttgttgagagttcttttcttttcttttccttttttttccattgctttcttttcttttcctttccttttttcctttccttccttttcttttcctttcttttctcctcctcctcctcttcctcttcttttttctttcctcctcctcctccttcttcatcttcatttaaaatcatgaatggatgttgaatttggccacatgccttttgtacatctgtggacataatcatatgtgtgtgtgtgtgtgtgtgtgaatctttcagcctgtggatgcgctataccatccttgcacatgcggaatcatccttttatccagggataaaccccacctgttcctgatgtatgatcttcttaacatactgttgaatttggtttgctagtattttactgagaatttttgcatttaatatctgttaatgtttatcagaggtagactggcttgcagttttttttcttttctggtgttgtctttgctttgttttggtatcagggtgatcccgacctcataaaacaattttggaagtgttcccttttctattttttggaagactttaagaagaattaatattaactcatctttgaatgtttggtagaacattcagctatgaagccatctggtcctgggcttttctttgttgagatatttttgattattgagtcaatctccttctttgttattggtatgttcaggctttgtattttttattgatttgcttttttttttaagttgactgtttctaggaatttatttatgtcttttaatttatctagcttggtgtataatttttcaaaatagtcccttatgatcctatttatttatttgagacagggtctttctctgtcacccaggctagagtggagaggcttgaccacagctcactgcagccacaacctcccaggctcaagtaatcctcccacctcagctttctgagtagctgggactacaggcatgcaccaccatgcctggataatttctttttctttctttctttcctttctttcctttctttcctttctttcctttctttcctttctttcctttctttcctttctttcctttctttcctttcctttctttctttctttctttctttctttctttctttctttctttctttctttctttctttctttctttctttctttctttctttctttctttctttctttctttctttcttttcttcttttttttgtatagatgtgacctcactgtgttgcccaggctggtcttgaattcctgggctccagagatccacctgcctcggtctcccaagtgttgggattacaggtgtgagcctttttatttctgagaaatctgttgtaatagctccttttttcattttggattttatttgagtcttctctcttttttcacagtgtagctaaggatttgtcaacttcgtttaatttttcagaaaaccatctcttagttttgtttttttctattatctgtttgatttatttctgctgtaatctttattatttcatttttttctgctaagtttgggcttagtttgttcctctttttctagttcgttgagttataattttaggttgcttatttgagatctttcttcttttttaatgtttgcttatctccataaacttcccacttagcactgcttttactgcatcctataggtttggtgtgctgtgttttaattttcatttgaagatatttttaaaattccctttggttttcctctttgacccaatgcttgttcaacatgtgatgtttgatttctgcctatttgtgaatttttccatttttttttactgttattaatttccagattcatttcttgttgtaaaaaaagatttttggaatgatttaattctccttacatttcttaagacttgttttgtgaccaaacatgagctctctcctggagaatataccctgtgcatgtaagaagacattttgagaacccaggtggtcttttctcataccatttttctcacccagtgctcatactgaggttagttcattttacatctaacattttctcagcctggagctaagacacctcatgtacctttgacaaagccattctagcacaagcaaaacggtcctgagaacgagtatcttagccacctggtatggcagaggacacattcatcatggaaaaagtctgaggaaaagggtcaagattagcatggatcgagggtctggtcctgagctgggaggagaaaaaggcaggttggagtgggaccaaaccaggtatttctatctctcacttagaattgtgtcttggtacttgagatgaaccatctgaggccaccagggggcagcaggggactaggttggagaagatgattgataaagtttatcctgacctttaagaagcccctgagtcggccgggcgcggtggctcacacctgtaatcccagcactttgggagactgaggagggtggatcataaggtcagaagatcgagaccatcctggccaacgtggtgaaaccccgtctctactaaaaatacaaaaattagctgggcgtggtggcttatgcctgtaatctcagctagtcgcgaacctgaggcaggagaactgcttgaaccagggagttggaggttgcagtgagccgagatggcgccaccgtgttccagcctggtgacagcgcgagactccatctcaaaaaaaaaaaagtccctgaatctcaaaaaaaagaatgtgactttatgattaactatgaacagctgctcattaataaaaagccattaaaaaaaaaaaagaaatcccaagagctacttacccttgaatatctctaaaggtactgggaagcagtgctccaaatctgttgtggcccagtgaattcctttttagaagcaccattaatggtcctagttcaacatgtcaggccccagctttaaaccactgcaggggcaggggatgtagcagtgcttagaacccaccttagctgagaggaccaagatggttgggcaggggatgagggaaatgagaagttccagcactgtctgaagtctctgggaggaggagtgattgaactttcccacccggcctgggagcagcctgtcctcacattcatccctcacagcacaaaggagaagtcctggtttcctcagcctggagctcctgcaatagtgagggttaggatatctctggactggcctgatgtcctgggcactctcatgggttcagtctcaggaaatccatgcctaggctggattaataccctcagctgagcctcacagggaagcagaagtctctgagcccaggcccaggtgagggtggggtgaggagaggagctcaggacacagatttgcatggaggccctgccctcctctgaggcggggggataagacagggctagaggcaggcccggtgctggggtctcaaggcagcgctctcgggacatctccaccatggcctgggctctgctcctcctcaccctcctcactcagggcacaggtgacacctccagggaaatggccttggggacctctgagctaatgcttggtcttctgctcctgctcctcagggtcactggacccagtactgacccagtagagtgtgtttctccctctttccagggtcctgggcccaatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttccatagtggtccaagttcctagggaactgagaccaaaacctgccctgggctctcaggctctgtctttgctctgaagatgcttcctcaccctgtgccaggggcttcctgcaacagggccttgagaattcacttctctgtcagctcctctccttttccatcaattcccaaaggaaacctcctctcttgtttactctccgggatatgacagcttcttcttcactcgtatgacggatgtcctctctgaattggaaactacttctagctctttaacaggaagtacataccggcagggaaatgcctgcctagtgcagtccccatacttctccggatgatcctcactttattatttatttttatttttgtatgcactaaagtcgtcaatgtaaatccttacgtcgaatgcctccacttcccacattgtgtagcacagcctggattcagttcttcagaaatgacgtcctcttcaatgataaaggaccactgctctgtgaacaccccactctagtgaagatagcccaccttgctgggttattcatgtacatcttttgtggaagcagtaaccactgtgtaaagctccaaagatgttttaaagcaatgaaaacaaagaggaagaagtgtgtgtgtgtgtgtgtgtgtgtgtgtgtgtgtgtgtgtgtgtagggtccatcctgtttgccctaatatctcaggttgccgagctagggagtatttgagtgacagacttggtgccctctcaggatcctcctcctctcacatcactgagtccctgtcctggaaacaccctacaggtggacaatctccccatagtatggaagtttccaaaatggctccacagggaagagttgagctgaacacacccactctttctcatgggcatcaaatatatctaatttttctggggaaatcatcaatttctagctggaatcctgattaatcgacagactgtgagaattaaaaattttaaaaatattcagacatatccagagtccagtatttaaattctctggaattttgtgagccaatctttaaacatagttattattgtagtttagagttcatgaacctgaattaaatagattctagtaaacataaagtgccttagttgtctattgttgcataaaaattactcctaaaattaacatattcttaatgagaacacatatgcattaatctgttttcgcactgctataaagaaataccttatttataaaagaaagaggtttaactggctcacagttccacatggctggggaggcctcaggaaacttacaatcatggtagaaggcaaaggagaagcaagaactttgttcacaaggtggcaggtgagaagagctggggagggtgaacttccaaatacttttttttttgagatggagtctcactctgttgcccaggctagagtgcagtggcgtgctctcggctcactgcagcttctgcctcccaggttcaagtgatcctcctacctcagtctccgagtagctgttattacaggcatgcgtcaccaagaccgactaatttttatatttttagtagagatggggttttaccatgttgaccaggctggtctcgaactcctgacctcaagtgatttgcacacctaggcctcccaaggtgctgggattacaggcgcaagccattgtgcctggccccagacacttttaaaaccatcagctctcatggtaactccctacccatcacgagaacagcaaggggaaaactgcccccatgatccaatcccttccgtccctcaacatatggggattacaagtccctccttcaacacatggggattacaatttgagaagagatttgggtggagacacagagccaaaccatattaatgtatttgtgatcttgtagttttcttgcatcaagaatctgagagctgcttagtttggtggttctgactctgggctcctcatgaaattgcagccaagctgtcaggcggggctgcattcagaggccagagcaggtggccaggcccagcctgagggggcttctactgtccctaacctctttggcagatgtagatgaagtcagggaaaaggggagctccccacagtgggtagcatcccagtgtcagagggaaggcaccatggagcagtgggaccagcacaggaccctgggggtgcactcagacctacctggagggatggcaagaaggggcattcacagcagggacaggataaagggcctctgccccatgtccagagctgtcttggcagctcagtcacattggttatcaggtaaatcggaggtaaaccctatcctgagttttaccactgaaaatgggtacaatttgaactaggagtgttttcagactttttctttccatattgacttcttaataaccgcgatttaattttttttaaccccagcctagtttagctacatagcttccaaatgtcatgctactgtgaaactgagcaattagttacttttatcagagcattttaaatttgaacaggttccttggtctttctatgtgtaattagtcaaagcttaggtatggagtagaggatctttaccaaatgcttttctagactctgttttcattggacttatagcagctgtttcacctgggccatgcaggaataggagagttgttgctccttgacatagcatctgtaacatgcctatcctttctgccactataaaaatagctgtgctttctctccactcgtctctcctgctgtttccctgtttttcctattaaatatgcagtgtttgcaatccatcttgcattctgagaagatgaggattttttttcataaagaatgacctaaaatagctctaaagatcatcagaagtcacaactacatacttactggagtgcaataccaaatgtggcctctgattacagtaacctggagcttgcagtttaagcaattcagtccctgtcacttgtggacagattcgtatgtctgtggatgagaagatgagcaacggtcactcctgtgctcatgcacagatccctccctgcccctgtcctcaaattcagactgaagtgcatggccctggagcattacatgagtgatggtttaagagcacgttggtgatacacacaatattaatggtatcttaatttgcttgttaagcataatttgaaaacatctggacaaatttggacacaatttgaagggcatatttgataatagcttgtgacaaatgattccgttctgggagagatgctatttttggttctctaaatcgccatgaaatgaaaatctcagattataaagaaatagactcaaatcccaagtgtcttttgcttttcattccccatcaactgtgttgcccaagcaccatgtggacactgcttacagggtaggcagccaccagctgaaggcaggttctttagttgtctgagctgtcctggagctgggaacagcagcgtgtgttctgtgcctgttggtccctatgtagcacacacccactgcatattctcgctgactcaccaggagggcttgcagcagccctggcctattttcttctgaagcacctgccaatggtgcattctcccctggtcataatgcaccaggagataaacatggcatttgacacacaggtgctaactggatctaggacttctaagcttaagtagactcagagtgggcaatctaaaaaaaaaaaaaaaaataggttctcaatcggtagcccaggctggagtgcagtggctccatctcctacctcagcctcctgagttgctgggacaacaggtgtgtgccaccatgcccagccaacagagagggcaatatggacttgaaatggacaatttccattacttgaaagtttttgagaaagaactgaggtttgtttaagaggaaatcagccagagactcaaagttaaatctatcaggcccaaagtctctttggggaaaggagactcttggacgtgcacgcagcagcaagtggtatgggatcccttctctgtggggaccttggcccaactgccaatcttttcaactgacccatttgcgttttccataagtgctcgccagccagcagctgtgactgcccctcagtctcaggaagggagaaagaaggaaacaggagcaaagcctctttcaatcttagcaaataaagtgggagctttgacttttttgaacacccagatgacaggaaagaggaggaaaattttcctaaagctgttattttttaatgcctcaggaagaatcacacccggagtctcatccacactttatttggaggtatttgggtctcagagtttgtgctgagttagttaatgatttgggctactgggatggggtgaatgtgttttacaagtgagaaagaaataagctttggagtccacagggtggaggcttattggctaaattgtgtccctcaagattcatgcaatgaagccttaatcacagtgtgtgactaaatttggagacagggtctttatggaggtgattaagtgaaaatgaggtcatgagggtgggttcttatccagtctgactggtgttctccttagaagagaaaatttgcacacacagaaatcagacaccagagatgagcaggcggaggaaagaccatgtgaggtcacagcaaggaggtaacgacctgcaagccaaggagagaggcctcagggaaaatcagtcctaccaacactttcaccctggactttccagcttcagcactgagaaaataagttttgctgttgaggccactagttctttggtatcttgtgatggcagcactggcaaatgaaaacaagagggaccccaaagaccttgggtagggggaacagatggagcagggtgcaggaggcagggcagggaggggctggaaggtcatgctctgaggttcgtttcctggatggaactgggactccactcactactgtctggggaacttggggaaaaaacttcacctcccaatattgattccctaataaaatctgggccctgagcatagggctcctcatcttcctactccatatgatgcaagttttcttgaagttatgcttgtaaaacactcaccaatgcatctggcatatattaagggctcaaaagtaggccaggcatggtggcttatgcctgtaatcccaatactttgggaggccgaggtgggggatcactggagtccaggagttccagaccagccaggccaacatggtgaaactccatctctactaaaaatacaaaaaaaaaaaaaaatagctaggcatggtggtgcccttctgtaatctcagctattcaggaggctgaggcaggggaatagcttgagcctgagaggcggaggttgcggtgagcccagatggtgccattgcactccagcctagatgatagagtgagactccatcacaaaaaggaaaaaaaaaaggttgtcattctgcagcccagatcgtgccattgcactccagcctggacgatagagtgagactccaccacacacacacacaaacgcacacacacacaaaaactaacccccgccccgcaaaaatcgaaggtagccattctgctgtatgatctattgatacatacaggatgacatttgtcctgtgggcaccagggggcactgtgacccctggtttgggacactaatggctccaagtccctggtagtacttgagtcatttcctttctggccccttctattgagtggaatcctgaaacccacctgactcttctactcttgaaaaattacgcagagaatgtcctcagacatagggtcagacaagaacttcgacatacattttaaagaatggagagcagatttacatccgctgcttaacagggaaccaactaacaaagaattaagaataaaggaagtagagttgcatgaagagactcccctttctatgataagaaaggcctgaaggtcccttcccagctgtggactcagaggcagagctctggggcatttccattatggcctggacccctcccctgctcgtcctcactctctgcacaggtgctgcctcccagggctcagcccccagtgggatcaagatcagcctggccctgaccttcaactcaacatagggagtgatgcagggtgtggggttctgggaatgaggccctcatcctcagactcacctctcctgtcctctcttgtgggctccgttatttcctctgggccaactcaggtgcctgcagtgtctgtggccttgggacaaatggccaggatcacctgccagggagacagcatggaaggctcttatgaacactggtaccagcagaagccaggccaggcccccgtgctggtcatctatgatagcagtgaccggccctcaaggatccctgagcgattctctggctccaaatcaggcaacacaaccaccctgaccatcactggggcccaggctgaggatgaggctgattattactatcagttgatagacaaccatgctactcaactcacagtgacacaggcagatggaaaagtgagacacaaaccctttttctgtctgtgtcactcacttcctccggccccagcaggactgtggacacagccatgggcaggtctggctcagttttcctggatctgagaccccagggtgccctgacctccaagccctccagggagactctgaagagagtgggttaggtcaggagaggacttggggctggcaggaccagactgtcctggtattgtccagagtggctgtgtcttggcttaagatgacctgagtgtaaggatagtcagagggagacagccattgagtggtaatggtccctggatttccttctgtatggtgactggacctaaggcagtgctgcttttctgtggcccaaatgccccagatcattctgaacttctcaggtttaactgagaccctcaagccccagctccatgacatcctcatattctgaacagggagggccaccacaatgggcagtgtggtgtccatcaagattcccctttcagggctcacccatccgccatacacccaaagctgccgggaggccctggcttctcacagctgctccccaccggaaaatgccattgattgcaaagaatggcctcccccaaaagtttgcccatgtcagagcgtggctcaggtgcaatgactgcttgatgcctcaatcccaaagtcaggccttaatttaggatggccttgaagtgtgttgcagctgagcactcaattgtaacacattcccactcatgcctcccatacttctttcctgagaatatatccctaaacctcactgcatggaattccccctctcagagtaggagtctggggaattaaaagatttaaaaacaaaccaaaacagtccaaagggaagagtaacaaagaggagagagttgcacagagagaggactctggagtctgcaaatgttcgtgagcaccgatgagcacatatgtgggaggaaacaacctctggaagagaaaagaaccatccaaagacacttgagagaacactccagagcgtgtgtgcacgcacacacacacacactcacaccccacataaagaaaacaacaacactcatcatcatcaaattgctaaaaaacattttagcaattttatgctaaaatgatgatgaagaaatgtggtgaagaaatgtagccttaaaagtagccagagagacgaggtggctcacgcctgtaatccaagcactttgggaggtcgaggcaggtggatcacctgaggtcaggagtttgagaccaggctggccaacatgatgaaaccccgtctgtactaaaaatacaaaaaagttagccggatgtggtggcaagcgtctataatcccagctactcgggaggctgaggcagggagaattgcttgaacctgagaggttgcagtgagctgagatcgcaccactgcattccagcctgggcaacagagcaagactcaatctcaaaaaaaaaaaaaaaaaaaaagtcagaggcaaaagacatgttagatacaggtgaacacaatgacaagagcagaatttttattagaagcaatgcaagcaggaagtagtggagctatatttataaaatatgaaaagaaaaaacttataacccagagcaatctacagcctcactgaaatccctaccaaaataccaatgacatacctcacagaaatagaagaaaaaccccacaattctacaatttgtatggagccacaaaagacccagtatagccaaaatgacactgagcaaaaaacaaaactggaggcatcacattacctaattcaaaatatgctacaaacggccgggcgcggtggctcacgcctgtaatcccagcactttgggaggctgaggcgggcggatcacgaggtcaggagatcgagaccatcttggctaacacggtgaaaccccatctctactaaaaatacaaaaaattagttgggcgtggtggcgggctcctgtggtcccagttactctggaggctgaggcagaagaacggcgtgaacccgggaggcggagctggcagcgagccaagatcgcgccactgcactccagcctgggtgagagagcaagactccgtctcgaagaaaaaataaataaataaaataataggccatatgtgatggctcacacctgtaatcccagcagttaggaggccaaggtgggaggattgcttgagcacaggagtttgagaccaccttgggcaatataatgaaaccctcatctccacaaatttttttttttaaattagccagccttggtggagtgagcctgtggtcccagttacttgggaggctgaagtgggaggatcacttgagcccaggaggtggaggttgcagtgagtcatgatcttaccactgcactctagcctgggcaacagagaaagacactgcttcaaaagcaagcaaacaaccaaaaaatcaagtaatatcattgaaaagggggcaaaggatcagaatagacttttctcaaaagaagataaacaggtggccaacaagcatatgaaaaaatgctcaacgtcactaatcatcaggtgaatgcaaatcaaagccacaacgagacatcatcttaccccagctggaaaggctatcattaaaaagacaaaaaaataacaagtgctggtgaagatgcagacaaaacagaagacaaaaaccacgtgatcatctcaacagtcacatcaaatgttttcatgtagggaaacattactgtttgtgattttccagacttgctagagcatcataaaaagtaagatttgtggtgccgatattggagggggtgttattctgtgcaaaaaacctggatatcccatatccaactgtgaagatacttactgataaatgctaaaaaattgcaatattgtgtgtccaaatgttctgggggtcaggagtggggtctcacacgggaaaggattcagtcaaagagaaaaatagagaggctagaacatagaggaaaacataatatgtctggaaataaggagtccaaactaattggagctgagtgataacaaaagaacaatggcatgaaccatctatttctctctggaaatctcattgatatattgtgctctctccagggctatgcccagctagattataaaattgtctgttcctgaaacgtttcttgcgtatatgacagggcctaacactggaatcaagctcaggttgatgagggcagggcagttaagcacccgaccctggtggcctgtgaaatacttgggggagacaggggtttgttgtctaaagcagaggaagtgagattttccactgtggcttagaccagagcttctgaaattccagtgagcaaacaaatcccctgtggagtctgtttaagatgcagatgcagcctcagcaggtctgcgtggggccccagagtctctatgtccagcagctcccaggtgaggctcatgctgcttgtcctccaagaaccacactttgagtggcttaactcctattcgccctcctcactcaagcacaggtgagactctgccaaggaaggcactgtctgagaagcaaaggtgaccttctgtccttcctcccctggtgttttagtccatgttctattgccataaaggaatatctgaggcagagaaatttataaattttaagaaagatttctttggctgaagcttctgatggccggaagttcaagagtgggcatctgcatctgttgagggcctcaggttgcttccactcatggcagaagatgaaggggagccagtgcgtacagagaccaatgggagagaggaagcaagtcttttcctaacaagaatgcagggatgtaatttaatcatatttataaagtgtttgacatagagcctgacacacccaggtactcctagttggcagcaattattactgtcgtcgcacatgaaaattggacctgggatggaggaaaggcagcgcaaaccctctgtttgggacaagagagacttaaataatttaaaattgaggcataggagataaggagagtatccctgggtgttctcctgccaattctctcagcatctcggaaactgtttcaaggtgatgaagtcaaccagagagggaagcggaggagtttgtagaaccaagggttgcaacttcatccatgaggaggaggtgtagtcaggggattgggaagaggtggctgagctcatctgaagggtgtctaaggttttctggcccccatgtcctggcccatccctccctgcccagggtctcacccctcacctgacagcccagagctggagagtggcctatgattctgattagagaccccaccaaagcccagaggggaagacatgggtgggaggcgtcacagaagacagttttctgcctgtggtgttggggcagtttcctggaaaggaaattcagacactgtaggggagaagaaaacacaggagaggaaggcccctccccaggggattgtggcgttagagaccaaagcatcttcaagaagcccagccctgcaggaggttccctgagcccagagttcctagagctgtctgtattattttgcctggggtgccataaaaagtaacacagactacatgactcaaagaacagaaatttattgtctcactaatcttatggcgatggtagaatctgagatcaaggtgttggcagggttggctccttctgaggctgagggagggtctgtttcatgcctctcccctggcttttggtggtgtagcagtattagctgttccctggcttataggtgaatcaccccaatctctgcctccatgttcatatgacgttttctctctgttcatgtcggtgtccaagttttttctttttataaaaagaccagtcctattggatttggggctcactctattccagtatgacccgatgttaactaatcacatctgcaaccacccttttcctatgtaagttcccattctgaggtcctgatggatagcacttcaccatatgaattccagggggcacaaaattcaaattcccaacaatgggccaggcacggtggctctttgggaggatcccaaatcccagcactttgggaggccaaggtgggcggatcacatgaggtcaagagttcaagatcagcctggccaactggtgaaaccctgtctctagtaaaaatacaaaaattagctgggcgtggtggtgcgtgcctgtagtcccagctactcgggaggctgaggcaggagaatcgcttgaacctgggaggtagaggttgcagtgagccaagatcgttccactgcactctagcctgagcgatagagtgagacttcatctcaaaacaaaaaacgaattcccaacaatgcctcagacatggcttaagctgcccactggggctctgcaggtgggatgtgcaccaccaagctctcaggtggggcattacctgacagcccagaaggactccgggccctctgcaaagtgcctgatctcttgcgcaccttaaaaggtagcttttcaggctgttcttgttcttttcatgctgacgtaggagattttatcctctgctttttaagtagaagcttccttaccctcctcatcatcctgagtagatgcctaggctggtttcagagaaatcaaaccagggtggattatgagttatattagccaccagctgtcaatattctctgaatgcccagcatccatccatgctctctgaccatcaccagagtgagcaaatctctgacatgtggataagagtttcttccatgggctcccagccaggctgtaagtgagaccagaatacccttccttcagtgcatggggctcagtgcagctgcctccctgacagtctccctgggacattaagcttgtcagcttctctcttccaaatgcaggtctggttgtcctaagcccagctcagcgctgctgtggactttgcatcctaaaaacattatcaactctgccttgtgcctcagtggactggcctggaggaaacaatatgaggtgtcctggctctttccacccccagcgtctctctccctcagtggtaccagtacggtcctcatgacggttcatctatacctgccaatctaggcctccacactgccgactgtggatggtcacagaacccaaaatgctaatcagccttaagcagatcatgctaatagtttctgcagatctgggtgcctcatcccagatctaggagttcacaagctaggccagctccagggagataacatgtatcacagagtctggacacgacaaagtggctttgctgtatttttgctgggacacatgatggtgatatcaataagaactggctcaggtccctgcagcttaaggcccattgaacaggaaagcagccaggaggatgtgctgccttttgacctgtacacaaatcagtgccatgtgccgactgtgtgtgaatatctgtgcctgtgtgtatatttgtgtacatgtgtgtatgtatgtgtacgtgtccaagttggtgttgcaaggaagtgttcctactgtcaaatgtttcaaactcaaatcttttctgttttcctaacttacctgcttcttctatctctagtgcctttgttctgcactaagaataaggatgaagattagggtagtaatactagcaggaggagtaaagattcatatgtgtttaatacatatcaagcagtcttccaagtacttcatatttattaattcccttcatctcaacaactctatgagttgttcattatccctccgttttacagttgggaaatctatgatacatagattttgagaaatgggaaaactaatgcagagaaaagaagaataacatgcctgatgtcagaactagaaagtggctgacccaggagtagaatctcaggtcttctggccccagaaaacctgttcttaggcaccatcctgtcgcctgtcattgcatcaatgtggtaaggcattggtgtgtctttaaggctccagaaagttctttctactttgtatttattttgttttgtttttgagacagagtcttactctgtcacccaggctggagtgcagtggcaccatcacaggtcactaaagtctcaaccttctgggctgaagagatcctctcatctcagcctcctgagtagctgggactacaggtgaatactaccatgcccagataattttaaagtttttttgtacagatggggtctcactatgttgcgtaggctgttctcaaactcctgggctcaaccaatcttcctgcctgagcctcccaaagttctgcaattataggcatgagccactgtgcccaacctttactttttaaaagtatcatattgtgactttgagtgcaccagcagtgctctagtgctggtctattagaaatgtaattttaagaatatatatatataatatacaattttttagtggccacatttaaaaggtaaaagaaacaggtggaatttatgttcataatatattgtgtttaaatgatttatccaaaatattatttcagcatgcattcagtattaaaatattgagatatttattttatttttgtactaattctttgaaatctggtgtgttttactcctacagcacatcttacctcagactacccatgtttccagggctcagtagctccctgggactcatggccgccatattggacacagcaagtccagatggataaaggtccatttgggtcacagcccctgcagtacatactgacagctacctgggaagaatggagagttccatgacccaaagggcctcctgagggaggaatggcagctctactttccagccaaagcaggaatattgagggcactaagaaacaagggaatttttacagtgtgtttcacacttcttcccttctcaaagacattaaatataacttcaattttaaaggtgaacctcggccatcaaaggcatgttttctattggtctctttccggtggaatgaatggcaatggtccctgtaaattgtgctccaaggatccctttcagtgggaagattcttgtgataagcccaataacaagtaagaaagcaattttttatacatagatctagaacaaaaagggctcatgatgaagaatattttattgaagcttagtgtattgctatttttcataaattgctgtttttgcctatcccacaagcactgatcacttttatgaaggtacattctccaagggtcgtcttagcatgtcaggacccacaagcaaaggtgttacaagtgacctgcacgagtggccagcaggacacctggaggagcccagtgagatgaggagtggatgcgcatcaggtgggaaggcatggagaagctgtgtgccacacactcaccaaggacaggagcgggcgtatttgtggcctgtggcctaatcttaggtcagttacctctttagactaaatcccaaggagtcagcacatggaggtttcggtccgtgcacatggcacctacagggcttcacatgacgttgctaattacaatgcagcggcacttacaaaggaattagtttcatcacatcctcagcagaactaggtctaaaaaccaatatatatgtataggatatcaggtgagaaatactttcttgccaatcatgtgtattaacgttaaagtggttcagtatctagtgtgacagttgttcaggcttagtggccttgaccacgtcaaaaatggaatcctgatcctaacttgtctagagattagcctggcacaaggagcatgaccaggcatctggatgtccccagtgtcactgcagacacatgctcctttttcatctgccagagggagcattaggatgtcctcacctctgtccccagaactcaggaagggcagtacacctgactaaagagtagagggttgtgaaaagagggacctagggcactggataagcaggaggagaaggagcactgggtgggaggtagagaaaggagggggctgaatggttaggctctgaggtgtgtctcctggatggagtcttggattccactcactaccatctgagaactttgagaaaaccgtgtaacctcctgatgttgggtctcttgtcagtagacatcagtgctttcctgatgtatagggttactgtagaattataatgaatgcctggttgaggtgacatgtctaatacaccctccaaagcatcaggcatatattaagtactcataagcaggcattctgtgtgaactagtcatacatggaagatgacattccccgtgtgggcacagtaggatgctgtggactttggtttggggaccctaataacttcaagtcccctggtagcacccaagtgtaaaaggcaaagggcatgactggtgcttcctgtgaggcctcttctatttggtaaaattcactctccactcatcgcacccacctggcctttattctaaacttggaaaattgctaacatgaaggtctcagcctcagggctcagataagaactcagacacatcaatagagaggatggctgaggtgcttggccgagctcagtgaacaccccagaacaggaactgaggagtgtatgcatgtgttgggggcagcactttctcactcatccagaaagtgtgaggaatctgtacagaactggggacagggcccatttttatacccttctataagcccagcccttgtctgctcactagggagccattcaccaaggccacaggagggaaggaagtagatttgcatgaagagcatccccttcctatgttaagagaggcctggaggccccttcccagctgtggactcagaggcagagctctggggcatctccaccatggcctggacccctcccctgctcaccctcctcactctctgcacaggtgctgcctcctagggctcagcccccacaggaccaagaatcagcctggccctgacattcagctcagcacagggagtaatgcagggtgtggggctctggaaatgagacccttatcttcagactcacctcttctctcttctcttgcaggctccgtggtttcctctgagctgagtcaggagcctgcagtgtctgtggccttgggatagacagccaggatcacctgccagggagacagcatagaagactccgttgtaaactggtacaagcagaagccaagccaggcccctgggctggtcatctaacttaacagtgtccagtcttcagggattcctaagaaattctctggctccagctcagggaacatggccaccctgaccatcactgggattcaggttgaagacaaggctgactattactgtcagtcatgggacagcagtcgtactcattccgcggtgacacaggcagaaggggaagtgagacaaaaaccttttctccatctgtcacactctttcttcagctccaggaaaaaactgtggacaaattcatgagcaggtcttgccctgttcacccagatatgagaccttgaggctgcccttccctccaggtctccaggtaggctatgaaaagggtgaatcaggagtcaatacacacacaattattataattttattcttgtttgaagaagaagtagaggaataattgaacatgtaaagtgaaaacatggaaaaccgaaaaagaggaattattgaacttgtaaagatgaaaactacaatgtctgaaatttagaaaatacactgggtgagtttgacaacagaaaaaagattagctgcaaaaaaaaagattagctgcaaaaaaaaagattagcaaattgtataatacagcagtagaaattgtccaagatgaaacacatatgggaaaaataattatggaaattaatgatagaaaggaacagagtatcagtgagttgtaggacaacttcaaacagcctaaagtatgtgtaattagtgtttgaaatagaaatgggtggaggagaaatagaaaaaagtatttgcataaataatggccaaatatttttcacctttggtgaaaaccataaactgaaatatccaagaagctcaacaaaattcaagtataggagacatgaaggaaacaactccaacataaatcataatcaaattaataaaatccagtgatgaagagtcacctaaataataatgctaagagcagttctcattaaaagcaatgcaagaaagaagacggcggagcaatgtcttgaaaacactaaaagaagaatcctgtcaaccttgaattctttttcttttcttttcattttctttctttctttttcttttcttttcttttctttttttctttattttttttttttgagacagggtcttactctgtcacccaggctggagtgcagtggcacaatctcagttcacaacatccagggcttacatgatcctcccacttcagcctcccaagtagctgggaccacaggcgtgcaacactatgcccaggtaattttgtattttttgtagagatgaggttttaccgtgttgcccgggctgatctcaaacttgtgcacttaagcaatctgcccgcatcagcttcccaaagtgctgggactccaggtgtgaaccactgggcctgccaaccttgaatttttttaataaaaacaaacaaacaaaaactttcaaaaaaggagacaaaataaaccctttccagacatatgccaaattaaagaattggttgctatcagactcttacaattagaaatggtcaaggacatccctagacagaaggaaaatgataccacaatgaaatgtgaatttataccgaaaaatgaaaacatcagatatagtaaccacaaggataaacatagaaacctctgaattgtgttaatgtctaataaagataattaacacttcaaagaaaagctaacgtaaatacattgtgatttgtaatgaaaatgaaagtaaattatgtgacaaagcacaaaagctgaagggatgaacaacatgttataatggtcttatactatatgtgaatatataataacacttgaaggtaaaccttgataagttatatacgtactgtaaacccaagcaatcattaagatcaacttttttttttttttttttttttggagtctggctcagtcgcccaggctggagtgcagtggcacgatcttggctcactgcaagctccgcctcttgggttcacgccattctcctgcctcagcctcccaagtagctgggactacaggcacccaccactacgcccggctaacttttttgtatttttagtagagacagggtttcactgtgttagccaggatggtctcgatcttctgacctcgtgatctgcccgcctcggcctcccaaagataaacccttttaacagaaataattatggctagtaagccatattagagttctccacagaaacaaaatcaataggatatgtatgtgtgtatatatgtataatgtatatatgtgtatatgcatgtgtacatataatgtatatgtgtgtatatacatatctaggtacatatatatggagaagaaattggttcatacaattgtggctgactaggatgaaatctactgggcaggctgaaggctggacatttaggtaagagttgatctcgcagttttgagtctgaattctgcaaggtgggacttcaggaatcctcagtatttgctctgaaaaccttcagctcattaatgatgcccacatgcattgtggagagcagtgtgcttatataaagtctacagatataaatgttaatcacatctgaaaattatcttcgtgccaacttctatactcgtatttgacaaaatcaactaggcactatacctagtcaatctaacacttaaaattaaacatcacttaaaccagcaaggagataaaaagaaataatttttaaaaatcagtcaaaaaaaggaaacagaaaaagggaaggagaagcaatgaacatatggcacaaatagaaaatgaagggcaagttggcatatttcaaccaaattatgttactaatcacattaattgtaaatagtctaaatatcacaattaaaaggcagagattgtcatgttgaaatgaacaagactcaactatacatgctgcctagaaaaaaaaccacttcaaattataaaaccacaaaaatccaagtacaaattaaggacaattccccccactcccaagtctgtttcacaaagcagtacaaagaaggattcacagtaaattttttttttttgaagtcttactgtgtcacccaggctagagtacagtggcaccatcttggctcactgcaacctccaccttccaggttcaagtgattctcctgcctcagcctctggagtagctgggattgcctgccaccatgtctgatgaatttttgtagttttagtagagacagggtttcaccgtgttggccaggctggtctcgaccttctgacctcaagtgatccgctggccttagcctctcaaagtgctgggattacaggtgtgagccaccatgcccagcccacagtgaactcttaacacacagttatagaaatatgcatcacctctcccatcaccctttcctctctctggcttccaaaaccttggttctggtaccagagctgagggaaaacattccacagaaatattaaatcaaggtgaagaagggagattctcaagatgtaagtaaaaggcaaatgagggaatggaagtcgcaatgcccttgcatgcataaggacagctcctgcatgagaatgttgtttgaaacattaccgaggaattggtgtccatgttcatgcaggacataggtctataggatatttttgtcatgcctttgtcgggctctggtatcagagtaattcaggcctcaaataggtagtagggaaatgtttgcttctcctctatattctgaaggagattgtgtatgattggtgtcatttcttccataaaaacttgatagaatttaccagtgaagtcatttgtactaggtgggcttttcttagcaggaagattttaaattgctaattcaatatatttatgtgtcatagatctattcagattttctcctttatgaatcgattttgataatttatgtatttccagatacttatccacttcatttaagtcatccataattttggcatttattgttcgcattattccctataaccattgtaccttttgtaaggtcagtggtgatgtcactctttaagtcatggttttgacaatttgggtcaggagaagatttggaggaggagagaacaaggttgtcttgatgttgtcttggctggagtgtgacttggagaaaaatgacttgaatgaaaatacagtcagagggagatatctgtcaagtggttctggtgcctggatttccacatgtgtggtgacggagcccagcccagtgctctactcatgcccagatgtcctggattattcccctgaaatactcaggtgaagctccagctacaccatggcatcctgatattttaaacagagaagaccagtgtcatgggcactggtgatctgctcctcagggcagactcactaaccgtggcagctgggaatcccaggggcctcacagctctcactaaccgtggcagctgggaatcccagggtcctcacagctctcactaaccgtggcagctgggaatcccagggccctcacagctctcactaaccgtggcagctgggaatcccagggccctcacagctcttttctccctcaaattgctgctggctacagagaactgcctccaccaagggcatgcccctttcacagtgtggctcaggcctaataactgcatgagactgaaataccaaggccctgtctcaggttaggatgaccttgcagggcctcccagatgagtcctcaactggagtcagatttcaggctgcccagttgtgcccccccatacttccttccagagcgaatatctccaaacactactgtatgcaattttccctctcagagtctgattccagggaacacaaaatagaaaacagtctacaaggaagagtacggaagaagagagagcagcacagagacaggactctggaatctgcaaatattcctgagcactgatgatcccatgagtggaaggaaaatacttaaggccaagaaaagaaccacccaaagacatttgagggaacaattgcagggcatgtgcatgcgcgtgtgtgcgcacacacacactcacacacacacacacacaccatcagaatagagtttgttcctacaaccagtgtggaaatgtgtctaatcagaggcatcaggttaactaatcagaatttctctgccctggctgagcaaagtggcttacacttgtaatcccagcaatttgggaggctgaggcaggaggatcacttgaggccaggagttcgagaccagcctgggcaacattgtgaaaccccatctctacagaaaacttaaaaaatatagctaagcatggggacatgcacctgtagtcctagctaatcaggaggttttaagcatgaggactgcttcttgagcccaggagttcaaggctgtattgagccatgatctcgccacacagtttcaaaaaaaagaaaagaaaagagaaaaaaaaatgaataagaaaagctctgccttagtatagggggaactaactatagactaaaatctgctcctatccctcctaggacaccgtaagagcaagttcagaaaggaacatactctcttcaagaaacccttctgaatcaaagaagacaaaaatatgtggagaaatataaaaatatcatgcacctaaaaagcaaaacttcacgatgtctggcatcttattacaatagcaggacaacgtgagtcagaagtaaaaaagttggtcagcgcatcatggccctgaaattgcacaggtaatacactttctagaccagaacaaaaagcagttgttgtaactgtaatccatttgtcctggagggtagagtattgatggaacaagttaaatggagacatgaaagacatttaaaaaacacctacatttaagtcctagaaatgaccacagaaatatatgaaatcaaagtactttgaatgagattgctggtatattacatgctgaaaaagaagagattagtgaatctgatgatatagtaatgagaactattcaaaatgaaatatgcaaaactactgaaaatgacaagaaaagagcatcgttgagttatgggacaactgcatgccaatgcaacctaaaataacgtaatttgtgttactgaaaaaaagaagttggtgggggtaggggagtatatagaaaaactacaaaacaaaataatgactaaaaatgatccaaattttgtgaacatcataagccatccattttcacgaagctcaaccagcccctgacaaaatatattttaaaatataaatacgttaagataacaataccaacacatatcataatcaaattgctaaagcacagtgatgaagagacactcttaaaagcagccagaaagaaaagacatgttagatataatactaagagcagagttctcattagaagcaatgcatgcaagaagacaggtagctacatctttataatattaaaaggaacaactgtcaaccctgcagtctttacccggtgaaatatctctcaaaaatgaaggccaaataaaacctttttcaaataaataaaacttacagaattgataaatcacaagccgtcactaaaagaaatgatgaaagacatccctcatacagaacaaaaattataccagatagaagtgtgaatctgcacaaagaatgaaaagcatcagaaatggtgactacatggataaatattttaatagtgcataatgtagaaataaaagggcttgaacagcactatagaacaactagacttaaccgatgcctgtagaactcttcaagcaacaaaagcagaatgcacattcttcttgcatgcacatggaacattctccagaaaaaccgtataaaacagattgataatttttaaaaagatagaaatcacacaaagtatgttcccaaaacaatgtcattagagaaatccaaaaaattgagggaagaccatgaaaactgcatgaaaaaaattgagatgaatggacaaatcactagaaatacaaattctattagaagtgactcaagaagaaatagaaaacccgattaaaactatagaaagagattaagttaataataataagaaaagccttcccataaggaaaggcccagacacagagggcctcactggtgactattaccaaatgtttaaagaagaattaatataatttatcattaaacttttccaaaatataaaagagataaaatcacttgccaactctttctctgaggccaatattaccctgataccaaaaccagacagagccattacaagaaaagataaatacagagcaatgaccttactggatatagatactaaagtccttaacaaaataccagaaaatgtaatctaacaagatataaaaagaagtacatacaataaccaagtggtgtttatccgaggaatgcaatgatggtttaacatctgtaattgaattaattaatagaaggcatcgtattaatagaagaaaggacgaaccatattgtcatctcaaaatcacttaaaatgttttcatgcaagcagactttctttcttgctgtttttaggccatcatgagaagtggagatggcatggggtagtatttcatgcaaagaatctggatattccatactcaactgtgaggatactttctgataaatgtaaaagattgtaatattacgtttctgtatgttcagagaacacttcctagacaagatatgtgtacagaaccgaaaggacaattaggattttggcaggcattgagtgaggagtggagtcactgcaagtgtcagtcagagaacaagaaagatgttaggaaccatgtatttctacctggccatcctactgggataccatccccttcctaacacatcacccatgtggcttgtaaaaatgtccatacttgaaacattttgtccacataattacaggtctagtgctggaatcaagttccctttgatgacatcaggacagttaaaggatctgcgtgtctaactgcccccaggtgatgctaacattgctgccctctgaggaccacaagcaaagtagctcagctcctgacctcctgctcccagcacaggtgagatgcacctcagctacatctgtgaagcccaggagactttctctccctcctcaggctccctggagtgatgacccaggactcatgcctctgcacatttatcctttccctcagagtttggggccttatcagtcctgttacatcttctcagcatctgaaaccactggagaggtggtcaccatctcctgtgctgacacagcagtgacattgggggttataattctgtctcttggtaacaaaagcaacagggaagagccccatatgactgaggggtgagatcaggaaaaagcctcagagattccagttctaatctcaggccgttctttgtattcttttatgagctagttagtcagctggtcagtcagctgtggccacaagaagaaatggaagagaggttcagaaaacagccctagagaccatagacccagagctctagagacagcaggcccaatgtgctacacagggccacagggaaaggcatcaggttcattagaagacagaagacaggagggcaggggatcccttagaccatgacttttatcagaatttcctcaggaaaagcagggcaagctaaaaaatttatgattggccagcctgaataatgtcagcaggctttgggctactaaggtggtctctagctgcttggtacctggccctgggacgataaaggcagaggaatattgtatcctgggatgcacaaaccagacaggggtggtgaggctctgaacacgttagtttccatatgaaaggcaggcttctggctgagcccattgctctttcaaggaatagagaactggggagacccaggaggggtggtcttttcccagacagaaatgttttttaagatgtcaaaatatcaaaatatatagaaaattatatacagttgacccttgaataacattggtttgaactgcatgggtccattgattttcttctgcccctgtcacccctgagacagcaagatcaacccctcttcttgctcttcctcttcagctactcaacccgaatataaaaaagataaaatcctttatgacgattcagttccatttaatgactagtaaatatattttctcttccttatgatttttaaaataacattttctgttctctggcttacttcattataaaaaatactgtatataatatacataacatacacaatctgtgttaattgactgtctaagctaggcctggctctgaccctgatcctgggagacactttaggcagattactctggaaataagtccctcagtctctgaccatctctctctcctcggcgggttctctgtcctcccatgggagctcagtgcccatggtgcagacagcccctctcagctgctcaggaccaagtagggaagctctgctctgtcttggtacccgcagaacccaggctggtgcccatgctgggactttaatgtggtgacaaaactcctcatgcagtgctgattgattctctgacagtgtctaggaatgtaattcccctgaccaggggacaggttgaggatgagtttcaggggggatgacaacaagacttccaatgacacagccacagggagaattgagatgcacaatctgctgtccccagcctggatcacacgctccccctgcatttaggaaagttgcttagaattaggctgaagaggtcaggattcagttttaacattgacctctctctcattttctcttttactctcttttctccttctctcttcctctctctttctttctctttctctatgatactgaagcccttattcacccccattctcagctatgaaatggacatggaaccctgacatcgtgagtttcctcaaggatcacaggagtggagtaaagatctgagccctgtctccaggtgtcctcaagggtctacatcacaggctcctccatcctgctcttcccttacacaggggctcccctcagatcctgcccatgcctaaatttaggccccatttctttgagacctgtggacacttcatcctgaggttcctgagggtttttctccctgctgacgggagatcccactgatcacatggtctgcttgttgtttctcaatcctggagcacagctgcaagtgtcacctgagacacggccaatcccccatacaggacagcagtgaaggtggaagaatcccagagtgaccgggtaccgtcattcattcaaattccatggggctcttgctgcatcactgggtgtcatcctttgggaacctggacttctaaactataagactcagagttagaaaacagaatcataaattccccatgtaagccactacttccacccctggtcctggactcagatatgttactaatgaggaacacagttcctcatagtggctgctgattgaggacatggtgggcaaactgtggttgatggacacatctgtcttgcatcctgcattggaacacagtcttgctcatgtctttatgagtgacatgtggctgttttcatgctgcaatacaaggcttggttgtggtgacagagatcctatggtctgaaaatctgaaatactatactaaaggtcccatactgtatcatgtcttctacatgaattatctacaatagacaaatccatgcaggcagaaagaagatgagtggttgcccagaattggagaaggtgatgaaagaggagaggctgctcactgggtgcagaattttcttttgggtgatgaaaatgtaggagaactacacacacagctggtggctgcccaacaaagtgaaggtgctaagtgccactgcgttgtacattttgaagtgattaattctaggttatatgaattccacacaatacaaaactatgattttcagaaattgactgttataattgtgttattatatctacaactttatgatggcactaaaggaccatgagcagtcaatgcaaaggatccagacaatatttcaagggctcttccagagtaacaagacatgaaaaggcagctctggttctctcttgcctggcgtattttaccctcggagttttttgtttttttgtgttgttgttgttgttgttgttgttattgttgttgttgttgttacagagtctcgctctgtcgcccaggttggagtgcagtggcgcgatctcggctcactgcaagctctgcctcccgggttcacgccattctcctgcctcagcctcctgagtagctgggactacaggcgcccgccaccgcgcccggctaattttttgtatttttagtagagacggggtttcaccgtgttagccaggatggtctcgatctcctgacctcgtgatccgcccgcctcggcctcccaaagtgctgggattacaggcttgagccaccgcgcccagccaaccctcggagtttttatgagcaccgaagggtgcagggagctggaagctacccaccaggtgcctggctcactcatgtctgggtgcagcagctcccccaacaggcagctggcagaactgaaagggaagagctatatccttctgagcccccacaattgtggtgcaggattgttcccgacactcccatccagtctgcttgctcctgcacacttagaaatgatcattatttctgcccaggacctccctggtcttgctctcccctcttcctccccaggcgaccttgggaactttactcaccctctggcccttccctcctctgtccagtgttttccccacccactgtgatcagctcagatcagcgagtctgtgggacattagggatcagtcacccatgtgaggccctcgacggggtcccaggatggagcagtgtatgtccccacaaggctgcttattgcacaagtaatggaggaacaaaggggtgggtaagccccctcctgggcagcttcagaccctgctaaaataggaaacagcctggggcaggtctgaccccacttgtgtctctcctgcccccaccccagcagcagcgtcctggaggccataccatgtgctaagcagatgccaagatcacgtcattcatcatcacctggaaattcccctaaccacaccttaatacgctgcactcgtgcctcagctaaaagtatcacacactgcattgcaatgagtttggatcccagacccccttgatgtttgtcactgctctttcagatcctcgaaaacacctacccctccctgcaggtcagtgacagactcttcttcctcacacttcctttcactgtttcttccttcctgagagcagctccagagactcctcttcagggaggcgccccaacctctgattacacagcagtctgcctgtcattttctgtgtatgcattctattaatgatctgcagagcacctaaacttcatgcctcttttcctaacatgtttattaattgattttctggtgctaaatactcctacaatcaatcaaaaatgcttctcctctgcttggacactcatgagaaacagtcatgaaccatttgctattttatcctcaaaaagtaagtgtggagttcactgctgttccccacatactcaccaaataatgagaaacccagcaattacccaactttctgctccaccatcatgacacagtaggcttttctttcatttgtgtggacttaagacctcaggatggctgctgcagctccagctattatacccatattcaagagcaaaggtgctgcacgaaaacagtctgtttatttccatcacaagagaaaatgttccctgagaagatctccaaccacctgacccttacagccctggggccagcatgggaccatgtggtcagtccaagccaagagtgaccagggaaaacaaggatctttttgtaaataaatagaggagaaaatacacaggtagaagatggtgcttctactacaaactgtttctattacacagccccaacccccatgtaggaaactcctggggtcagagacagtctttctcgtgctgaattcccaggatggaatattgccggatcagagtgggtctcaataaatactggctgggtggatatgctcctgcctttgtttttggggcaggagccaccactgcctcatgtttttctacacctggagccatgaaacttggtgtctgaggtctgcggcactatatgcagagccttggtaagatgcactggaccacttaccaacccagtgacagtagagggatgtcttaggtgggccctacccattttcctccaataggacgtgctcataatttcatgggtaaccgagccccttatgcctggtattgaggcatataaggccaaataaagaagaggaattcctctcttggaaccagcagtccatggacaagggaatcagggacctgagcagcaggttctgaatccacacctgatctggggcaggacccagaacctatcaaagtcttctgctgttaactatagaatgggctcacaaaatgcagacagaatgatctgtgaactccacctggcctggctagctgagaaccaaggccaagacatagtttaaggtaaagatgttggcccagactttgggaccagcaagtgaaggagaattctgtgggctgaggtgggtctgtagggtcctcccctcccctctctgtgtcccttggggctgagcccttctctggaaactacaaagctactccagtagcagcccctgattctgctgacttgcatcacgggccgctttctccatcaaggggataagagaggcctgggagaaacctacccgccctgggccacaggaagcagcatcagggatgtctcagtcatggactggacctttctcagcctcctcgctcactgcacaggtgctgccgccagagtcccagccacccgcccagccccgggctgtgggaccaggctggccttgattgtgagctcagcagggctctgcctgtggtggaaaggatgctcatgaccttgctgcagggtgaggggctggtaaggttgaaatcttcctgtactcctgtgctcatgggcactctgaggggcacagtcaggctccctttcatcccagaagctctgtcccagccaggcaggtgcaaaggaatcctgaggatcagctcctcagcttcaagccttttctccctcatctcctgcaggtttcatggccacatatgagctgtctcagccaccctcagtgtcagtggccccattacagatggccaggatcacctgctgtggaaatactgttggaggtggatatgtttattggtaccagcagaagtcaggccagacccctgtgccggtcatctataaagacagcaagtggccctcaaggacccctgagtgattctctggctccaacttgtggaacacagccactctgaccattagtggggcccaggccagggacgaggctattactgtagcacctatgatggctgagggagcagcaggcagtggctcacagtgaaacagacagatggggatgtgggacaggaacctctaatataactaggctcaatatctcacatcctctctaagccaggatgtccaacattttggcttctctgggccacattggaagaagaaaaattgtcttgggccacacataaatacattaacactaacaatagctgatgagcttaaaaaattgcaaaaaaatctcataaagttttaagaaagtttacaaatttatgtagggccacgttcaaagccatcctaggctgcatgtggcctgcaggctgcaggctggacaagcttgctctaagcagtgaccatgactttggtctcagttcactcaggtggtttctcatggtagccaaagcagcaggagaaactgtcggatttctatttaaccatgaattttacaattacattcattgtaaatccaaacatcttgtccctttattacctgggccctacagagactagtgcacaggttcatgggataagaaatgtctccagagagcttggtttctgcactagagacagtcgtttccctccctttcaacacagagtgtggcaggaaaggaaccagttctctgagctaaccctgagaacttgggcttgagaaaaagaaagcattttgaaccagtaggattgtgcccacagaatgagatgtgctactctggcccagcccaactcctttcatttcaggagctctgtctgggccaggcaggtgcaatggaatcctagggatcagctcctcagtttcaagccttttcttctctgggtgtctgagaacaggagttgtcttgcacgtgcacatgagaaagaagtgcacacacgactctcaggtgtgagcagcaaagacagaacaaacctttccagaaggggcaaatttcattaagatgacagggccttgttacacaaccccacatgtctggactgggatctcctattggatcttgccataaatgcaaggtttcttctcccatcataaattcctgcattgcagtagacccagctgggttctagggctcaaccagcagggcactcccaccactgtgtggacctgctgcagagccttcctgctctaggacccacagacatgcaacttttctttgtttttgctatttgggttggagcaacatcccaagagtgaataatgcttcttccagaatccatcatgaccatatatacttcttgatgcgaagttaggatgtaataatgtgtcctttttttctatgggaggtgctcagctgttccaaacaagaagaccctaaacatttctgctcatatgaaggatgactccctaggtttgctttcctattctctgaatgcatgggtctccccaaatcttccaatgacctttcactgcatgcacatctcatccaaataccaccacatggtggatgcttgggcatggtagcgggtgcctgtaatcccagctacttgggaggctgagacaggagaatcacttgaacccaggaggcaaaggttgcagtaagccaagattgcaccactgcactccagcctgggtgacagagcaagacttggtctcaaaaaaaaaaaaaaaaaaaaaaagaaagaaaagtttatatttttgttctaatggttatcttaatatcttcattctataattatatgttttatataattataatagctatataagatataatacccctagtatgttgttttttggatattctacttgctcctgatggttaatttatgtgtcaacttggctaagctatggtgtcccgttgtttggtcaaatacttgtcaatatcttgctgggaggttatttcatagatgtgattaacactgacagtcaattgactttaagtaaaacagatcacccaccataatatgggtgggccacctccaatcagttgaaggccttaagaacaaaaactgaggtttcccagagaagcaggaattctgcttcaagactgtaacacacaaaccctgcctgagtttctggcctgctgactgctctacagattttaggttccagacttcgagatcaactcttacctgaatttatagcctgctggtttgccctacagattttaaacttgctagtccccacaattatgtaagccaattcctaaataaatctctctatgtataacctattggtttagcttctctgaaaagctttcacatccagtttcctggatgttaagaattactgaaactagctagtaacttactttttttttttttttttttgagacagagttttggtcttgttgcccaggctggaatgcaatggcacaatctcagctcacctcaacctccacttcctgggtccaagcaattctcttccctcagcctcctgagtagctgggattacaggcatatgccaccatgcttggctaatttttgtatttttagtagagacacggcttctccatgttggtcaggctggtcttgaactcccaacctcaggtgatccgccgccttggcctcacaaagtgcctcacatgagccaccacgcctggctcctagtaaattcttcttttccgtgatgtgtctcttacctctaataatacttttcttcttaaagtctacttcattaaaaatagttatgctgggcatggtggctcatggctgtaatctcggcactttgttggaggtcgaggtgggtggatcactgaagcccaggagttcaagaccagcctgggcaacatggcgagaccctgcctctacaaaaaatacaaaaattagctgggtgtggctaatataattctaagttggcacacttgtagtcccagctacttgggatgctgaggtgggagaatcgcttgagcctagaagggagagattgctgtaagccaagatcacatcattgcactccagcctgggagacagtgaggctctatctccaaaaaaaaaaaaaaaaaaaaaaaaagttatacagctttcttggttagtacatgcatgacatatttttcattattttctacctctctgtatccttatataaaaggcattagttgggttttactttattttcaattattttaatttttattgtccttttaaatgtaactaatgatttatttacgttgaaacccaccaccaatttgttttccatgcctattctatttcttcttatctcctctcacatcttgttttggatttattatttttattatttaatttcctccttctctattagtttcataactgtgcagtcttagagttattttaaaagatgacagtggattattttagagcttacaacatgcatccttcacttatcaaagcctaacatgagctagtactttttgttgtggttgagacagagagagtcttcctctgctgcccaggctggagtgcagtggagcaatcttggttcactgcaacctccacttcttgggttcaagcaattctcctgcttcagtcacctgagtagctgggaccacaggtgtgcaccactatgcccggctaatttttgtattcttttttagtagagacagggtttcaccatgttggccaggctggtcttgaactcctgaccttaagagatctgcttacctcggcgtcctaaagtgttgggattacaggcgtgagccaccacgcccagcctatgagttagtacttctatcctcttcctagtcagtagaagaaccttggaacaggaactaaatttacccccagtgacttatatgctaatatttttgtgtattttaaacatatgtgtgtgcatagatgtatctgtgtgttttttgtgtttttattcttatttatgttgagagtgtagagctatgtaagagtaaagagaattgtgtaatgaagccccgagtatccattcaatttcaacaacaatcttatggccaagctcatttcatgtatactctttcctgcttccctctaccccacattatttcagtgcaaatcccagatatataactgtacccatacatatttcagtatgttttatttattttaaaccccacaagatatcattttctatactactgtaatttcataccaataacattcatttagatttacccacacatctacctcttctgttaccctttatttttatttataaaaatatctttgggaaaaaatatccttcagcacatggtcaaggatctcctgagggctatgtcatggacaaaatatacatatatattccatatatatacacacatatacacacacacatatatacacatacacacacacacacacacacacacacacacacacacatatatattccactttcacttttttgtttgttttttgagaccgagtcttgctctgtggcccaggctggagtgcagtggtgggatctcagctcactgcaacttctacctcctgggttcaggtgattctcccgtctcagcctcctgagtagctgggattacaggtgttagccatcacgtctggctaatttttgtttgtttgtttgtttttgagacggagtatcactctgttgcccaggctggagtgcagtggcatgatctcggctcactgcaacctccatctccctggttcaagcaattcccctgcctcagccttccaaggagctgggattacaggtgcatgccaccatgcctggataatttttttgtatttgtagtagagaccgggtttccctatgatggtcagactagtcttgaacttctgacttcaggcaatccgcccacctcggcctctcaaagtgctgggattataggcatgagccaccgtgactggcctgttttttttttttttgagatggagttttgctctgtcaccctggctggagtgcagtggcaagatcttggctcactgcaacctccacctctcgggttcaagcaattcttgtgcctcagcctcctgagtagctgggattacaggcatccaccaccacatctggctaatttgtgtatttttggtagagatggggtttcaccatgttggccaggctggtctcgaacttctgacctcaggtgatccacctgcctcggccttccaaagtgctgggattacagggaggagccaccatgcccagccattttcacttttgaaggatattgttagtgagcatagaattctaggttggcagatattttctttcctcagtttgaaaacatgattccttgtatctgatttctcctgcttttattgggaagccaattctcaatctaattttgctcatttgaaggcaatggctttttatgttgttgtgttttctgagatggagtcttactctgtcgcccaggctggagtgcagtagtgcaatctcagctcactgcaacctctgcctcctgggttcaagtgattcttctgcctcagcctcccaagtagctgggattacaggtgtccaccatcacacctggctaattgttgtatttttaatagagatgaacttttgccatgttggtcaggctgatcccaaactcctcatttcaggtgatccgcccgcctcagcctcccaaatgctgggattacaggcatgagccagcccccaaccctggcctgaaggcagtatcttttttcctctggctgctttgaaaagttttgtctttgttttgagcagtttacactgatgcattgaggtggctcttcattccatgacttgattcttttttgtccattttagaaaattgtcagctttatctcttcaagtattacgtcttccccatcctctctctactctccttatgagactccaatttcacatgacttatgccttgttaaagtatcccccatgtctcttaatccattcctgtatgttctatctatttttctctttgtacttcaatttgtatagtttgtatcaaactatctcccaattagccgggcgtggtggtgggtgcctgtaatcccagctacttgggaggctgaggcaggagaattgcttgaacccgggatgtggaagttgtagtgagccgagatcatgccactgcactctagcctgggcaacagagtgagaccctgtctcaataaataaataaatacatacatacatacatacatacatacatacatacatacataccagttcactattttttttatgtttgtgtctagtgtgctgttcaaattgagttcctaattccattttttttgagacttttttttttttgagtctctatctgttgcccaggctggagttcagtggtgcaatctcaactcactgtagcctccatctcccaggttcaagggattctcatgcctcagcctctcgagtaactgggattaccaccatgcctaactcatttttgtatttttagtagagatggggttctgccatgttggccaggctggtcttgaactcctggcctcatgtgattggcctacctctgtctcccaaagtgctgggattataggcctaagccaccactcccagcctccatttttttttttttttttttttttgagacggagtctcgctctgtcgcccaggctggagtagagtggtgcgatctcggctcactgcaacctccccctcccagttcaagtgattctcctgcctcagcctcccgagtagctgggactacaggagcatgccaccatgcctggctaatttttgtaattttagtagagatggggtttcaccatattggtcaggctggtcttgaacttctgacctcaggtgatccacccacctcagcctcccatagtgctgggattacaggcatgagtcaccacacctagtgcatccattttttgtagctgccagttttctgatgaaattcttaattatttctttatatccttgatacacatgtaaagaatttattttaaagtacatggtctgatgattttatattctggagatcctatgggcctttttcaaagttgtctgtgctttctcttgagttttgttcctgctgtcttatttccttgtttgcttggttgtttttaatttggcaatggaagttgtgtataaaaattgttacaaataattttttttttttgagatggagtctcgctttgttgcccaagctggagtgcaatgatgtgatctcggctcactgcaacctctgcatcccagggttcaattctcctacctcagcctcccaagtagctgggattgcaggcaggtgccagcacgcctggctaatttttgtatttttagtagagatgggttttcaccatgttggtcaggctggtctcagactcctgacctcgtgatctgcccacctcagcctcccaaagtgctgggattacaggcgtgagccactgcgcccagccagaaataatttttaaaaataatttcgagcccaagcatgatggctcatgcttgtaatcccatcactttgggaggctgaggcaggcagattgcttgagcctaggagttcaagatcagcctgcgcaacatggtgaaaccccatctctacaaaaaataaaaaattagctgggtgtggtggtggtgtgtgcctgtagtcccagctgtttgggacgctgaggtgggaggctcacttgagcctgggtgatcgaggctgcagtgagccatgatcctgagactgtactccagcctgggcaacagagtgagatgctgtctcaaataaataaataaataaaaataaaataatttgaggcctagggctctgaaattctgagatctcctttatgcatttgagtgactgagatgatctgaagctggatccagtgctcctgagggctgctttatttctggttgactgtgactcctagagtaagaaacctgcaccccatgtgtggggtattatggcatcccctccctcagccacatgagtaagtcaacagcactgctctagaccaggtgtggtggctcacgcctatagtcccagctactcgggagactgaggcaggaggattgcttcaggccaggaatttgaaaccagccagagcaatatattattaggttggtacaaaagtaattgcggtttttgcctttaaaagtaatggcaaccctgtttcagcaaagtaaaaagcaaaaaaaaaaaaaaaaaaaggaaggaagaattaaaaaaagaatcagctgggcgtggtggctcacgcctctaatcccagcactttgggaggccaaggcgggcagatcatgagatcaggagatcgagaccatcctggctaacacggtgaaaccccatttctactaaaaatacaaaaaattagccgggcgtggtggcaggcgcctgtagtcccagctactcaggaggtggaggcaggagaatggcatgaacccaggaggtggaggttgcagtgagccgagatcatgccactgcactccagcctgggtgacagagtgagactccgtctcaaaaaaaaaaaaaagaatcactgctctgtctctcagcctcctcttccaggattggccgtcgccttgaggggaatgctggccttgcctgtctccagccctgtacctctctgcctcctatgcctttaagcacatgttttctatttgctgggctgtgaaatctgctcttcatctgatggggtttgctttataggtgactagattcttttctcttggtggttttagatttcgcattttcacattgaccttaaatagtctgattatagtttgccacggcaaagaccctttgcattgcattgtttggggatatttgagcctcctctatctggatgtctaatctcttgttagatgtgagtagttttcattattattttattaatgggctggcatgtgggccttggttccaggcgggctcagaggggcagctgcctgatgtctgggcagcttctctttctgtcttttcttacctggactctgggttgcttgttagctgcttctgccagttctgagttttcaaggggagaggggcccagtgatggctgttctttgaaggaaagggaagaatgtctcctgtttaacatgtttctatgtttccagttacttggttagttagttagagccagggtctctcgctctgttgcgcaggctggagtgcaatggcatgatcgtggctcacagcagcctccaccttccaggctcgagcaatgctcccacctcagcctctcaagcagctgggactgcaggtatgtgccaccatgcttggctgcctttttaaattttttttttttaatacagacaaggtctcactatattgcccaggctggtcttaaactcatgggctcaagtgatcctcctgcctcggcctttcaaagtgctgatatcacaggcagggtttccattttttaaagctcccagcagtggtataaactcctcctttccagagaaagcgcactctgtccgcatccctcatgttgtcctctcctgcctctgcttagggttcactccgggggaaagtgccacttgagagtttcctttttatgtgtggttctgactgaccgctccctgctcacagatgctgcttctcagggtggggtccctgaggcctggagtgtggcctctgacgaccttcagggccaggtgcggaatgagagcctgtggccacatggcccccggtgggagacgtcccgccgccctttgcttctctgtgccactctggctgcacagttcagagccttgggaaacgttaaccagtaggacctagaaggggaggtgagaaggggtcaccccccaggtgtgcctgtggtgagccttcgtgctgagcaggtgcagggagggaggcccaggtgcacacacctgtgaagtaggggcagctggctgggctccttgacctgctccagagcttcttattttctggccacttcacctgcagaaggcccaggtggctgtagccgctagggtcccttgcagtggaaatgatgcctgtcctcagcccctctctaggcctggcgctgtgctcagcaccgtcgtgtgtgtgtatgtatatgtgcacgcatgtgaatgtgtgcagacatcatgaggtgtggtccctgctgttaggcagcttgccttgtggctgaagtgaaccatcacctgaatcaagggatggaaacacaaggccagatgcagtggccttctatggagtcagacggtggctccgtgacctggcttcactccagaactacctggggtttctagctgtgcaaatcccaggtcccactcagattatgagtccagttctctgcaggtggaacccaggaaggtgtatttttaacaagatggtactgctcattcacccagcccagccagtggtcttggcatacccaggaaccgctgacatagagcttgtgctccccataaagtgggaaacagagcgttcctgggtgggggacatgtggcttggtcatgacagtcagggtgttacataccaggacagactgtgttcgggtgacattaaggacaagctcctgcaggctagctgcctggatagtgctggctgggggtagaagttagaggggtcacagaggggcttcctcccggccccctcatcagctgcttgatttagggcttggttctgggtccttctgggcctgattctgaaccatgggactggtgtggcctgcaggctcctcccgccacaagctgttcatggtgcagggggagaacagtgtccacaattccccagacagcagctgtggatgccaggcccccaggagttgttactgaagttgctgctggacagctcgcctttcactgagctccacatagcacccgtggtgatgggagccggatggagagagcctgccagcctgcacatcagctcccaactgggcggggcagagggaggagggggtggggaccccaggcagcagggctctgggagcagtggggccctgggttccaggggtgtctggcaggcccctccttactctacgtctctcagcctctggatggaggtgctggccgcagtcgggctctgcctctgactaagggttggggaagtggcgggtgtgggctgctgccccgtggggcctctgaacagaccccagggcctctgccaatcatgactccttcctttcagctggacccacaggccctgcaggacagagactggcagcgcgccgtcatcgccatgaatggggtacgtgtccgtgggactctcctggcgcccacttcccccagaaggatagggtggcctctgttcatttcaaatcagtcagaggtggctgagcctgaggcagcatctgagagggagcctggttggagaagggagggcccccaagagcagaatcaccatgcacgggaatcgtcattcattggctggaatgcagttgccagccaggccctgagcatccctcctcaaacaaaggtctcatggcaccaccaggacaggtggggcctccactcagggacctgggggctgcccatagaaatggagacccctgatttgtctttaggtaccccagaaaggtttaggccttaaaagcaatgacacacccaaaaaggcccgggtataaatggtaaaatgttaatatttgagattcttggctttttcttacattattctgtctttcctacttaatttttaattgttactaagagaaagctggtcacagtacactataatctcagctactctggaggctgaaccaggagaatcactggagcccaagagtttgattacagcctgggcaacattgcaagatcccatatcttaaaaaaaagtaagcaagcaagagaagcagcggggattttaggaggtgcttctgcagaaaccagtcgtttacatcatcttcaacaatcctggctcttgctgaagtagactaggggcttccccgaggggcggctccacctcatgctgagacctctgcatgccttgggggtggaaatatttgatgagactcccaggggtccttgggaccttgggctatgaggaccagaaggattagaggactgtgccccttctccccactgtagatcgaagtaaagctctcggtcaagttcaacagcaggaagttcagcttgaagaggatgccgtcccgaaaacagacaggggtcttcggagtcaagattgctgtggtcaccaagtgagtggggaggggcttgggctcacgcactgagggtgcctgtcccttcagctgtttctgcagaaaagagcatgtgtgggtctctcctctctgtgcgtggccactgcacggtgaggtcaggccccagggaacacggcgtcttcagctacctcctgtgtttcctgcaaaccagctcaggaatgtccttgccaccttgcttggaagcagtaggctggctccaggaactgcccaagtgcagggttttctgcccttgcttggaattagtcacggtcccagattcctgttgaatggttgtaacccctgcccctttgtcacgagtcagttgccaagagaagcctgtttgttggtttgagagcagttcatgcagacatagaccacttcctctgagaattcatttgcctccctaggatggaatctggctgggcctctgaccttgctggtcacgtgggccggggcctccatcagtcataccctggactcctatctgtgtctaaacaccacgccccacccccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagacgggggcacaggctgctaaccccaggcctggaatctgtcagatgcccttcccgtgctgacttgacttagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcacatagggagcaggtctcctgtgttatggcccaagcagggctgttaggacactgagaacattccctcctcccgcaggagagagaggtccaaggtgccctacatcgtgcgccagtgtgtggaggagatcgagcgccgaggcatggaggaggtgggcatctaccgcatgtctggggtggccacggacatccaggcactgaaggcaggcttcaacgtcagtgagtgtcggcctgcgcaggacgggatggaggtgtgggcagtggtgtccgcgatgagatctcagagtgctccatggcccaggcatgtcacatccttctctgtgtcttttcttcatttactgttttattattttaaaaaaagagaaaacaagagttgtacaaacagcttctatagaagccagtttttacaccatcgtacccactcatgccacttggtggagtggaccaggggcttctgtggggacttggccttcctgccttgggggtggacaggaggtggaagcccaggactcagtgcggtctgtccactgccctgtatgaggatgtggtgggcagagggcactgatgaaattcagcgcaggccggggctgcagcatctccgcctccatctcaccaaccctcacaggctttgaaggacccagactggcctcaaatgccaggggagggcactgagaccccagagggtccctcccagcatcttcaaagcaacaggattttgtgcctgcaggcccttctttgcagcacacaccacccaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccatgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagtgtggcagggacggtgctttagccaaggcagggatggcgggtgactcactcaggatcttcaaggaggccgctgcatttccatgctctttccagataacaaggacgtgtcggtgatgatgagcgagatggacgtgaacgccatcgcaggcatgctgaagctgtacttccgtgagctgcccgagccccttttcactgacgagttctaccccaacttcacagagggcatcggtgagcactggaggccttggcctcgtgggagatgtctcccccatgtgcactgctgccctcggaggctgtgaaaagcgaggtgtgggaacctgagttgtaacccctctgccatggtcggcattttaacccaacctcaaaaagcaggggaccagaaccgagcctgtcctggaaggccttgcccatccccagagggctccccatccctattcctcaaggaggccaagtgggtgaaatggtcagcactgccgtgctgtggggtcctaaagtctgctgtcctccttcctgcagaccagggctaaacactggtgcccaggtgctcttgccatgggtcctggtccagccaagcatggtttcaaacatgacctgacccttagtcaacctggaggctgatgtctagagtgggcgctggagcgtgcagcacctgtggcctctgcatcacccttagggcaggtctgcctcccgggcccatgcacagaggacctggtctcccagcctgcaggtgcccctgtggtgtccaggacgacgagggggtctctgcgtacttggtggggctgggaccctcccacttcccacctccttgtgtccctcactccgctgtttcattccatgctgagcctcccctgccttgggctccctggggagggggtggtggcaggagttgcccaagggctgctctgcccatgagcagctgctctagcggctcctcctgctgctgttcgccaggtgctgctgacccctgcgaggtagagaaaaggcgttcaggtggttcacaccccacacaggtgcccctcacagggtcctcactggcggccagcgctgtgggtgtgacgatgatgacaagcctaaactgcgcaaggactcgtgtcccgggcgctccatgtgaccacctcgggagaggtctccggcttgtcgtaacccaggggagtgacccactgcctcctgcagctctttcagacccagttgcaaagaagagctgcatgctcaacctgctgtcgtccctgccggaggccaacctgctcaccttccttttccttctagaccacctggaaaggtagcccagctctcttgtggctgcccaggactccaggtctccaggccgttggggtgcccctctgctcccaccagacccccagcaccaaggaccttttcccccgacccctgtctgcagtaactcactgcttctaaggactagcaccactgccacccctgcccctgcctctcctctttgccacccgcctccctctgcactgtggccttaacaaagagctcagagctttggccgtggccagcagtgcatttggaccgcccccacttccctcccaagcacatcatgaagacctccccatcagcccagagctggccccttgtcccgggccactgagacccagaagtaccaaggctggagtcagcttgcagcacagccagggtcgaggtcactccctccctgaggactctagcatggcacagcccctctgcctctctcctggtggtggcgttgaaacagcaccctctgcttcggtcctctacagggtggcagagaaggaggcagtcaataagatgtccctgcacaaccttggcacggtgtttggccccacgctgctctggccctccgagaaggagagcaagctccctgccaaccccagccagcccatcaccatgactgacagcaggtccttggaggtcatgtcccaggtatgggaagacagcctccagcccatgcaaccccagcctgacagaggtggcctctgcctgccccacccccagtcctgcccatcttcccacttgcattgtatgtggtggtggctgagattcagagagagggacttgcctaggtttgcatggatgggagtgatagggggtgcccaggccacctcctggtcctgctggtgcatcttgctgggggcttaaaaccaccccaagtgttcgggtgtggtggctcatgcctgtaatcccagcactttgggaggccaaggcaggacaaccgaacccaggtgtttgagatcagtctgggcaatgcagcaaaccccatctccagaaaaaatagaaagaaaaattagtcaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttgggggcttgggccccaaagacctccccaccagcagctgtgagcccccctctgagccactctcctcttccccactctgcgagggcaggtcgaggtgctgctgtacttcttgcggctggaggccatccctgccctggacagcaagagacagagcatcctgttctccaccgatgtctaaaggtcccagtccatctcctggaggcggacagatggcctggaaacctctggctaatcgggccatctgtagagtgggaatcaagattttctgaggcatccttgggccacccccaggtgtcaggccatctgccaagagacagtggcccaaagcagaaggacaggtggcctgggcagatcccgcccaggtctgaaagccccaggctggcctcagactgtgggttttttatgtggccacccgagggcgccccaagccagttcatcttggagtccaggcctggccctgggagacagggtgaaagcagtggtttttatgaacttaacttatagagtctaaaagatttctactgaatcacttgtcaagaagcgccctctctggggagaagggaacgtgaccggattccctcactgttgtatcttgaataaatgctgctgcttcatcctgtgggggccgtggccctgtccctgtgtgggtggggcctcttccatttccctgacttagaaaccacactccacttagaacagggtttgagaggcttagtcagcactgggtagcgttttgactccattcttggcttgcttctttttctttccagaaggatttttgtgcagaaatgggtcttttgttgccgtgttagtcctccttggaaagcagctcagaaggcccgtgaaatgtcgggggacaggacccccagggagggaatcccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggtagcagcttgctgatgacttgttttaaaactttcatcctaaataaccttttgatgcttgaatatttttaagttttatacatagtttctaatttttttcccagcagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacagctgcgggggagcccaggcattctttgtaagccctcctgactacctgactcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctccccagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgaacccgcagctcactggggagcctgacagtggggccatgcgcctgacactcctctctgcttgtggacctggcaaggcagggagcagaaaacagagccccttgaaggcttcctgtctgcgtctgtgtgcagtgtggatttagttgtgctttttacttgctgggagagcacagccaccatttacaagcagtgtcaccctcgtgggtggcgaggacagaacaggagcctctgctctctgtacctatctgggcccggtgggctcccttgtcctggcttccatctctgtctcagcgaccattcagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcaaaggcctagatgccagtgtgacctcccacaaggcgtggcttccagactccccggccggaagtgatccttttttgccgcgggccctgagtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaaccccactgagtggggtagtctggttggggcagggaccgctgttgctttggcagagagagatgatccccactggggagaggctgttctgactctgcaggtgggacagggacagatggccaccagggtgacccggctggtcttcctttgctatgctaagccctgggacgtggaggattcctgccacacagcctgggcccggtttcttacctgtggccaccgctctggcacgagcccctcagtcttgggtggtttctgcctggtccgggatttggtgttcctgctgagtccagcctttctgccacctccgcatgggccgtgggtggtgttgtcagctgcctcccaccttggcttcagtagctcacccagctcacaggggagctgccctgggctggagatgggcatgcaccctgggtcctacttgaatgaatgcagcttgaggagagccggccatatacactgggccacaggttaccctcggcaatgcccacatcagccgtcagcctgagcctccccaggagagcaaggctcacacgacaaaggctgcccgtggccaatgaggtggctgagcccagccaggacctttctcggactcccgggatgtggctctgctcgtgagctgcctggtcagctctctcggggtgagaggggcttgtcacacgggcccctgcctgcagtgtgacccttctcagcttctctcagcagccctgcctgcggagtgtcaccgccaccatgatcatttccctgacactgcgagggtgtggggacgtcctgggtagagacagggcccgtggcagcagcaggctcaggggcgccctacactggtgggctggggacctggtggagaccacgccaagggctggacaaggggacgagcctccaccctggcctctccgcaggcctcagcagcccctcccacaggcagaagggttgacactgggttctgccctcactgcaagagctgcaagtgccacgtgctgttctgcccaatctggtgtctgcaggtgaggaaagggctgccgctggcccgtttctgagtgttcagcacctaaggatgacagcactgtctgtccctaccctccgggtcctgtttgaaaatcaaacccatgctcacaggccaatttttttttcttttagagacagggtctcactttgtcacccaagctggagtgcagtggtgcgattatagctcaatgcagcctccaattcccggactcaagggaccttcctgcctcagcctgccaagtagcttggactatagctgtgtgttttcttattattttgtagacatggggtctggctatgttgtccaggctattctcaaaattcccggcctcaagcaatcctcccgcctcggcctctcaaaggttgggattacaggtgtgaggcaaggcacccagctcagccacagagccctattgcatctctcttactaggagcaagagctgactgccccctcatccccattccagagtgttggggctgtgttcagccgaggccgggccactggcatggcccagggagcgggatcattcactgctgccccaaatctgagatcattccaccttgacaagacttcctcatccaatccctttacttgacagctggggaaaccaatgcgcacagagcacccccagctcactcggggtctcagagctgatccatgagcggaggctgagatcctgggatcttgtcccccagcctccctgcaaccttaatcccgttctgctgaaagagatggggccggacctcgaccagcagccctggcctggacatgactgtgctcatgcaggtattgaggccgagatgccccggcatcatatgtttttctattttcttttttttttttttgagacggtgtctcactctgtcacccaagctggagtgcagtggcatgatattggctcactgcaacctctgcctcccggttaaagtgattctcctgcctcagccttccaagtagctgggcctacaggcttgtaccaccacacctgactaatttgtgcatttttactagagacggggtttccccatgttggccaggctcgtgtcgaactcctgacctcaagtgatccacctgccttggcctcccaaagtgccaggattacaggcatgagccatggcgtcacttaaatgtagtgagaggccgggcacagtggctcatgcctgtaatcccagtactttgagaggacgaggctgtcagatcacctaaggtcaggagttcgagaccagcctggccaacatggtgaaaccgtgtctctaaaaaaaaatagaaaaaaatagccctgcatggtggtgagtacctgtagtcccagttactcaggaggctgaggcatgagaatcgcttaaacctcggaggcggaggctgcagtgagctgagatggcgccactgcactccagcctgggtgacagagcaagactttgtctctaaataattaaataaataaatatggctgagcatggtgccttaggcctgtaatcccaacactttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcacttgaaactggaagtcagaggttgcagggagccgagattgcaccactgcactctagcctgggcgatggagaaagactccatctcaaataaataaattaataaatacagagcaagattccatcttaaataaataaataaataaacatacacctgtaatcctagcagttcgggaggctaagacaggtcgatcacctgaggtcaggagttcgagaccagcctgaccaatatggcaaaactccatctctactaaaaatacaaaaattagccaggcgttttgatgtgtgcctgtagtcccagctacttgggaggctgagacaggagaattgcttgaacccaagaggtggaggttgcagtgagccgagatctcggctgcacttcagcctgggtgacagagtgagactgtctcaaaaggaataaaaaaaatacaaaataaaaaaaatgtagtaagatggcagagtcgtgccgcggaagcgtgctggtcctatccatgtagtgaaggctgatttcatacagaaatgtcacaagaactttttttctttttctttttttttgagacggagtctcgctctgtcacccaggctggagtgcagtggcgcgatctcagctcactgcaagctctgcctcccgggtttatgccgttctcctgcctcagcctcccaagtagctgggactacaggcctgtgcagcagatgcaggggggccactaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggcctggtcctcaacctgcagtgcactgttgatgcactggaatgccgcctccttctcccagtccaggtcttcagcagtgacccggtaccccagctctaagggaggtggcagcatcaaaggctcccctcgcctgcgtggcagcaggggaaacttgcatctacggggcctagaggcctgggatatgggggagccacccctgggagcgagtgtctgccctggtgctgtatctgccgtcttttcacactgggtgtgacccgaagagacagcctgaggtccgtcctcactcactgtgtttgaggaactgagggtcagctggcagtgggatgaggctggcccctcttccactttcgttccgggaggcctcccgtagagctgtaggggctcgagatggcatttcatttggggcacgagctggtccgggaggtctgcgatctctggttctgacctctgggcacctgctgcagctgtggctgaggcccagaaatgtgaagggcctccatccactccagtagtgaccccaacgtggggttcaatgcggaggggggaggggctgctgcggcagctgcaggagcagaagtgccacgccttgttcttctcatgcccgcatccatgcttgcagctgggaagggggcaggaatcagcgaggtgacctgggctgagtcctgggaatgggaagaggtggcaggaaggggatctgaggaggagaacagggggcctggtggtctgtgcttcttcccagacatgggagctgtagaggggacctctgcagcagatgctaagggggccagtaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggccttgtcctcaacttgcagtgcactgttgatgcgctggaatgccgcctccttctcccggtcaaggtcttcaacagtgacccggtaccccagctctaagggaggtggcagcatcaaaggctcccctcgcctgcatggcagcaggggaaacttgtgtgtactgggcctagaggcctcggatgtggaggagtcattcctgagggtgagtgtctgccctggtgctatatctgctgccttttcacactgggtgtgacctgaagagacagcctgaggcctgtcctcactcactgtctttgaggaactgagggtcagctggcagtgggatgaggctggccccctcctccgctttagccccggcaagcctcccgtggagctgtaggagctggagatggcatttcggttggtgcaggagctcgtccaggaggtctgggatgtctggttatatctgatttctgacctctgggcatggaggtctgtctgcagaggcccgggcccgggcacaaagggagagaggcctccattgtcccgcaggggccgaaatgcagacggtgcatccccggtgacctccgggacccttctctgatcaccaggattctcttggactctagggtccttgtcctgctcaggcatccctgccccgctctccttgagggccctcaacactatcttccctggacacaagtctggggacagccgggtgttgtggaccccaaaggggtgactcccggctcctgggccccacagagagtccatgttctcagtgcagtggctgagctggaggacgccctggaactcggagcacacagcactggcttgctgtggtacctgtgcaatcaaattgaaggcaggatcccaggaaggaacgcagcgcttgcaggatcaccgaaaaccttcttagagttgtcttgacaccactgatgtcaagtgtctgggtacttgtaggatggcctgccactcagtgcacgggcaggagcaacggggagatcccacaggcaaagtgaactgggggatgggctgaacgggctccaggcaactgagccctactggcaggtcctcggcctgggcccgaacaggaaggaggggcacagagtgcccaggtaaccgctcctgggagcagtggggaaccgtcggttgcttgaactctcgagagctgggctctgagcgtcctcgtccagccgccaactcggccaacggctaagccagcagtttcttctgttgccgggcaacgcgccttttaaacctgagggagcgggcgcgtgagcacatcacggcgcccgtgacagagccagcttaacggattaataagcgcagccaggtacccgcgcgaggcacttgctggcaatggcgggaggcggacgtggggggtcatgcaataggtactggaaggagagaggcgggcacaaaggtcgcgggaggaacaggtgcccacaatggcggcagatctgcccgtggatcactgaagattcctgctctcctgctgaggtggagattgcagtgagctgagatcgcaccattgcactccagcctgggcaacagagtcagactctctctttttttttttttttttttttttttgagatggagtctccctctgtcgcccaggctggattccagtggcctgatctctgggctcaccgcaagctccgcctaccgggttcacgccattctcctgcctcagcctctggagtagttgggactacaggcgcccgccaccacacccggctaattttttgtatttttagtagagacggggtttcaccgtgttagccaggatgatctccatctcctgacgtcatgatccgccctcccaaagtgctggcattacaggcctcggcctcccaaagtgctgggattacaggcgtgagccaccgcgcccggtgttgaaactcccttgaggcattttcttcggccttcgggtccatcctctgtctcctccttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctcttcaggtctgatgaagtatccaaaatcaagctcctgaccatcctcaaacctgccccttctgcagggtttacctcgctagtcggcgccatccttgattcttctctttctcccacccaggccatcatctcttgcctggttgatacccacagcctcccctttgggctttatccttatccccgtcatagctgccagagggaccctgtgaaaacactccccagcctgctcattcttctgccctaagcctgcatggcacagagcaaaagccagttgttatgggacctaggaggtcctgtgggatgggccccagcctgcatcttcatcctcttctccccaccccactccattcactctctgcctatcgctcaccagcctataccacctgcctcagggcctttgcactgaccatttaggcaacattccaggctcttttcacacgttgcctcctctgagaagccctccctgaccactctgcccatacctcatgcctcttgattccccttacctggcttgtggtttcagcactttccctgtgtgtgtttgtttttcttggcatgagggcaggacctaagtgtctgttccctgttgattccccagttccaggcatgcagtgcaaattctagaaatattttttgcatgaaggaatgagtgattgaatgcagcaagggtctggaggctgaggaccaggcagacagacattcagagttgctggaatgcgacagagacagggagtcagactggtcatgcaagatcctgggcctgcccttgggtcctggggagccacggaaggttgtgggtgccagagggttgtggtcagagccacagtcaggggccttctgagacctgtgtcccctccccaccctccctccccacctcctcaggccagctctggggtctcggcaggtggtccacaacatgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcaggtgctgtctgacctggctgggcggtagctttggctccaaggtccgctccccggtcagcgagatcctgttcaatgatgaaatggatgacttcagctctcccaacatcaccaacgagtttggggtgcccccctcacctgccaatttcatccagccaggtatggggtggaggtctggggatgggggactggggtggagaggggcgggtgtcctgggcaggcagctgacgggcatccctgtcttctcccatcggccacagggaagcagccgctctcgtcaatgtgcccgacgatcatggtgggccaggacggccaggtccggatggtggtgggagctgctgggggcacacagatcaccacagccactgcactgatatgtgtcaccccttttctccctggccgtgcccaccctgcacagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggtgggccgggggttggagaaactgagtcacggtgtggggccccagggcatcctgggctggaggcctggatcatcacagagtggacaattgttggtgtcctctctctagtgcctgggccatctggagcccctgtgccatgagggccaagccccctgctccagtgagacccagcaggccccaacctgctcttcctgatgacctggcccgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtctccccactctctgggcctcagtgtattgtgtgtgaaatggagccatctgactggggaggaacagagaggtgggattcggagatcttcacaatgcggacactggaactagcctcagcatcttcagcatggggagagccaggcacatggctgggggccaggggaaggttcacaccaagccctgcccctttccaccctgatccctcggactttggggccaggccctcccttactggggctgggcagtgacactacctaggatcagccaccagggggtgccacgaccctggcactttcttaggcagagggtggccagctgatgctgggaacccgggcgccttctcagacccgtaggcgtccagctcaccctgccgatgacactggaggtgaagctgaggtccgaggaatggggactgggcaacaggctggaggaaaacatctcggtcagagccacgcccctggggggtttccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccagaaggaaacagctagacacagcagccttcaccatccgcagcccctccaggcctccctcggggcctgctccctcctctgtgcacagttccaacacctggggcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacaggtttttatgcctgtggagtcaagtcccactgggtctgagctctgcagggctgtgtctctggggctctgcaggggtgagatggaggtgggctcaaatggtgtacaagtcactcctcaatccttattttatttatttaatttttttaaaaaaaatttaaaccaatagagatggggactcactatgttgaccaggctggtcttaactcctgacttcaagcagtccccccatctcagtctcccaaaatgctaaaattacaggggtgagccagtgcacccagcctcaatccttattttggcctgagaggaaaggccgtggccccatttgcaggggagaagactgaagctggaggggcaggccttgctctgggttgcacagcagcaagagaagtgggagctggccacgaggcttcctcgactcgacacactggtggggtacaccctggttctccaggtcccatggggctcagcccaggactacctcggggggtgaggtacttaaatcctctccttcattctcatcgccctttcccccatcatttcctgaggaagaacattcagggacctgaaggggtggcctgcccctccacatctgtgggtgtttctcatcaggtgggacaagagactgagaaaagaaagagacacagagacaaagtatagagaaagaaaagtgggcccaggggacctgcgctcagcatacggaggccccacgctggcaccagtctctgagttccctagtatttattgatcattatctctaccatctcagagagggggatgtggcaggacaatatggtaatagtggggagagggtcagcaggaaaacatgtgaacaaatgtctctgtgtcataaacaaggttaagaaaaaggtgctgtgctttgatgtgcatatacataaacatctcaatgcattaaagagcagtattgccaccagcatgtcccacctccagccctaaggcagttttctcctatctcagtagatggaatatacaattgggttttacaccgagacattcctttgcccagggacgatcaggagagagatgccttcctcttatctcaactgcaaagaggccttccttcctcttatactaatcctcctcagcacagaccctttacgggtgtcgggctgggggacggtcaggtctttcccttcccacgaggccatatttcagactgtcacatggagagaaaccttggacaatacctggctttcctaggcagaggtccctgcggccttctgcagtgttttgtgtccctgcttacttgagattagggagtggtgatgactcttaacaagcatgctgccttcaagcatttgtttaacaaagcacatcctgcacagccctgaatccattaaaccttgagtcgacacagtacatgtttctgtgagcacagggttggggctagggttacagattaacggcatctcaaggcaaaagaatttttcttactacacaacaaaatggagcctcttacgtctacttctttctacatagacacagtaacagtctgatatctctttcttttccccacagggaccttcctggctgtgcctcgggtcaggaccagaatgacacccattcatttccctgggcctttgctccggtggtccctgcaccctggcctctgcctgacgaggatggtggggagaggaggggggacgtcccccacactgctgtctccactgttcctgctgcccaggcctctgggcttccaggactacagcgggtgggtgggtgggctggcctgagcccaggaatgcacttcagttcctggttgagcaatgtcactgaggcttgggagtcgggtgggggcgggaggaggcgtccacaggccccccctaccgtgagaggcagccgtgggaacagcctacctctaaacaatcactgcagcccaggctgaccaggggctctggccggacataggggcctggcaggctgtgtgccctgtaaggacacagtctgtctctgtgcctcagtttctctgctgcccagatggaggggcccagactccaggtgtacacatctggagcaggcagtgttcagttggggaggaagcggggaggactgtgggggccatgtgggaaggattccaccccacatcacctgcacccctgctgagcctggtcaacggagcccctcagtgggtcctcactctcctggctgcctcccatttaggcaccctgaggcctggggagaacagagccaggccagtgtccctagagaggctgcgctgccagcacagtagtagcggatttggattcagggaagcagacctgcagccagggtgggaaagagctgcaggcggggtggagcccccacatggcacagcccccctccctggaggtccatgctgcatttccaggacagcaagtcccagggatggatggtgcctggtgccaagggctagaggcatggtctgtctgcattccctacaggggcatcttgtagtcaccagcatttgatgctgtcaagtccccctgtcctctgtgcagactgggaagcccttggtcaccctggggggtggggggacccaggccaggctgcagaagcataaggacttgaacccgggtcctgagtgacaccaccttgggtcctcctccctctgcctctgttcagctccaccttgatgctgactaggctgggccatgcggagagggttaggggatagagatgagagctggggagcagggctccactctgggaggggggcagccttgcgggatccagggcagagttaagcggccccagctccgctttcctagagctgctgagaacccgggaaatggtgtggaggttccggggagccctgcccctacctggcaaccgcagtgcaacaggcaccaagttctcctgcacattgcgacagtgggaccctgggctctggcgggcggtaggtggggcctttggacctaccagcagtgagggagttaacacagcagctgacttctctaggcaaggaaaactcccctcagacgctttgctgcctggcctcctgccagcaacaagcaggagctgaaaactagaagctgaggcatgagtttggtcactccgtagtgtgcacttggtgagggcagcagctggccacagctgccagccgtctgtccattcgcccatctgtccatctggcagcccgctgttcagacctgtctgtctgtccgcccatctgtaagcccatctctgtcccattgtctatctgaccatctttctcttactgtcctctttgtctagctatctggcctgtctgtcgatccatcttcgtgtctgtcttcagcccccacctgtttgtccatctgtccaattacctgtgagtctatctatgcatcttcttgtccattcatctgcccacccatctgtccctccgtctgcccaccggcctcccctctccttctgggccgcagagccacggcccaggactgcagagccatggttggcctggtcctgctggggctggggctggcgctggctgtcattgtgctggctgtggtcctctctcgacaccaggccccatttgacccccggcctttgcccacgccgctgttgctgctgactccaaggtctgctcggatattggacagtgagtgagatgtgggaggaagctgggtggcccttggcagccagcccctcctggagaaggcgtgtgtgtgtaagcgtgtgtgtgtgtgagagattatgtgtgtgtgtgtgggtatgtgagtgtgagtgtggggtgtgggtgtgtgtaaatgtgtgtgatcgtgtttgggtgtgtgtatgtgtgagtgtgtgggtgtgtgggggtatgtgagtgtgagtgtgtggggggtgtgggggggtgtgaatgtgtgtgattgtgttttgctgtgtgagagtgtgtgtgactatgagtgtgtgagtgtgtgttggtgtgtgggtgtgtgtaaatgtgtgtgattgtgtgtgtgagtgtatgtgtgggtgtttgtgggtgtgtgtgagtgtgtgagtgtgagtatgggggtgtgggtgtgtgtgaatgtgtgtgattgtgtgtgggtatgtgtatgtgtgggtgtgtgtgtgcatgtgtgtgtgtgtgcgcgcacgtgcactggcccaggaagcaggagccgtgtgtgtgggcttcagcacctgcaggacttgagcgcaaggagacagcctcagggcccttgcacagaacaggtggcagggtgtgcccgtggggcagatggggacttggggacaatggtggtgtgtgagtccatacctggctccaggattcaggaggcccatttgcatatcccaggtgggaacctgtctggccccggctgaccctgctggccggtgcaggccccttcagtgaggccaattctccaaggctgcggtcttctcccagggtcatgggtgaaggggtttggaggctccctgcgtgggtactggcctgctggggtacacacaatgctgccatagccagtctgcccctacacccagcccggggccacatctcaggtctctcagtcctgaggagcccggtgccccacccctcacatcctctctccctgagtcagggcctgggtctcgtgagctgagtgactgatacttggtgtcctggatgagggcgtggtggagaggggccacagcgggtgtttcctgaccctcttccaggaaggtgctgctgccgctgcagggaggacacatacaggatgccccttcctgccccctgcctcccattgggcccacaaaagccagggcaagcctcccctccctgccagccacctggtctgcttcccagaaattctgtcttgcaggctgttgggaggatcccagtactttgtaaactaaagcaagggaggagtggccgttctctctctttgctcattcattcaccttttcattcattccttcttccctccattcccccatctgtccatccttccctgccctgattgctcatgccaccccccctccagcccctcctgacctggtcctttggtttctcttcagggctttctgtctcctcccacagggctgagaatggcagctcagggacaagtgggggctggggactgcttagtctccccagtggctctcaggggatttgagggtttgacgccagctgccaccccaggctgtgcccctcctctgctcaggaggacatgcagagatgcgacacccacttaaactcgaagttgcaaagatgcaaatgagactggggtctcaggcaccagagaccacccatgggcacgtggcttttgggagtggggacctgctgccacagatctctgaagagtctggacctgctgggtctccccgagtgactgtctgggggtctccatagcatgccctgctgtgtgcgcgacggtcactggttgggtaggggtctctactctaaagctccctctgccggcatcccctcgaactctcccttggtgaagagaggatgtggttttcccccagtgttttatcaaacaactctctccacttcctgttttaagaagctgggagtggaagagagcctggggctggccccagctgctgctgcgaaacaggggtcactggacgctgggaccctggccgggctggctggaggcctcaggaagaggcctgctacagtgtcatcctggccaagattcctccctgcagaggaccctggccacactgccacagggtctgctggggccaccagaagcccatgctcctgcctccatctctcccctttgtgctcacctctcaccaggaggccctcccagagttcagtctcctgcttttctttttttttttttttgagatggtgtctcgctctgtcaccaggctggagtgcagtggtgcgacctcagctcactgcaacctctgcttcgttggttcaaatgattctcctgcctcagcctcctgagtagctgggactacaggtgccagccaccacgcccagctaatttttgtatttttagtagagacggggtttcaccatgttggccaggatggtctctatctcttgattcgcccgccttggcctcccaaagtgctggcattacaggagtgagtcatggcacccggcctcatctcctactctttcagcaccaggttttattcttgggattctgctacagccgcagcccctgggtgcgagctcctaagctttctgcgagtgtggacccagcaccgtgcctagtagacatacaaaaggaacatggtgacagtgaggtctgtcatctccagcataatgactcttttgatccttgtaaaaaaggtgatttttggctgggtgtggtggctcacacctgtaatcccagcactttgggaggctgaggggggtggctcacttgaagtcaggagttggagaccagcctgggcaacatggtgaaaccacgttctcctgggtgtccaggtggtccaagaccccatgactatatcatgacaggaaagagagagttaataaatctgagggcataaaatgtgaacatatactgtttccatcccacatgaaggcacatgtgtctgagcctactctctgggaggaatagagatctcagtttccacatcagggttgcattctatgcacctgcagccatgttattctgctgtagcagatgctacacttggcaccgacattgcagatgggaccatgaccttactggagttgtagaaatctactttcaccttccagaatccatttaatgtttataggagctagtccaagaaattagatggaaataaagtcctgctacaacctgagaatctttaggcctttaaaggtaacactattacatgcaactcccaatgaagggtgaagcatgattattatttaccttttttgatggggtgaaatggggagagagtcggaattcatcacatacataaaaggcaggtcgtataaatgttagtgtttgtgagtcacaaggtctgtcttgcagcgactcagatctgcacttgtggcatgaaagcagccattgactgaacataaatgaagggatatgggtttgtttaatgaaactttatgtacaaacgtaggtagtcactatggtttgctgaccccagcttttccattgccccatggaactttctttgggatgcctttttgcagtgggttctaggtgagaaaaattggctcggatctggatgctgaagttgagactggtgctgtcatgtggctactgccctcgtccatcctgggtgacttctgactgttgtgatgagcagggccctttgtggctgcctagctcctggtgccaagaatgatgaaccctctgcattgccctctgcaaagcagaccacaggacagccaccctgaattgctcgttctcactgtgtccaccttgcctaagatggttgggcacattcactggctggttaattccagatagtgttatctcattaatgccaggcagtaccttctagaagaggctcctaccatctgcactagactatggagcttctccggggtgctagtgctctgtcacctgaatatgcttcagggatttgctaaacagaatgtccttcaggccctcccatagaacacagggaaacattttgttttcccttgtgtgactgcaaaagggaaaacaaaaataagcctgggaaagggtgatttaggactttgatgatgtcgaggctgggaactcccatcagagtttctatatatgatggggaggggccaattttttgaaagtcagcattgactggccattggacacaggtggccctacattgactctctcttgcccaggacctctcctcaaaaagtctcaggtgattcagccccacagcagcaggggcacgacaccttctgtcctgaaggctgataaccggtgatgtggacagctgccattcactctggggaagatgctgcctaattccacacccaccgcctgcatgtctagtgagagcctgcctattcctatggggacaccccaaaattagctccaccaagaagcctcctccacctccattctccacagaagacactcatcttatatgcttggctacaggtcctgtttgctctgctattatccctatcacctgtccctgtctgttcaattgtctcacatgagcagagagacgatgtctcattcagccttatttcccatgggtattaataaatattcattgagtcaattaaaaattcatgtaataacctatcaatgcatgtctctgtgtgaggtaaagaaagcatcctgattgtaaatataactctcatgttaaaagctgggagcagtggctcatacctgtaataccagcactttgggaggctgaggagggtgaattacctgaagtcaggagtttgagaccagcctgatcaatatggtgaaaccccatctctactaaaaatacaaaaattagcagggcatggtggcgtgtgcttgtaatcccagctactcgggaggctgaaacaggagaatcacttgaacctgggaggcgaaggttgcagtgaaccgagatcatgccactgcactcctgcctgggtaacagagcaagactccgtctcaaaacaaacaaacaaaagcattcttacagattatcttggcttttattcctttattctaccaataagttgttagcctctcttatgtgccatttgttacaaaaaatcagctgtcatttttatggagactgagaagtcccctgatctgtccattgtaagctgaagacccagtagggccggttttatggattagtccaagccccaaggcttgagaaccaggggagccactggtctaagactcagtccaagggaaggagaggatcaaggtcccactcatgcagtcacacacaaaggaggaattctccctgctggtgccttttgttgtatccacgccttcagtagatttgatgatgccaaccacacagaggagggcaaagtactaacttagtccaggcattcaaacatgaatctcatctggaaacaccctcatagacacactcagaaatagtgttcaatctgggcacctcatggcctagtccatttgacccataaaacttaccattactatcattaaaatggcatacgttatgtatattttgttaccataaaaaatttacattctgaaaataaagtacagtgtcttagctcatttgtgctgctacaacagaatacttgaggttgagtgatttacaaagaacagacagttatttctcacagttgtggaggctgggcagtccaagatcctggtgagggcttttatactgcattctcatgtggcaaaggcagaagggctggagaaagctaaaggctgcatgaagcctctttcctaagggccttaatcctctcaagagtgaggagctgtcatgccctaattgcctcttaaaggccatctcttttaacactaccacactggcaacatctgaattttggagaggacacattcaaactatagtagcaagtttaatttggaaataattctactcaaaaaagcattagaattgagtaatgaaaccctgtatatcccctccctggatgcaacaatggggtacgttgagtccaatccagggagcattctcgcttcctctctctactccatcttaaaaaattaacaataattttctgtccactccataatcccatttcaccaattgcccaaaatacctacagtagttatttaattatgtttactaacagaatcctcaagattccaacccttatatttgatttttacttctctctgatcgatctggcatttatcgacgaagattccatcaaaccctgggcttatgaaaaattttgcaaaaattccacagataggaaagtgttcattgtgtgcagcagaaaaatgttcatcatgcagagtggaaacatgtttatgtgtggcaagcaatggtaaagtgagtcctgcattttaaaatgaaaggacagtagatggaaattagaggtcacactgtgaaataatgaattctgttaaaggcaacaacataggttagtataaaaggcagcattatggtatttttggttagtaacttctctttggaaacctatcacaagcagagagactgaatccataattaaaaccttccagccaaagaaagtccaggaccagatggcctccatgttttttatatcagccatttaaagaattagcatcaattcttatcaaactctgaaaaactagaagaggaagaaactattcctaacgagcccaacatgaccctgaccgaagtcagttaaagaccctacaagatgtgacaactaaagaccaatatacctcgtgaatataggtgcaaacatcctcaaaatgtgtgccagcaacatgaatccaacagcatattcaaaagattatgtcatataactaagtgagattaatatcaggaatgtaaggagggttcaatataagaaaatgaatcaatggaatatacaacattaatagctcaagagagaaaatacatattccaaataacatagaacaacaaaatccaacaccttctctaaatgaaaaaaaaaaagcacccagaaaactagaagtagaaggaaacaacctctgtgtgataaaaggcgtttgtaaaaatcccacaacaaacttcatactcaataatggaagaccgaaagctatccctctgacatctccggatgcctaaccttatttaagtgagttcagcaaagttgcaagatgcaagatcaccatgcaaaactcattcatatttttttttggggggggatggaatcttgctctgttgcccaggctggagtgcagtggctcaatttcggctcacctcaagctccgcctcccgggttcacaccattctcctgcctcagcctcccgaatagctggaactacaggcgcctgccaccaagcccagctaattttttgtattttttagtagagacggggtttcaccgtgttagccaggatggtctcaatctcctgacgtcatgatccacctgcctcggcctcccaaagtgctgggattacaggcagagccaccatgcccagcaactcattcatattttatatgcaccagcaatgaacatctgaaaaagaagttttaaaagtaactctatttacaagaccaccaaaaagaatacaaataaatttatccaagaagatgaacttcttgtacactgaaaatgtcaagacatttctgaatgaaatgtgcagagatgcctcaggtggctcctgcatattccgcccctggtgaagcatgtttgcattttcttgggaactgagcacctcctgcttggtcgtaaggcagacaggccacacagagaagaataattcctccctttgggccagcagttcagggatcaagaaatcctagacctgaggagtaatttctgaatctacacctagaccaaggtggtgtctgagcctccagcagtcagtgaagagcaaccagcagtggtcaacagagagtcacatggcaaagccgcctggagctgggctggacctgcatgtcagggagatgctgacatgcagggagggtcagtgaccatgacctaacactggggggaaaaatgtccttctttttctagagtatcatcgttaacattgatgtacaaactcttttgccccatgtctcttacatctggctcttttagaatttgcttatttcacagcaacaagttcaagtcttatactacattgcatcccagcccacccaattatgctaaaactctggatctgtcaaacactttcagagcagcagatttgtacctggccctaaacgcatagtggggacactgaggcacagctcctagggccttcccctgaagctccaccaagggcaaaaacttatacaagcttcatggatattaaaaacctccatgttcacttagcaagggagaaattttattcaagttctgcagctcaggagctgtgctcaagagcaagacccagaacttctcaaagcctggttttggcacctgtagaatggagcccaaaaacgcagacagacttacctcggagctctatagggccaggacagcccaggagtaaagccagtttgagacacaatttggggtgaagatgtcggcccagaatagaaccaggagaggaagaagaaacccgtgtgctgagagtgggtctgctgggaccactcctctccttcctgggccctttggggctgagcccttctctaaaaaccacagagctactccagcagcagcccctgactctgctgatttgcatcatggccgctttatccagcaaggggataagagaggcctgggaggaacctgctcagcctgggtcttgggaagcagcatcgggggtgcctcagccatggcctggacccctttcctcctcggcctcctccctcactgcacaggtgctgcccccagggtctcactcacttgcccagccccaggcctctgggtccagcctggccctaacactgagctcagtagggccctacctgtggtgggcaggatgctcatgaacctgccgcagggcagggggctggtggggcagaaatccccccacactgtgctcctgttctcttggtgccctaagggcacttttattcctggggctcaggtcagttcaggcaagtggcaagatattctttggttaatccccagagtttcaggccttttcgctcctcttttctctccttgcaggctctgtggcctcatatgtgctgacacagccaccctcagtgtcagtggccccaggacagacacccaggatcacctgtaggggaaataatattggaattaaacctgcttaatggtaccagcagaaaccaggccaggcccttgtgcaggtcatctatggggatagcagatggccttcagggatctctaagtgattctccagctccaactcggggaacatggtcaccctgaccatcagtggagcccaggctggggacgaggctttcctctcaggtgtggggcagtggcactgcacacagtgacagaggcagacaaggaagtaagacacagaccccttccccatctgtgctgctgtcgtcctccagcccggcaacactgtggacaaagccatgagcatgcatgacccagttcacctggatctgagacccccagtctttacttccttcagccctccaggcaggctgtgcagagggggcatccagaatggatttagggctgaggtgaccaggatgtattggggttttgtggactccactgtgattcagggaaattagatcttccaagcagaccaaggtcaatatcctcagttatctctggatttccataggtggtgataggccagtccttggccgaaatgtcctgaatcagtccccagaactgcccagctgaggctcctgtcattctctacagaaaaactagtggagtggacactgtgggatcctcccagatcccctcttatgagctcacccacacagcactcctgggagcttctggcagctcagagctgttcggtgcagaaatctgcctcccccaggtttatgtctcttctcagggaggtttggtttcatgactgcctgtggccaaggtctcaagactcttcctcagtataacaggacctgaaaatcctccaagatccatagctccttgtagggctgactgaagcctcaatatgtgtcagggcctccttctgcctggtgttgcctccatcactttcttaatcatctgtgtatgatattctccatctcagagtctgtttccagggaacccaaactaagatcaccagccatccccaacacgggccatgagggagctgaagaggccactgtacactagaaagcatcagtttactcttaaattaccactgcgagtctgcaaatgcccagcgagacctgagtggttttttttttcatttgtgtgaaatgaaaagggagactgacatgccagatgctctgggttctgagggagagttggagtcagatcctcctgcaggaatccaggggcagcaggagcagcctcgccccatgcagggaccacagatgcacccagagggtgagctgcaggatggacactgcccacctccaatctgtatatcctgtgcaaaaaaatcattgttttcaccccttcttcagcctatcaaagttgtcacttaaaaagccactacatctcatcctgtgaacaggaaacccatccacatctccatcagccacataatctccacataaagattcttcaaaaaatagtaataatagctgtgaaaaagtatctaaaatattgcatgacaatcatacttagattacatatgaaaatggcactatttttgatatgctaggtaaataaaatatattatttgaagtcatttaccttcttctctttatatgtctaatgtggtgactagactagcctagtgggattcccattaggctcatcatactgtgattgaacagtgctggtctgcacctcttcaggttaacaggggctgtggagtgacctggtgcaggaaatatcatctccatccataggatatcagtgtgaacccagggagaggcactggtgcaagagagatgagaacaggggtgtggagtaggggactgagccttcactttgagccgaagaagtttcctttcctatcctcaatcctgaacaagagggatttctggacttctttttgttttcaagtttgtgccccttcagatttggggctgtctggaatcctgccaggggacaccgagaaaaaataggagtctcacactgactgttgtatttcatctgctggggccatcccaaaccactgcgtacaatttcctttcctggtgctcaaatagctgctccacgcacttgttgtggtttcagagatgaatctgggtgggaagacaggacagtgtatgttataatatttaaatggaacccaaatccattaatatttattttaatatggaacattaaaagagttttgtaataggcaatgggaaaaggtaaaaaagataaaagctttttgagaaaaaaaacaaaaacaaacttatagaatgtctatgtgtcttcagtgttgcagggttgagagagatcagctttatggtgccccatggatgtgctgagatggggaaaatcaagaaagaaggaagtatgtaccactgtgactcaacaaataaatcaaagtaaaatggacttaaatctttcaataagtcattcacaataaatatcactctggtgcacacagaaatgcctgttagcaaactttcccttccccctggccatgtctccatggatcacctgtgtgcagagtggctccggtcagtgctctgtgttccctccacagggctccccacaacatgtgccctgtgtggatgtgggtgcatcgcctggggtggctgatgtgctccagggattcgatgctgcagatgcctcagcaccaagggtgggggtgggaatgggacaaggctgcagctggggagaccaaggatcaaccacacacagcaggggtttccacggggtgagcagcctcatttcctgacagtagagcgagcctaaaggtaggtgccaggcagtggtatctgtggggtggcccaggcctggagggtcacagagacacaggcaccacacagcagagacactgagggccaggagctcactcaggtgagggacttcagcagatctttctctcctggtacaaagagatcaagttcctaccatcagaatagacaaacaaggactttaatctcctcagctgagccccactgtccagggaagaagtctctgagcccaggcccaggtgagagtgggatgaggagaggagccaggacacagattttcatggatgccccgccctcctctgaggcagagcggataagacagggctgggggcatacccagtgcttgagtctcaggaggcagcgctctcgggacgtctccaccatggcctgggctctgctcctcctcaccctcctcactcagggcacaggtgatgcctccaggaaaggggcctcagggacctctgggctgattcttagtctcctgctcctcaggctcacctgggcccagcactgactcactagagtgtgttttttcctttttccgggctctcgggctcagtctgccctgactcagcctcactcagtacccgggtctcctggacagtcggtcaccatctcctgcactggaaccagcagtgacgttgggcattataactatgtctcctggtgccagcagcacccaggcacatgatttatgaagtcagttataggctctctggagtctctgatcacttctctggctcccagctctggcaacatggcctccatgaccatctctgggctccaggctgaggacgaggctgattattactgcagttcatatacaagcagcaacattttccacagtggacataagattgattctcaggctccaagtctggccagtgagcttctttgagactccctgggatcccagcagtgacactgatcactattgctgtcccacacatcccaagtgatgaggaagtaagaccaaaaccctcctgagattcctgacttgtgtcctgacaccagggctgttgggattcctgtctttccttcaagattgttcaaataagcagtgacagtcacttccatgtgagatatgagaagaagaataattccatatgaaccaaatccacgaagcctacactgaagcctgccaagttctctgcagtccagcgcgatgaagggagcattttcgtgggaacttttgggaatatgaggggagccaggctcagctatgggttccagagacaaagctcctggatgtttctccccggccttggtccatcacctgctacctctcctcactctttccacagacactgccccaggctaagcccccacaggaccctaagcctattcctgaccctgagctcagcccaggtgatgcttcaggagatgggatcctgagaatgagccccaacatctctttaacctaaggtgtggggtcatgagacacctgttagccataagacacctgtcccccacctgctcaggagacagtggagcaggcaacagtgcagagagaaccagcaggagccaggccaggccctgcatccaaagcaggccccagtccccacagattctccagctctagcctgtggtacagcccccactttctgcaggctgaaatgggcttctcaggatgggcaggccatgatgggggatggcagtgtgtccacaggacacagccctgctgcctgcctgaccctcatgccccctccttccccaccctggttaatctccaccagaaagggcccaggttcagaactcaggacacctggatcagctcctggacttgcccccactgctctctgttctcctgagccacttagtctcttttggcctcagtgttacctgctgtgaagtgaggaggcttatactgaactgaggaagctcttttcttcattcaaaattaaaagacagaaaaacaatgaaagtcatgtaaattaaagcctgctgaggggatgtcatttaatgggcttcagtgggtttcagacgtggaacttcttgtcttttctctgcagggattccaagacaggggctcaaaagagcttgctttctgtatggtgggaacagcggtccctagctgagaataagcaggagattcccagcttcatcaggaaggcagactaggctagtgtagaaatcctctccgtacaaactctgagaggtgttgaataaaataaagataaacataatttcatgttttcatggtgccgatgatggtgatgttagctcacaactaagctgcagtgcctggaacatcaggaaatcacagtgaatcacagctgctcttattgggtgggaggtgcaccagtttgatgcctaagtacatagaaagcctgggtccctgtaggatggcacatgcatctctctggactttgaaagctttgcagaagagcttcagttgactcactctaattagtccggactgaacaaaaccactagaggagggcatttcaaccctgagacacttctatagccccaacttcctaccctgcgtgtgcgaactctctgtgctgggctgggcagggcagattgggtcaccctgcacagaatggggctggactgtctggtcctcaacttctgaggtgacaggtgctgtggaggcacgtggaagaaaaaagctcctgggctgagtctcctccaccagctgggggcagcagagctgcagccaggagcagtcaggattaaggctggggctgcccagctggggcaaagagaaggccagcctggcgttcaacaggtgtccaagaatcagtcttcagactgaaagtgagtgcagttcatcctatcccctcaggctgcagtgaccattctctgagggtcagactcatacagtgtcaccccaggacactgacagaagcccggcacagtgaaggcctcacctgggaaatgcagctggaggaggctgggaccaggtgtcaactggggcagcttactcaggaaggggatttctttggagacatcccaaggttgaggtgctctaggagggggcacagcgtgaggtgacggggctcccagggcccgggttcttcacccaggatggctgtctgagcctcctgccactctcagggccttgtccctctcagtccagcagcaacctggggagctgagccctctgtcctgggcacttccagatacaccatacctcacttccttctgcctcaccttccagctccaggcggactctgactcagggggaaactcctgtgctcaggggagtctcgggtgggtggggtgaagcatttgggatcctgatcccttcatggggcatccccagcatccttaaggagacactcttcagagggacagggcttctcacctgcctcagctctgaccatggggctgtccacactcagtgacaggacactgaccagggatctgactggagtgaccaggaacctggctggggcaaccagggaccacccaccctctggagctcacatgctgtgcagagaccatgaccctgggaccccttcagagaccatggggcctgaagttagattttcagtccagtgtggttttctcctgctttttgcaagtttacataaaacattgatgagaaaaacatacataaataacagacgagctgagggtgccaattgctaatctcttgtggcaatgaggggtgatgtagcaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctgggccacctgctgctgagtcaggtgtcagcaagatctctccgcagagcccagctcagcccatggccaacctcctggaaggtccacagctctgctgagcctggcccaggacagaccccaggtcagcgaggtttgggacagtggtcatgagattaattcccagaaaggtgactgtgatcacagggcttgaaggctgcagctgattttctaatctgagaccctgcttcttcctcctgttgcctgtgctgccctcacagctggtttgagtgacatctctccaggaggaatcgcagaggatgtaaatttgcataaacgccaaacactgactgcccccaaaagctggagagggaataagagaggcctggggagcccagctgtgctgtaggctcaggaggcagagctctgaatgtctcaccatggcctggatccctctcctgctccccctcctcattctctgcacaggtgctgcccctaggctcagtctccacagaccccaagttgagcctgacctgaatcctgagcaaagccctgccactgcctctgggggggattcctggcaatgcgtcctttgtcctcaagccccctctcctgtcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctcacagtgacacaggcagatggagaaatgagacacaaaccccttgccatctgtgtcaccttcttcctccagccccaggaggactgtggacaaagccacgaacaggtctggcccagtacacccagatcagagactctgaggcctccttccttccagatctctacggaggccctacagaaggtggatcaataataaattcggggttggcaggtccagtaggtcctggtgttttctgggctggagtgtgacttggggaaaaatgacttgaatggaagtacagtcagtgggagacatctattgagtggtgatggtcccagtatttccttgtgtggtgactgaacctagggcagtgccactactctgtggcccaaatgccctgggttattcctctgagttccccgtgtattattgagatgctccagcccccactctcatggtatcctgatctgaagaatcatggccagtgcccattgcagtgtctccatctaggtgccattttcaggactcatgcatccagcatccaaacaaggctgtgtgggagaccgtgacttgtcacagctgttccccactggaaaatgccactgagctgcagagaactgctctcccagtgatgttcccccttcacagtgtggttcaggtgcaatgcctgcctggtccctagattttaatgccatgttttcatttaaaataaccacgaagtgtctcttgctgagcgctccggtgtaacacattcccagtcatgcctctcacaattttctttctgacaaaatttcctgaaaccctattgcaatgaattctccctctcagagtaggattgcagggagttcacaaattaacaaacaaaccaaatactgtctagaagaaagaggatcaaagaggagagagctgcacagggagcgcactctggagtctgcagatattcatgagcaccgatgagcatgtgcatgggaggaaaccttctgtgatagagaaaataaccattcaaagacatttgaggaaacactccatagagctcacacacacatccatgtgcacacacatgcacaatcagaatagtgcctgttcctccgctccatgaagaaaggcccgagttaaagtgggtgagatttaccagtgagaagagctttgcctcagtactggggaaaacattgccctagacaaaaggcatctctggtgttaactaagaaagtgtacggcccctgtgctgatgcccatgtcaaagaccatcacacgtattttaaccaactagcccagagttgtcaccaagagtttgatcttacaataattctgcaatgaacatccctattcagactccttggagttcacctatgaagattaccatagaataaatctctagaagttgaattgttaggtcaaaaagaagtacgtttgtaattttcactgattattctcagattcctattcacgggggggttgtaccaatttacagtgccagccataaatctttgacgtgagtatgctgttgaaagtttgggtttttgccaacatggtagattaaaattttgttgtcttgtaacagtgttattttggatttctcctattctgcttgaggttgaacattttctcaaacatttcagggctcttatattttaggatttagtgagcttttttctaaaatggccaggtaaggagggttttagcccctgtgggccaagagtcaactttgaccatattatgagggaacttataactccagttacaatgtaaccatttaaagctataaaaaccactctcagctctgggaccacacaaaacaggtggcaggccaggggtggccacaggatgtggtttaatggtccctgttttgtagggtcatttgaagtttaaaaatttcaccagcatatattttaggtggagatctttttgtgggtaatactgtatttcaccgcctatagtggcctgagatttctctctagataagaacacacttttcttattttttggatggattttgggtctatctgtgatagccctgtgtcataaactcataacttttgtgtccgtccttttactgtgatttttgggagtgtgacagtatatcaggaatacactatccagggtggaaaatcagagagagggggaggagcaagtgggcaaggaagcttgtaccaaagctggaatatccactgcagcaggctcagagaaaagggtcctaatatcagcatttgactgaagccaaaaccacaagagaccatagaggttctgaggatgacaaataaaaacatagtttaagttttaatgcattcattatttttataatccacaaaaattctaaaactcagaatttaacaatgggataaggaaaagagtttgagatgttaaacgataaagaccccaaggaaagttgccaggaaaagaacaggacctttttggtggaactatgtttatgctgtaaattaccctcttctatatgtctatatatatatttaggtataagagaacatctcatggaacacccttcttcaccacagtcaaagatcaccctcacccaaggagggaaccgaaagggaacgtcaatatgagacagaaaacataatgcacttttgtataaacattaggagagtctctatttgcatatcaaatgtggatgcttaatgttaacattggaaatagtaggttaatatgcatgtgaggtgagttttcttttgactatttctgtctgtgatttatctttcttaatagggacatttctgcccttagaacaacttaacttgtgatattttttgttctattatctgtatcagctctgttttttttttttcaaacagtggcaaagatatcccatgactaatgattaataaattcaattaatgggtatttaaattatttcaagagtggacagttgtgacttccccacatctaactcacagatgtcgctgatgctgactcactcttctcttccaatcatagcaaataaagtgggagctttgacttttctgaagacccagatgacaacaggagagaggaggtgaaaccccctaaagctgttatcctttaaaccctcaggaggaatcatcctggagaaacacccacacttgagttggattatacctaaatgagagtttggtcttagagttggtgctgagttagttcaggatttgggttgttgggatggagtgaatgcgctttacaagtgaaaaatacatgagtttttgggtccataggttggagagttcttggctgaattgtgtcccccagagttcatacaatgaagctctaatgcacggtgtgtgactgaatttggagagaatctttaaagaggtgattcagtgaaaatgaagtcatgagggtgggttcttatcgaatctgactggtgttctcgtgagaagagaaaatttgcacacacaaaaatgagacactcgagatgagcgtgcagaggaaagaccgtgtgaggactcagcaaggaggtagcgacccgcaagccaaggagagaggcctcagtgaaaaccaaacctataaacactttcatcttgactccccagcttcagaactgtgagaaaataagtgtctgctctttaggccagcaggtctttggtatctcattaaggtagcactagcaaatgaaaacaaaagggaccccaaagaccttggatgcgggaggaggaggagatggagcagggtgcaggaggtggggcagggaggggctggaagttcaggctctgaggtcatctcctgggtggaatcctgactccactcactgctgtctggggacttggggaaaaacaattaaccgcccaatattaattccatagtaaagatcgggccttgagcacaggattcctcatcttccttttttatatgatgaaagtcttcttgaggtcatgcttgtaaaacactcagcaatgtatctggcatacactatggtctcagaagtggttattatgaattttctagtgatatgtagaggatgacattggtcctgtgggcagagggggcactgtggaccttggtttgaggactctgaaagacaccaagtccgctggtagtgctcaagagcgaagagcatcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgaggagtagatttgcattcactgctcatcagagagcccacccaacaaggatacaagaataaaagaagtagatttgcatgaagagcctctccttcccatgataagagaggcctgaaggtccctccccagccatgggctcagagacagagctatgtggcatctccaccgtggcctggacccctcccttgctcaccctcctccgtctctgtgctgcctcccagggctcagcccccaaaggaccagagatcagactggccctgagcttcagctcagcacagggagtgatgcagagtgtggggctctgggaatgaccctcatcctcataattaactctcctgtcctctcttgtaggctctgtggcctcctccatgctgactcaggagccagtagggtctgtggccctgggacagtcagccagggtaacctgccagggagaaaacctaagaagccatggtacaaactggcaccagcagaagccaggctaggctcctgtgcaggtcatacatcgacaaaataaccagccctcagggctcccagaccaattctctggctccaagtcaggaacacagccaccctgaccatcactggggctcaggttgaacatgaagctgactattaccatcactcatgggacagcagtgctactcacctcacaatgacacagacagattgggaagtgagatctaaagaccttcactgtctgtgtcaccctcttcctccagccatagcaggactgtggagacagccatgagcagggctggcctgggtcacctgcatcgaagtcctccaagctgcccttccccccagctctccaggtagtctctgcagagaatgagtcaggataggatttggggctggcagaaccaggctgtcctgctgttatttggaatggatgtaccttggctcaagatgacctgagccatcttactggaaggacttactggaaggacggtaagagggagacagctcctgagtgctcatggtcactgaatttcctcctgtgtgttgactgaacccaatgcagtgcctctactctgtggcccaaataccctggattatttttctgaactgcccgtgtttaactgagaccctcaagccccagctttgtgcatcctgatgttctgaacatggaagcctttcacagtgtgcactgtgacatccctcagattcccgtttcaggacttatgcacccaccatcctcccagggctgcagggaggccctggcttctcacagctctccccaccagaaactgccatgcagtacagagaatagctttgctcaaagaattgcccatttcagagtatgtttcgggggcaatgactccctgatgccttaatctgaaagtcatgctttaatttaagaccctgaatatcaaattgaagtgccttctagctgaacactcaattgtaaaacattcccagtcacacactccacacttctttcctgagaatatatcctgaaaccctattgcatggaatcctccctctcagagtaggattccagggaacttaaaaattaaaaaaaaaaacaacacaccagtctagagggaaaaatattgaagaggagagagttagggagttgcacaaggaaagaactctgaagtctgcaaatatgcatgcactgaagagcacttgtgtgtaaagaaactccctctgaaagagaaagacccttgagggaacactccaaagagtgtgcatgcgtgcgcacacacacacacacacacacacactccagtcacagaggaaaggcctgagttacagagcatgaggtggactcatcagaagagcttcggctcagtattggggaaaatgtcggacagacatagggctactccactgtcaactaagaaagtgtagaagcaaactgggaaaagttaagacagtttccaagtaactttactgaatccaaaaataaaagaccaaaatagagaagaaaatgcaaaaggattataaactcaacaaagaaaaattcacaatgattggcattctgtcaatatttcttgcaagcaaaaaagaaaatatatgctttaacacagagaaaaatgaatcaatccaaagtggccaaaaattgcacacatgatagaccttgtaggcacgaattttggagcaattctttttttttttttttttttttttgatggagtctcactctgttgccaggctggagtacagtggcgcgatctcagctcactgcaacctccgccacccgagttcaagcgattctcctgcctcagcctcctgagtggctggaactacaggcatgtgccaccacacccagctattttttttttttaatttttagtagagacggggtttcaccgtattggccaggatggtctcgatctcttgacctcatgatccacccgccttggcctctcaaagtggtgagattacgggcgtgagccaccgcgccagccttggagcaattcttataactcttttctccttcctcatgagaatggaggatctattgaatgtgttaagtggagaaatggaaagcataaagcaagatgcaagttaaacttttagaaatggcccctaaatatctgcattgaaaaaatacactggatgagactcattgcagattagaagctgtgaaggaatagatgagtgaacttgaagatatggcaatggaagttatgcaagatgaagcacaaaaaaagtgaagagagcatcagtgagtttcaggacatcttcaagctgacttactggttataattaaagacatgaagggagataacattggtggggggagaggaaaggtagaaaagccatttaaaggaatcatggccacaatttcccaaatttggtgaaagctagaaacccactactccaaaaagcttaacaagtcacatacacacacacacacacaaacacacacacacaaataacacaccaccaacactcaccataatgaaattgctaaaaacctattataaagacatacttttaaaagtagccataaagacatggtatgtacagatgaacaacatcataaaaagaacagatttctttttctttttaaaattttcttaaacatctgtgggtacagagtaggtgtatatgtttgtgggatacatgagatattttgatacaggcattgccatgtgaaatagtcacatcatggagagttgggtttccatcccctcaagcatttatcctttgtgttacaaactactcaattacactatttcaggtattttaaattgtacaattaagttgctgacatgttatcaaatagtattgatgtaactctgacatgctatcaaatagtaggtcttattcattctttctattttatttacccattaagcatcccctaataagagcagatttcttcttagaagtcatgcaagcaggaggcagtggagctatatttataaaatattaaaagaaaaaacttactaccaaaacccatccacagactcaatgcaatccctatcaaaatacaaacgacattcacagtagtagaaaaaaactctatagttggtatggaaccacaaaatcccctgaatagccaaagcaataccaagcaaaaagcccaggctgaatatgtcacattatctgaatcaaaatatactacaaactacagtaaccaaaacaagatcgatggtattggcttaaaatcagacactgagactaatataatggaatagaataccccaaaataaattcatatatttacagccaactgatttgcagcaaaaatgccaaaaacatacgttgagaaaatgacatacttttcaataaatggcgctgagaaaaactggatattcataggcagaaccttgaaactagacttttatctctctccctatacaataatcaactcaaaatttattaaaactccgaaatataagacccaaaactataaaactactagaagggaacgtagagaacacaggggaagttcttcaggacgttggtctagacaaaaattccatagctaagacttcaaaagcacagggaacaacacgaactagacatatgggacttcattaaactgaaaatcttctgaaaagcaaaggaaacgatcaacagagtgaagacaacttctagaatgagagaaaatatttgcaaactattcaactcaaaagggcctaagatccagcataagaaaataagacaaggagctgaaataactcatcagcataaaaaacaaataatacaattaaaaagtggataaatgatatgaatagacttttcacagtcaaagacatacaaatggccaacaggtatatgacaaaatgctcaatatcactaatcatcaggggtacgcaaatccaaacctccatgagatatcatctcatcccagttggatggctatcatcaagaagacaaaaaaataacaaacactggtgaggatgtagagaaaatagaagacaaaaccacatggtcatctcaacagtcacatcaaatgttttcatgcgaggaaacattaccatttgttgtttttctagtcttgctagagcatcataaaaagataagatttgtggtgccactattggagaaaatgttattacatgcaaagactctggctatcccacaccaaactacatgaacacttactgttaaatgctaaaagaggccaggcacggtagctcacactcgtaatcccagcactttgggagaccgaggcaggcggatcacaaggtcaagagatccagaccatcctggtgaaaccccatctctacaaaaatacaaaaattacttgtatttttgcacggtggcacacacctgtagtcccagctactcgggaggctgaggcaggagaattgcttgaacccgggaggtggaggttgcagtgagccaagatcacgccactgtactccagcctggcgacagagtgagactcaggcaaaaaaaaaaaaaaaaacctaaaagattacaattctgcatttccaaatgttctggtggtcagagaccacttccttgacaagtggtgagtacggggatctgatgggataggtggcatttaggcaggtattgggtgaagaatagtgatatacacaagaaactttcaaagagaaaaacacacggaagttggaacacagaagagaacataatatgtctgagaaataaggaaagtccagactcactggagctgagtgagaacaagaaaaatggcataagccatgtatttctctctggatatctcatcaaaatattgtctcctccccaacacaccacccatgtgaattataaaaatgcccgtttttaatttttgtttgcatgtcgtgacagagtcaagcacgtgaatcaagctgagtttgatgagtccagggctgttaagctccagacccaggtggcctcagaaggacttggtggaacaagggcttgttgtcaaaagcagaggaagtgagattttccattgtggcttagaccagagattcttaaattccagtggacacacaaggccccttaaggatctggttaagatgcagatgcagcctcagcagttctggatgtggccccaaattctctgtgtccggcaactcccaggtgaggctgctgctgctggtcctcccaggaccacactttgagtggctgaactcttattcacccacctcactcaagccacgggtgagactcacacaaggagggcaccttctagaagcacaggtcacttctcactcctccccttgtgtcttagatcctttcctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggcgagccagtgtgtgctgaggtcaatgaggggaaggaagcaagagagaaagggaagataccagtctcatttaaataagcagctcttctggaaacagaggaaattcactcaccccaagtgagggcattaatctattcatgagagatccactcctatcaccctaaaagctcccattaattcccacccccaacactggggattcaatttcagcataagatttgcaagggatgaagatcaaagccatagcaccctgaggcttggccacacacttgctcatctccacatttgtcccttccttcaggaccgggatcctgactgctctgactcagtctccgtctacctcatggacacctggcagtcggtcatcatcggttttgctgaatcagcagcaacattgggggtaacaattgtgtctcctggttccaccagagacagagtagagacccacacagctgaagtgtggggtcaaatattaaaactaagagacataagattgattctcaggctccaagtctgacaagtgagcttctttgagactccctgggatcccagcagtgacactgatcactgttgctgttccacacatcccaagtgatgaggaagtaagaccaaaaccctcctgagattcctgacttgtgtcctgacaccaggtctgttcttccctcccctagaataaaacatctcttaagcacaaggctgaagaaatgtggcctcctcctttctcccacagctggtcaaagtggatacctgagagaattggctcactgaggcctcttgggaacaaaggctgggttcctgcctgtgatctgtgtactgagacacattccggacctgcccaggaaaggcaagtatagatgatgtttagttgtcacagagtccaagtagggacaattcagcggtgtcttcttgggacccctgcctctggctattttcatctactttataatgggccagggccattatttccaacttgtcatatcctttttctcctttcctcaccaggtaaggaggtggaggacagttgatgagggctggcttatgagttaccccaggatgcaaatgactttgaagtcaagcccatgtggggtcaagctcagtctataaccagggtcttttgagctctggaggagccaggcatcccagccatcaaagaggtcttgcatttgctaataaatcctcttcttccaacccacagcttatcttggctgcctaccctcatctctgtcaggaagcaatccttcgttgtttaacaccaaattattcttacttggtcagtttaaaagtcccttcctcagaaaggtcatctgtggcctgaagacaaagtgagaaggctttgctgcattttcatttggaaccttacattgccccttctgcaatgttctaaccacacatggcacatatttacaggacagcgtgataattcacttttgaaaatacagaatgtgctcatggaacaggacaatgtcatacttttggggcctgatgagcatgtccttttcacaggaccccccagagctgcccatgcatccagaaggtaccattctactctatgcaaaacgatggggcatttctatattgcagtttcttagggttccttagaaagaggccacccccaacacagagctgcacaccttgtgaccacttactgtcaattcctcaatgctgtctccaagtctcaccatgcacaagggaggaacacagagaccctggattcctagagacttgcatttcttggatgaacaaatctggggtttggttggtggcagagagctcagggctcatgtgtgagcatcacctgatgcttcctccagggtcagagtccagcccctaccctggaaggatgaaagatattgtccacagaagtggtataaaggtaacagcatcgaggacggagctgcctcttgaaatgggctattgctttgcacaacgctggagacctaaattatgttgactataatggaagagtagtccctgcggatggcctctaattgggtggaagaaagcagagggtctgcgtctgagagagcagcaatgggcagattcagcacaggcatgggcagagcagcaatcaagggtacctgagcagcaatggccccgggagaggcctggcacctgccggaagtgacgttggagacagagaaacatctaagacttaaggcttctctttctgtgcaatcccccaccccacagtttatgtgtcacagatattggcacctccttactgtaaggggtcatatgaataatacagtcctcaggggcatgggttcgaggggcagccaggtttatcctcgaagcccacttctgttacctgcagctgtgtggctgtaagcaaggcatttaatctctcagaaaaccatcctaatgagaggttaagaacctctgagaaaaaaacttagacaagaattgacagtaattcttcactattgaggctgcagggatgtaacttaatcatgtttgtaaagtgcataacacagaccctgacatgccccagctgctcctgagttggcagcaattattcctgacatcactcatgagaattggacctggaatggggatggagggaaggcagtgcagagggtttcagagggttaggaaaagagagactttaatgatttaaaatgaaggcctaggagtggagacaagcgtcctgggacattctcctgccaactctcacaatgtctcagagactgttccaaggtgaagtctactagagagctaagggaggagtttgcagaatcaaggtttgcaatgtcatgcatgagggggcagagagtcagcgggagggaagacagctgagctcatctgaagggtatttatggttttctggccctagagtccttggccatccctctatgaccagggcctcagataagcagagagcttatctgcttctctcctccaacgatagttcctggttatcctgagcccaggtcagtgcagctgtggcccattctctcctctttgtgctcagtggactgacctggaggaaacagtaggaggttcccctgctctctgtccccagggtcctttcctttcagtggcaccagcccagccctagtgtccatccatctgtgcctgcccagtcaggcctccatgctgccccctgtaatggccacaggtcaaaaactgattgtcagtcttgagcagattgtcctgactctttctgcaaaactgagcctctcacccagcaccaggacgtcacaagcaaggccagctgtaggaaggcaagtaggggagtaacgtgcatcacagagtctggacaagacaaagtagttctgctgggacacatcctggtgatgtttctcaggatggttcaggtccctgcaattgcaggcccagagaacaggactgaaggctggaagatgtgctccctttctcctgtacacaaaacagtgccatgtgtgcatgtgagtaaatgcatatgcctgtgtgcttgtgtgtgtgcacctgtgtaaatgcatatgcctgtatgtgagagagtgtgtgtgtaaatgcatatgatgtgtgtgagtgtgtgcatgtgtgtaaatgcatatgcctgtgtgtgtgcatgtgtgtaaatgcatatgctgtgtatgagtgtgtgtgcatgtgtgtaaacgcatatgcctgtgtgtgtgcatgtgcatgtgtgtaaatgcatacactgtgtgtgagtgtgtgtgcatgtgtgtaaatgcatatgcctgtgtgctggtgtgtgtgcatgtgtgtaaatccatatgcctgtgtgtgagtgtgtgtgcctgtgtgtaaatgcatatactgtgtgttggtgtgtgcatgtgtgtaaatgcatatgcctgtgtgtgtgtgtatgcatgcgtgtaaatgcatatgactgcgtgtgagtgtgtgtgcatgtgtgcaaatacatatgcctgtgtgctggtgagtatgcatgtgtgtaaatgcatatgcctgtgtgtgcatgtgtgtaaatgcatataccttgtgtgtgtgcacatgtgtaaatgcatatgcctgtgtgtgagagagtgtgtgtaaatgtgtgtgctgtgtgagtgtgtgcatgtgtgtaaatgcatatgcctgtgtgctggtgtgtgcacatgtgtgtaaatgcatatgctgtgtgctggtgtgtgtccatgtgtgtaaatgcatatgcctgtgtgtgagtgtgtgcatgtatgtaaatgcatatgctgtgtgtgtgtgtgcatgtgtgtaatgtatatgcctgtgtgtgtgcatgtgtttaaatgcatatgctatgtgtgtgtgcatgtgtgtgtgagtgtgtgtgcacgtgcatgtgtgtgtgcatgtgtgtaaatgcatatgctgtgtgactgtgtgtgcatgtgtgtaatgcatatacctgtgtgtgagtgcatgtgcatgtgtgcacatgtgcatgttagtgttgccagggagtgcttcaagtatcgaatgtcccaaattcacaacttttctattttcctcacttacctcctccctgacacatgcttctcagttaagtgagttcatatgcgcaaggcctacaaacaggcaaggcatgggccatagtcagtgctgagtcagtgtcatcaaatattgttatgcttatatagaaccttgtccagggtgggccaaatgtatgcccctgtcttgtcctgacagagcagcagaaagggagactgagacaaaacaatggccagggccctggcaacacggagacaccttcccactcctgtgagcttcacagacaaccctgggtatgggattcctgtcattcctttaagattgttcaaataaacagtgacaatcactctcatatgatatatgagaagaagaagaattccatataaaccaaacccatgacgcccacactgaagcctgccaagttctctccagtcgagcccaatggagggagcattttcatggggacttttgagagtatggagaagacctgaggaaaccaggctcagctgtgggctccagaggcaaagctctgggatgtctccccatggcctagacccttcgcctgccacctcttctcactctttgcacagatgcttcccccaggctaagcccccacaggaccctaatcctagtcctgaccctgagctcagcccaggtgatgcttcaggagatgggaccctgagaataagccctaaagtctcctcaacctgcaggctctgtagtctcttaaagactcaggtacctccagtagagttggccatgagacatctgtccctccaactgctcaggagcaggcaacagtgcagagagaaacagcagcccaggccaggccctacactcaaagcagcccccaatccccacagatcctccagcgctaacctggggtacaggccccacctctgcaggctgaggtgggctcctcagcatggctaggccatgacgggggatggcagtgtgtccatgggacacagccctgctgcctgcctggccctcatgccccgtccctccccaccctggttaagctctgccccaaagggcccaggttcataactcaggacacctggatcggctcttggacttgcccccactgttctctgttctcctgagccacttagtttcttttggccacagtgttacctgctgcgaagtgaggaggcttatactgaactgaagaagcacttttcttcattcaaaattaaaagatagaaaaacaatggaagtcatgcgaatggggggatgtcatttaatgggcttcagtgggcttcagacatggaatttcttgtctttcctctgcagagattccaagaaaaggactcgaaaagagcttgctttctatatggtgggaacagcagctgccagctaagaataagcaggagagtcccagtttcatcaggaaaacagactaggctagtatggaaatcctccctgcagaaactctgagaagtgtggaatgaaataaacataaacatgaaattaatctgccaacgatggtgatgttagctcacaactaagctgcagtgccagaaacatgcggtgattgcagtgaatcatagctgctcttactgggtgggaggtgcaccagtttgcttcctaagtgcatagaaagcctggcacgcacgtctctctggactttgaaagcttggcagaagagcttcagttgacttactctaattagtcctgacggaacaaaaccactagagtagggcatttcaaccctgagacacttctgtagcaattgctcctgccccacatccctgcactgcatgtgtgacctctctgtggtgggctgggcagggcagattgggccacactggcacagaatggggctggactctctggtcctcaacttctgaggtgacaggtgctgtggggtcacctggaaggaaaaagctcctgggctgagtctcctccaccagttgggggcagcagagctgcagccagcagcagtgaggagagaggctggggctgcccagccggggaaaagaggaaggcctgcctaaggttcaacaggtgtccaagaatcagtcttcagactgaaagtgaagacagttcatcctatcccctcaggctgcagtgaccacgctctgagggtcagactcatatagtgttactccaggacactgacagaagcctggcacagtgaaggcctcacctgggaaatgctgctggaggaggctgggcccaggtgtcagcttgggcagcttcctcaggaaggggattccctggaagaagtcccgaggtcaaggtgctctaggaggggcacagtgtgaggtgacggggttcccagggcctgggttcttcacccaggatggcggcctgagcctcctgccactctcagggccttgtcctgccctgtccagcagtgtcctggggagctgagccctctgtcgtgggcacttccagatacaccctgcctaccctccctctgcctttccttccagctccaggcagactctgactcaagggcagctcctgtgcttaggggagtctcaggtgggtggcgtgaagtatttggggccctggtccctgcatggggcatcaccagcctcattgaggagacactctccagagggatggggattctcacctgcctcaggccacagccctgaccccggacctgtccatgctcagtgacaggacaataaccaggaacctggctggagtaaccagggaccacccatcctctggagctcacatgctgtgcagagaccatgaccctgggaccctgggaccctgggaccctgggaccctggaaccgtgacagaatccatggggcctaaagttagattctcagtccactatggttttctgctgctttttgcaagtttacataaaacattgatgagaaaaacataaataaataacagacgagctgagggtgccaattgcttatctcttgtggcaatgagggaatggtatagaaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctggtccacctgctgctgagtcaggtgtcagcatgatctctcggcagggcccagctcagccccatggccaaactcctggaaggtccacagctctgctgagcctggcccaggacagaccccaggtcaacgaggtttgggacagtggtcatgaagtcaattcccaagaaggtgactgcgatcacagggcttcaaggctgcagctgattttctaaccagagatcctgcttcttcttcttcctcttgtcgcctgtgctgcccccacagctggtttgggtgacatctctccaagaggagtcccagaggaagtaaatttgcataaacaccaaacactgactaccctaaaaagcctgagagagaataagagaggcctggggagcctagctgtgctgtgggtccaggaggcagaactctgggtgtctcaccatggcctggatccctctacttctccccctcttcactctctgcacaggtgctgtccccaggccctgctccaggccctgctccagtcttattccccacagatcccaagttgagcctgccctgaatcccgagcaaagcccagacgcagcctctgggtgcgactcctgggaatgggtcctttgtcttcaagccccctctcttgttcttccttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttatcccacagtgacacaagcagacagggaagtgagacataaacccctccccctctatttcatcctcttcctcctgccccaggaggactgtggacaaagccatgagtaggcttggccaaattcacccaaatctgaacccccaggctgcccttccctccagccctccaggcaggcactgcagagtagtcagtctggagtggatttgtgcctggcaggccaggctgtcctgtgtttctttgcctggggtttgagttgtcgatggagggtctgactggaaagacagacacagggagacatccatgcaggcatgtccaaagggacatggggaactctcaggtctcagttgaatgcagtcattgttgtatcctctgggaaagcattcctctagtgcatctaagacctccagacccacagagcctgagatcaggaggagagaatgttaaatttttgctaatggaccactgaagacatttttgagtggagccactacaatttactccttgattctggactcatggatcctgactgtgggagaaacagcaccatctattgggcactgatgcacagaacatgccctatcctggaagacattgtccagccctacacatacttgccacttgcctggtgcagtaatggtgtctccaagcagtcattaaaccattcatataagccatatgtctcagaatgtttgggacaagagtaagaatcttgattgccagaagaaaaggcccatagccctttatttgcagtgaaatgaattccttggtcagaacctcctgtggaataccatcatgatgggtgcgtcattctgtaatccagagacaacagttttggcagaagcattgctgtcaatgaaagcaaatcctctgtagaataaatgtcaattctagtaagaaaaaagagctattcctgccatgatggaagagtgcaaacgaaattaatattaagcaggcccctggctgttttccacagagaaagtcatcctatagggatctctgtgttagtctctgctgttggcagatggtcactcagcagtggctacagccaggccagctccagttagtggaaatcgacattgatgagcccatggacagcctccatccctgccaccatgggcgcttttttttatggagcccactgggcattgacaagagtggttgagggaggctgcctgatgtccacagaacaagtcaccctactcacctgattagcaaaatcacttcattttcacagaagacttggtgagtattgacatatggaaaaaattctcttactttctgcccaccggaggaggtctattcacacatctctccccctgacgtatttgtgatcaatattctcattgtgtctctctcaagtccctgaacatccttgagcatctttcaagaccctgagtcacaacctgtgaattaggaacctctgcccatctcttggcaggtgacatgagccaattgcactgcttaaaattctactttaatgagaatgttcctccaacactgctgttcagggattctcagaggccaggtggagtactagcactgtccacaccagtagtggctgcatgtcctgcagaaaactctgtaaccccagcctaagtgcctcctcctaggcagctgatctcagggagcccctcaggacgtcaaggctgtagggtgagaggaagacatggtgcagggctccggtcatgtctatttggccaactcttcatgaaacttacttgggcctcgtgacctagtccctcaagtcacaaatacatccctgccatgtgattgaggagctgctggaaatggccaaccgggactgtggttcagaccaaacctagcatactggcaacttgggtcgcatggtgagctgtgtggccacaatcacacagagcctctgctgaggcccaggagcgttcgcagtctttctcaaatggagctttctgctcattcaaaaaaataagtagagggaggctgggaccccaggaccacttagaccacgcacatgatcttgtctgattattctgaatccttgcatgctcagctatgcattatggtaaccaagccacagtgtctttggcaataaaatgccactacttggcccccacctaacctgggatcccctcaaccacatcttgctacccaaaacaggtttcacctccactgagagaaatttatttttatattgagaagatgaaagattaattatttcaattgtgaaaattttataggacagtaatgtgaaaatattttaaaagacactttacgaagagtgaaagaccttccattaaaccactcaatatatgacactgtaattggcctacccaaaccctaagttcagctccgggttgggaccttctgggaatggacccttcatcctcacgccctcctctcctctcctctcctctcctctcctctcctctcctctcctctcctctcctctcctctcctctcctctcctctcctctcctcttctgtcagccctgtgcctcctatgtgcagagacagctggtctcagtgttggtggccctgggactgacaatcatgagcacatactctggagataaccttgagataaacatgcattaaggaaccagcagaatccaggccagtccatggtgctggtcatctagtataacagcaactgaccctcagggacatctgcccaattcttaggcttcaactcagggaacatggccaccatgaccattaatggagcccaagcccgggaagagactgactattgctgaactgcagataataacagtgggagcagctggcagggactcatagtaacacagagagacagggactagccacagaactgtcccatctcggcctggctctcattctcagctgccctgtgagcagctgaaggtcaggcctcagggtcaggcgtcctctctggtcttaacctggcccctgcagggctggtgattctgagcagcttctccatcctctcagggcctgcatgtgtccagtgagaagtgagtggacagggggaagctggttggagctgcaggaacctctgtcaggtttgtggtgtacatgaaaggtttaggaatccacacaacatcacatggccccagatgtaatcacacatcacacaggggaggaaagagctgtcgcagagggtacagtcctgtggaatttctcttttccttgggtataagcagcttagtggaagctccagaggctgtgtctcctctggtttccagatgagttcagttgacctccgcattctaaaggggtgcctgaggcctgaggaggactggagacccagccccttttggccccagggccctttctgtgctgacatttcacagaaactgaagaggaagaacagacactacctttcatcccacctggggactgtctttggggcacgctgaactcccatggcccccaaagtcccatcaccttccccaggtaggtcagacctgactggatgtccctctagtgccctgatagtgtggattttatctttgggctctgggctgctttctgaggagctcactaagaacccttgatgccaagtccaggacctgcccctctgctccatgtcccaggggctgcaagcatgacgggaaggtcctgctgggtgaggatggtgcccttttccagaagagatgtctgattccagtctctagggccaggtttgttgggctttttttctcacttggaaggtctcagtctctttattaccttctttaaaagtacaattggtttaatcgtgaaatcatgtgcatgcactaaagtttacagactatggtcatcagcacatatgtacactctttctggatgggacaactgtggacacggccatactggggtctctgtctctctcattatcacaagggaggataccaacagctctctcctatgcagaccgtagtcatgtttcccaattgcacaagaatgtctcttacagttgtttaatttccttcccagccaggacgcttaagtttcccatgctgatacttggttgctatttctctctgatccaacatttttcaaacagtattgcttgcaacccaaggcttatgaaacactttaccaaaagttccacaagaaaagctcaagtttctcatgcaccgttggaccaggttcattgcgtgcagtaggaccttgctcaagtgatgagtccatttgatgttttcaccatcaaggtgaagggtattatgacttttgggcactgagttgatagaaggaagacagcagctgatgatggccctgcccaccgatgtgtgtgtgtgggcaggacctatcgatggatttagaagttgagggaactgtttattctgcagatggaatttccagcactgaatctccaccaaccagacactagcactcagcaggtgctctgtaagaagaagcccttcactgccaatcacggccattacacaggtgaaggagaggatgatttttaacagccattgaccctcacagtaaactgaggtcaaaactctggtacacaaagtgactttgagagaacaggctgaggaagcaggttaattagtagcagaaggctttgccgagagcaggaacaaaacagggttggtgaggaactagtgatgccatggtgtggaaggaacaaggcctgtaccaggagcaggaaggggcatgggaaagaccacactgccacatgtgatgagtcagcacatggaaggcacagcaaatgttgcacaaaggtttttgtgtaataacctggcaaacagctgcttctctatcaagattgatgagtcaaaaaatgttactgatgcattgctgtcacatgtgaaggtgtgtgaagaatggtgacattcaaggaaacctgttctctgcagacacctacccaccagtacagcagacaccccagctatgccaagggctttgtcttcctctggggtaagagcctgggaacaacaagttggcccctgaaaggggtgccccatcatgcgctcttcatggctgagttaagtggggagctcccagagaactttccagtaaatggtcaatctgtttgttctgggtgcattgagcatgacccaggatcaatggaagtgacagaagcttaatttccccaaggctgcaaggcgggcactgggaggacggctgaagcagtttagccaccaccccctagtggctccagccccaggtaagcagggacagttgaagggcctgcctgagcccacctgtgtctaattagttccagcatcagcagctgcatcctgtagaccaccaaggagtgtgtgtgcccagcccctcacagatcacctgagcataaacaggaaattctccttcttacacctgactgcaccacacatctgccccttgctcttcatttacaagacgctatcacatcagacacggactgatctgagtcccgggttccctcaggtttctgctgtcctctcagatccccacacacaaaagactcttcaccacagggcgttgagccagctcttcccctaacactgcctcttacaggttactcttctccaatatgatgcgggtttgatttcagtgtttctacatatatacttttgtattttattgggtaagctgagccccttgtacctgatcttgagtcaggcaggggccacacagagaagaggtgttcctcccctgggaccagcagtcctcggatcagggcatcagggacctgaacagcaggttctgaatccacacctagacccaggaagtccctgagcccccagcccacagtgtggagcggccaccagggggaagcagagagttacctggcaaagccacctggcgatggggcgggcctgggtgacagggagacgctgacatgcagcaggagccagtgaccatgatctcacacctggaatgaaagggtctttattttcatagagtattgtccttgtgtacttgacactcatgtagaaattctagaataggattttaccttcagctcttgcagatgctgcctctttctctgccacagctccaggcacttgacttctcacagtgccctctcctcacacacccagttgtgctaaaatggtgtccctgccatgtgcagtgtcctccctgaggtcacaggtgtcccctttatctcccctttgctctgggagcccctgtcctgcagacacagtggcttctcctttcctggctgctcctccactttcattgtccctggtctttccggactctctcctggggaagctgccaaatcatggctcttgatttcctggtgagtcacaaaatagttgctcattaacctttagttgacttaagttcttaatcattgatacattttccccaacaactgacgacaacttagttataataaacattcacttctgggggtcttggagtttgcagccccctctcattctctcatggagcaaacatttccttcgcctcctcatctgtctctgatcctgacagcatcctggagatactgaggcacagcagctatgacctacccaggagcttgcagccaaggcagaaacttccatcacctcatggatcttccagcactctgtgtgcacttgacaaataagaaattccattgtcctctaccactcaggagctgtgccctgcggtgggacctgcacctttccaaggtgtgtgttatcatctgcacagtggagatgaagagggaacctgcattgggttctggaaagtaccatctaaaaatatatttagacctgcaacagaaatctcctctctaacataaaatatttatgatcaggacacactgagaggcctagaccaaaattaagcactgccctcctgagccaggatagaatggaggaggggactggggaccccagataattccacagttaccagcatgactctatgatcacctcctggaccagatcaaagatcatcccatatgaaggacttcatattccttaggaaatacaaagtcacctctgagctctgctgtgaccaagtgagcccaggaatgaggctgagcacagtgtgatgtggagatgtctgcagagaatatggaatcaattgataaaggagatcctgtgggcaaagggtgggagggcaaggccacccctaacctctttgggtcccttggggctgagtccttctggaaaccacaaagctcctccagcagcagcccctgactctgctgattggcatcacgggctgttctctccaacaaggggttaagagagacctgggaggagcctgcccagcctcagacttgagaagcagcattggaggcacttcagccatggcctggcccctcttttccttggtctcctgactcactgcccaggtgctgcccccagggtctcacccacctgcccagccccaggcctccaggttcagcctggccatcagtctgagctcagcagggccctgtgtgtggtgggcaggatgctcgtgaccctgctgcagggggaggggctggttgggctgaaatgcccccactctgtgctcctgtgctcatgggtgccctgagagctcttttattcctggggctcactccagccctggcaagtagcaagatatcctggggttgagcctctcagtttcaaattttttatctcccctttccttcttgcaggctctgtcacctcctgtgagctgacacagccaccctcagtgtcagtagctccaggacagatgactaggatcacctgtggggaaaacagtattggaagtaaaagtgcttaatggtaccagcagaagccaggacaggcccctgtgtgggtcatctatggggatagcaggcggccttcagggatctctgagattctctggctcaaactcagggaacaggaccaccctggccatcaacagggcccaggctggggaccaggctattactgtaagatgtgggacattaggactcctcatcccacagtgacagaggtagatggggaagtgagacacaaaccccttccccatacgtgtcactcttgtcctccagcccaggaagactgtggacaaagccatgagcatgggtttcccaattcacctggatctgagaccccccaggctgccctttccacaggccctccaggcaggctctgcagaggggacatcaagactgaatttagggcagaggtgaccaggatatattgaggtttgggggactcagttgtgatttggggaaatggggccagaatggaaggtcaggccaaggtcaacatccttagttggtctctggatttccatagggggtgaaggccagtccttgggctgaatatcctgagtcagtttccagaactgcccagctcaggctcccatggcatcctgccattctctgaaaagggccctggcatgccaggtgctctgggttctgagggagagttggaatcagatcctcctgcaggaatccagggtcaggagaagcagcctcacctgacacagggaccacagatgcacccccacagggtgagctgcaggatggatgctgctcatctccaatcctcacatcctatgcaaaaaatcattcttttcacccctccttcagtgtatcaaagttgacacttaaaaagccttaagagcccactcttgtcaacagaaaacccattcacatctccatcagccacacaatctccacagaatgattcttcaaaaaacgataacagtagacatgaaaaggtatctaaaatgttacataaataattgaacttagattacatatgaaaatgatactatttttggtatgctaggtaaataaaatatattatttggactcctttactttcttctctttgtatttctaatgtggtgactagacattgggattccaatgaggctcacatcatattgtgattgaacagtgctggtctgcacctcttcaggtaacaggggctgtggagtgacctggtgcaggaagccccatctccaatcataggacatcagtgtgaacccagggagaggcactggtgcaagagaaatgagaacaggagtgtggaccatctgcttgtacaggggactgagccctcactttgagccaaataaactttttttctattttcaattctgaagaagaagactttcctggacttctttccgttttcagatttgtgccccttcaggtttggcctgtctggatcccagccaggggacaccgaggaaatccaggagtctcacactgactctgttgtatttcatctgctggggtcatcccaaactgctgcgtatcgtttcctttcctggtgctcaaatagctgctccatgcacttgtcacggtttcatagctcagtctaggtgggaagacaggatagtgtatgttataatatttaaatggaacctgaatccattcattgtttttgtttttttgtgtttttgtttgtttttgttttgtttcgtttttgagagagagagagagtcttgctctgtcgcccaggctggagtgcaatggtatgatctcggctcactgcaacctctacctcccaggttcaagcgattctcctgcctcagcctcctgggcagctgggattacaggcccccgccaccacatccagctagtttttgtattttagtagagatgaagtttcaccattttggtcaggctggtctcaaactcttgacctcaggtgacccacctgtcttagcctcctaaagtgctgggattataaaggtgagccaccacgcccgacccaatagtttttttaaaatatgaaatgttaaaagagttttgtcataggcattgggaaaggtgaaaatagattaaaaacattttaagaaaaaaaccaaaaatgtacttgtagactgtctgtgtgtcttcagtgttgcagggttcagagaggtcagttttatggttcactaaggaggggctaagatggaggaaaccaagaaagccaaaaacacacatctctgccactcaaaacataaatcaaagtaaaatggaaaaaatctttcaataaatcattcccaataaatatcactctggtgcacatagaaaggcctgttagcaaactttccctttcccctgctggctcatatccccatggatcacctgtgtgcagagtggactctgtggtccccatttctcaggctgagaaccagagactgggaaggacaagtcacctgctcatgagtgggaagggcaggattgggagcagctggcttgggttcaggactgtggccctggtcggtgctctgtgtccctccagagggtccctcccacatgtgccccgtgtggatgtgggtgcactgcctggggtggctgatgtgctccagggattcgatggtgcagatgcttcagcacaaaacgtggaggtggggatgggatgaggctgcagctggggagaccagagaccagcgccacccagcagaggtttccacggggtgggcagccccatttcctgacagtagagacaggctggaggtgggtgccaagcagagggcgctgtggggtatgcccaggcctagagagtcacagagacacaggcactacacagcagaggcactgagggccaggagctcactcaggtgagagacttcagcagatccttctctcctgagcaaatcaggtacaaaaaaaattaagttcctgccatcagcatgcacaaacaagaacattcatctcttcagctgagccctgctgtccagggaagcaaaagtctctgagcccaggcccacgtgagggtggggtgaggagaggagcccaggatgctgattttcatggaggccccgccctcctctgaggcaaaggggataagacagggctggggcagggccagtgctggggtcacaagaggcagcgctctcgggacgtctccaccatggcctgggctctgctgctcctcactctcctcactcaggacacaggtgacgcctccagggaaggggtcttggggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttccacagtggtccaagttcatggggaactgagaccaaaacctgcccagggccttcagacttcctccttgctctgaagatgcttcctcacccggtgcaagaggcttgctgcagcgcggccttgagaattcttctctctcagctccttccctttccaccatgaattccaacaggaaacctgccctgtggtttcccatccaggacagggacagcttcctgatgcttgtgtgctgtggtccctgaatgtgcaactcttcccagctcttcaaatgcagggacagtgacaaggagctgcctgattggtgcagtcactgcttttttcagggatgtcttcaccctacatgtatcatcatcccctacactgtgggtagaattttagcaactacattctaatggttatcgccacaactttgatcttagaaataacagtgcagtgaacatccctatgcaggctcctttgagttcctgtgtgaatacgaccataggattcatttctaaaagtgaaattgcgggtcagaaagatgtgtgtttgtgattttcacccaatgttgtcagattcccctccagagggattgtaccaattttcaatgccagctggaagtacttgttcagagtacattgttgaatgtggaaatttttgccaacgtatcagagtgaaaaatggtaccttgttacagttttatttttcagtctcccgttctgcttaaggttgggccttttcacaaatagttcagtactcttcatttttcatgatttggtaaactttataaaaaatatccagataagaagaattttagtctttgtggccagacacggtggctcatgcctgtaatcccagcattttggaagactaagacgggtgaatcgcttgatcccaggagtttgggattagcctgggccacacagtgaaccctcatctcaattaaattaaagaaaataaaaataatttttaaaaaaatcctttgtggtccaaggatcaactttggggatattacctatggacttatatcaccatttacaatgcaaacatttaaaatgataacaactactgtcagctgcagaactaatttgactccatcaaaaaaaaaaaagctaaaagattataattctgcatttccacatgttctggtggtcagagaccacttccttgacaagcagtgagtacggggatctgaagggtagttagcatttaggcaggtattgggtgaagaatagggatatacacaagaaactttcaaagagaaaaacacatggaagttggaacacagaagagaacataatatgtctgagaaataaggaaagtccagactcactggagctgagtgagaacaagaaaaatggcataagccatgtatttctctctggatatctcattaaaatattgtctcctccccaacacaccacccatgtgaattataaaaatgcccgttttaaatttttgtttgcatgtcgtgacagagtcaagcacgtgaatcaagctgagtttgatgagtccagggctgttaagccccagacccaggtggcctcagaaggacttggtggaacgagggcttgttgtcaaaagcagaggaagtgagattttccattgtggctgagaccagtttcttaaattccagtggacacacaaggccccttaaggatcggttaagatgcagatgcagcctcagcagttctggatgtggccccaaattctctgtgtctggcaactcccaggtgaggctgctgctgctggtcctcccaggaccacactttgagtggctgaactcttattcacccacctcactcaagccacgggtgagactcacacaaggagagcatattctagaagcacaggtcacttctcactcctccccttgtgtcttagatccttttctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggggagccagtgtgtgcagatgtcaatgggggagaggaagcaagagagaagacaaagatgccaggctctttttaataaccagctctttcggaaacaggggaattcactcaccccaagtgagggcattaatctattcatgagagatccactcccatcaccctaaaagctcccattagttcccacctccaatactggggatccaatttcaacataagatttggaggtgacaaagatcaaagccatagcaccctgaggtttggccacacacttgctcatctccacatttgtccctcccctcaggactagggtcctgactgctctgacttagtctccctccaccttatgggcacctggcagtcggtcatcatcagctttgctgaatcagcagcaacattgagggtaaaaattgtgtctcctggttccaccagaaataaagtagagccccacacagctgaggtgtggggtcaaaaattaaaactaagagacataagactcattctcaggctccaagtctggccagtgagcttctttgagactccctgggatcccagcagtgacactgatcactattgctgtcccacacatcccaagtgatgaggaagtaagaccaaaaccctcctgagattcctggcttgtgtcctgacactggggctgttgggattcctgtctttccttcaagattgttcaaataagcaccgacaatcacttccatgtgagatatgaggagagaataattccacatgaaccaaatccacgaagcctacactgaagcctgccaagttctctgcagtccagcacgatgaagggagcattttcatgggaacttttgggaatatgaggggagccaggctcagctatgggttccagagacaaagctcctggatgtttccccctggccttggtccatcacctgctacctctcctcactctttccacagatgctgccccaggttaagcccccacaggactctaagcctattcctgaccctgagctcagcccaagtgatgcttcaggagatgggatcctgagaatgagcgccaacgtctctttaacctgaggtgtgaggtcatgagacacctgttggccataagacacctgtcccccacctgctcaggagacagtggagcaggcaacagtgcagagagaaccagcaggagccaggccaggccctgcatccaaagcaggccccaatcccacagattctccagctccagcctggggtacagccccaactttctgtaggctgaaatgggcttctcaggatgggcaggccatgatgggggatggcagtgtgtccacaggacacagccctgctgcctgcctggccctcatgcccactccttccccaccctggttaatctccacccaaaagggcccaggctcagaactcaggacacctggatcagctcctggacttgcccccactgctttctgttcccctgagccacttagtctcttttggcctcagtgttacctgctgtgaagtgaggaggcttatactgaactgaggaagctcttttcttcattcaaaattaaaagacagaaacaataaagtcatgtgaattaaagccttctaaggggatgtcatttaatgggctccaatgggcttcagacatggaacttcttgtctttcctctgcagagattccaagaaagggactcaaaagggcttgctttctgtatgatgggaacagtgatctccagctgagtataagcaggagagtcctagtttcatcagcaagacagacaaggctagggtagaaatcctcctggcacaagctctgagaggtgtggaatgaaataaagataaacatgaaattaatgtgcctatgatggtgatgttagctcacaactaagctgcagaaccagaaacctggtgattgcagtgaatcatagctgctcttactgggtgggaggtgcaccagtttgcttcctaagtgcatagaaagcctgggtccctgtaggatggcatgcacatctctctggactttgaaagtgttgcagaagagcttcagttgactcactctaattagacctgactgaacaaaaccattagaggagggcatttcaaccctgagacacttctatagcaattgcacctgccccaccccactgaactgcgtgtgttacctctctgtgctgggctgggcagggcagattgggtcacactggcacagaatggggctggactctctggtcctcaacttctgaggtgacaggtgctgtggggtcacctggaagaagaaagctcctgggctgagtctcctccaccagttgggggcagcagagctgcagccaggagcagtgaggagagaggctggggctgcccagctggggcgaagaggaaggccagcctggggttcaacaggtgtccaagagtcagtcttcagactgaaaatgaagacagttcatcctatcccctcgggctgcagtgaccacgttctgagggtcagattcatacagtgtcacccaaggacaccgacagaagcccggcacagtgaaggcctcacctgggaaatgcaactagaagaggctgggcccaggtgtcagcttgggcagcttccttaggaaggggattccctgggagaagtcctgaggccgaggtgctctaggaggggcacaatgtgaggtgacagggctcccagggcccaggttcttcacccaggatggcggcctgagcctcctgccactctcagggccttgtccctccctgtccagcagtgtcctggggagctgagccctctatcgtgggcacttccagatacacccgacccctcctgcctctgcctttccttccagctccaggtggactctgactcaggacgcagctcctgtgctcaggggagattcaggtgggtggcgtgaagcattttggggccctggtccctgcatgaggcatcaccagcctccttcaggagatgctgtccagaggaacagggcttctcacctgcctcaggccacagctctcaccacggggctgtcctttgatcagtggcaggatctgcatggctggagggactactgaccacatgctctctggagctcatgtcttgtgtggagaccatgacctggggaccctcagaaagaccaagcagcctaaagttagattttcagtccagtgtgattctctggttcttttcgcaagtttacgtaaaacgttgatgagaaaaagtgaataaataaaggaagagttgaggatggcaattgctggtctactgtggggctgggggataccatggaaagagcagcaccacatgtcaaatgagactagagattgggatgcatccgaaatatgtgtggttgctcaaatgacaaaactcttccaactgcaatgattcataagtgtcctacagacacagtacatcatgtacataacattaccaggatggggccaagtgactcgggggtatcaggagcagggatgaaagaggagaaagatgatgcatctttggtgtacttgctgctgagtcaggcgtcatcagtgatttctcaacagggcccagctcagccccaggccaggctcctggaaggtccatagtcctgctcaatgcagcccaggacaggccacatgacacagaggtttgagacagggaccatgttgtcaatccccaggacggtgactgtgatcacaggccttggaggccaaggctgattttctgactggagaagcagacgaaggaagctggggattcaccccttcattttaagtttctcatgctgcccccagagctggcttgagggatatcccgccatgaggagtcccagagaagtaaatttgcataaacaccaaggatgcactgccccagtgggcctgagaggaaataagagaggcctgggaagcccagctgtgctgtgggctcaggaggcagagctgtgggtgtctcaccatggcatgggccacactcctgctcccactcctcaacctctacacaggtgctgcccccagaccctgccccaggctcagccctcctaagcccctggtcttaccctgaaccctgagctcagcccaggcatagcctcagggcgatactactggaatgggtttgttatcttcaagccccctctcttgtcctctcttgcaggctctgttgcctcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatccctcagtgacacaggcagatggggaagtgagacacaaactcctttttcatctgtgttgtgttcttcctccagcaccaggaagactgtggaccaagcaatgagcaggtctggccaagttctactggatctgagacctccaggccatccttttttccagctgtccaggttggctctgcagagggtggagcaggagtggatttaaggctgctataatcagaatttatggtgttttggggcctcatgagtgacttggggaaataagaactggatggaagatgaaagagatgtagagaaccatcacttgaccttagatttccatacgatggtgattgggtcactccttcttcaaaatatcctacatcagtcccgaaaaatacccacctcagctcaacacctgagcttccaggcttccatggcagcctgggattttgaacaggaaaagccaaggaggggacactgtggcatctgcctcaatacccttttctgagctcacccaacctcaactgctgggagcttctaggagctcagagctgtgccctcactgggaagtgctattagctccaaagaaaacttccttcctcatatttaggcccagttttgagagttttggtttgatgactgcctgagccaagaacccaaggccctgtcctaatagaggatgacactgaaaggccttccagatccagacatcccagtatggatgcctgaggcctcagttgcaaccctattgtgggtcagggtctccttctggtgggcgatgcctccctcactccttccagatcctctgtgcatgcacatctttttctcagagtctacttccaggaaacccaaactaagatggctggctatcaccaaaataaactaccatagacctgaggtggaaacaccagcgaatttcccaaatttccattgtgaacatccaaatgcccatttatatctgagtgttccttgtattcttataaaatgaaaatggagcctgacataccaggtttttggagtcctgaaggagatgtggagacagatccttctgcaaggaatccaccgaaaggggagcagcctcaccccatgcaggggctggagatgctcccacaggggcagctgtagcatggacgctaccaacctccaccctgcacatcctgcacaaacaatcactctttcacccctccttcagcttatcaaagttgacacttacgaagccagcacagctcacccttgtcaatcagactccttcaaacctccatcaaccacacaatctcaacataaagaatctccccaacataataataggaacagtagctatgaaaatggctataaaatatctcataaataattttagattgtgttcatgtgtaaatattatttttcacactttgggttaaataaaatatattactgaaactagtttacctttttattttttatgtctagtatggtgactagacagtaggattcacatgagactcacatcatgtgattgtacaatgctggtcttgtcttaccccttgaggtggcaggtgctttggagtaacctgcttcagcaagccccatctccacccgtaggacatatgtgtgaagccatggagaggcactggtggaagagaaatgagaacacagatgtggaccagctgtttatgcaggtgactgagtcctggagccctgatcctgttctaacctagatgtgtcacatccatctcaccagagaccgctgctggcctgccttagctcataactggggggatctggcagttcatgaaacatggtcgcttgatgtccagtgttatcctgtctctctcagggcccaataagacaaaaggagctgcttttagaaagggaagtaacactctactgcacatgacatggccttattccaaaaccccatgagtctacgttgggattctccagtggggtttgccatgtacaggaggtttcagttcccacagtagagtcagctggattctctggacccaacagcaggacactcacaaccctgcctgcacctgctgcagagcctcaatgctctgggcctggaaaacaatgggtgatatttgtggctcctgatatatgggttggagccacatccccaagtgtaaaatatgctactcctagacctttatagaccttgtgtctgtttcttcctggagggaattgaagggtataataacatgttctttaatttgtaggagactctcagctgctccagacaactgaagtcccaatttctgctaatacagaagagggaacagtttatttcccactcttaaaagtgcatggatctcacaaaagcttccagtaggccatgcccatcatgtatatgtgattcaactatgatatcaagatggtctgaaccctcatgatgatatcatgatagagataagagagctaatgatgctgggcagagaaagtgtgaatgtatactgtcgtccattccacctgaatgcacactgattctgatcctattctctgagggaaatagacaagacctcagtatctgcttcagtgaggtaactgtgcacctgcagccatagcattctgttcccagagatccccatctggcacagatattgctaatgccactattgcccatctgggtctgtacaaatccaaattcatcttccaggatcattcaactattgtagagatcagtccagtaaactgaaaacaaaaccccagaagtaatcacacgtactgcgggagaggagagagctgtctcagagggcacagtcttgttgaaattcctctgctccttgggaagaaacagcccagaaaaggccccaggggctgcgtctcatctgggttcctggatgaggcacaccccctactgcactgagattccacagaagctgggggtgaagtgcaaataccgtctttggttcatccttgggattttctttttatcacacactcgtcattttgtccacaatgtccaaagtttctaaagtgctgtctaatagatagaggttctttgtgcgctgaactaaaagctcttgggttggacaatggtgatgtttgcacaacatttttactgtacttactgccgcttaattacacacttaaaaatgattaaaaggatgaaacattttgttatgtttattttaccataataaaaatattgcatgctcaggaagcaaagtaattttgcaattatacaactgttaaaaatggaagaattatgtactgagcaccattttctctgttgtttatgctacaattcaactttctctctctctcactctttctctaattagcaatgatcttctgtctggtccaaggtcacacatttccagtcttccagaaatgtctgttgaatctgttaatttgttgccaggaagaatactcaaacttctcatgctcatatttgagtgttagctgtctccagccagcatttctaagccagaccctttgtcaaggcttttgaataattttgtgaaaagtacccccaaagatgacagtgttcactgttggcagcaggactgtttccatgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctattggacactgagtcacatagagggacagaaggtggctgaggacaccttatctctgatgagcataaggggattagatctgctggtggaacaggaagctgaagaaacctgtggctctaaacatggaatttccagccctgagtctctgctgtccgtgcccctctcatctgtatgttcctgggagatgtggaccacgggggttagaggtgaaggggattgggaagctttcatgttctctctcaccatctcccttgcttatctaacacactcttacacacctactttattggagcttctgctctacaaacatggctgagctctaaattagagacttttgaaagtgcagacggatgcaggaactcgtccatctggagactttccaccacttgaagcagtgaacacgtctgtgcaaggctcagaatttcaagtgacaggatgttgggatttcaaagaaaactaaatctttggatgaaccacgacagaagagggaaggttcacacatttccctgctgcttgggcctcagtgaggactgactcagccagtctcaggctcctggagaccgcctgggagatctgcactaggaaaccattttcagcacagcctggggctggtaaggggcccttactctgttattctgctgcctgataattttgcatccagagaagaattaggacctgtgagtccaggaatttcaaagcccatagacaaggtcccctcattctgccgtgacagcctcagctctgctttcccaaaaaaagagcatcttcccagcatgaagaaccaggagcaaagagggagcttctcccaggggtgagcagggcagaagccaccttggtcagtgggaaggaaacatgctcagctcacatctgacccagaatgactcagtcacacctgtgcagggtcacctgtgtgtgagcatcatctatttgctccatgagaaaataccttgtgtggctcttgggtaaaatcataccataggtgacatttctctgcctattgcttcagccgatgcttttcgtgattccctttaggacactggcataaggtaagcatgtcaggtgtgggacgtattgaacaggaaaagcagaggcttctcatatcaatgctcgtggcttgtatttgggcccatacctcatggaaatgggaaaaacagaaaagaaaatgatactctgctcaaaaaagcactgagaaatgctatagtattaatatatcgacaactcatttattgagctaatgaaatattaacatagatagatcatttttatagggggatccctaatccttaaacattatattaaaaatttgtcagcttaaaggatcattaaaaggcctatgtttgattgaaacctggagtactgtactttgagtcttctaatcagccaatgagtgcagggagctggctgccctcccaggtcctgactggctccatgtccaggtagagcagcgctccccacaggcagctggaggaactgacgaggggaagctgttggcatcagggcctcaaaaatttgactcaggattttcccacgtcccctccccaagtccaggcgggttccaggacactcagaagagctcatcattatgggtctaggacttccctggtcctgctcttctttcttccttccccagtggccttaagattgtcactccctgtcacaggcccttcctttccttgtcaagtgcactccctgaattctctgctcctgggtcaggaaagctctggaacttcagggaaagcagtgctgggtgacccaatggggacccagaaagctggcccagggccagatacacaggcagcagggtgggtccctacagtgctgcctggtgggcatcaggtagaggggagtgaccaggaccaactcccctgagtgtcttcagggccaggtgaactagggagggtctgggacctggtgtggacccatgcactgacccaggaataggacaggaaactcctcagagcaaggactgtgttttcctcatgctgagctcctgaaaagcagtcttgccaggatagagtgggccagggtggatatatgttgggtgaatgagcttctgtctctgttttattgcaggagtcactacgaaggtacgctggccctgtatttgtatccagaaccagtcaaagccacctgtgagtcctgcatccctcagtaccaagccccagtcccccttcaggaccacccaccacacagagagacagacgtgcagggagcctgaggaagaacctgaaacctcctctactacatggagtgtttgtatttccatcaggaatcttgagcaccttgtgccgggtcttgaggcaggaaggggccacacagagaagaggagtttcttccctgaggtcagcagtccatgaacgaagggatcagggacttgagcagcagattctgaagcaacacctggacccaggaggcccctgagcctccagcagcccgcgtagagtggccaccagggggcagcagagagtaacctggcagaagcacctggagatggggtgggcctgggcatcagggagatgcccacatgcagggagggtcggtgaccatgacctgagatctggagggaaagaggttcttcttttcttagagtatttgtccttgacaccgatgtttacattcttctggcttcctggttctcagatctgactcttggagatgatccttatttttctgacacacattcaggcactttgcctcttcccatcgacctggcccccatctcactgtcacacatgccatcccatcctgtagtcagacgtgtcccacctccctgcctttgctctgggagcccctgtcctgcagacacagccacttctccttccctggccacccctcaacgtccactgtccccggtctttcctgactctgttctggggaacctgccaattcgtagttcttgatttccttatgagacacacaatacttactcattaatcttttgttgacttaagtttttatccattgttacattttcccagcaacagaagacaacttagttataataaacacttacttcctgggtcttggagtttgcagccccctctcattttctcatgaagcaaacatttccttcacctcctgatctgtccctggtcctgacagcaccctggtgatactgaggcacagcacccatgacctgacactagaactcgcagccaaggtagaaacttaccgcatcccatggatcttccaaaattctatgtgcccttggcaaccaagaattgcattctcctctagcacagaggagctgtgccctggaatggggcctgtacctgtccaaggcttgtgccgtcccctgtgggagatgagaagcgtccctgcattgggctcttggggacccgtcttggacatgagtgagaatgaagagggtccctgcattgggctctggcatgtgactttaaatggatttaggcctgtaccagacatctcatgtctgacataaaatatttacaatcaggacattactagagaagcagaaaaaagctaaccacctccctcctgagccaggatggaatgaaggaggggactgtggaccccagataattcccctgtcaccactgtgactctaacaacctcttaaatcacggccaacatctatcccataggaaggtctttatatcccctagaaaatacagaggaagtcagctctgagcttttccacgaccaacccagccaaggagcaaggctgggcacaacctgggtaaagatgtgagcccagaccatgggaccagtgggtgaaggaaaatcgcatgggctgagggggtgggtaagcaggggccagccctcctctctctgtttcctttggggctgagtccttctctggaaaccacagatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggtgatccccccagggtctcaccaacctgcccagcccaagggttctgggtccagcgtgtccttgattctgagctcaggagggcccttcctgtggtgggcaggatgctcatgaccctgctgcagggtgggaggctggtggggctgaactccccccaaactgtgctcaaaggcttgtgagagcctgagggactgcacctgccaggagagagtagtgagttttcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctcttatttatttatttatttatttatttatttatttatttatttttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacggtgacacaggcagatgaggaagtgagacaaaaacaccctcccagcctcggtcaccctcttgctccagccccgggaagcctgttgataaagccatgagtgaatctggcccagttcacctggatctgagcctttcaggttgcccttccctccagccccctccaggagtctctacagaagatacatcaggcataaatatggcctggaagggccagaatcatctggtgacttggggctgttgtgtgagttagagaatgaaggcttgggtggaaagacagacagaggcaacctctgtccactgtcctacccctggatggtcatatggtggggacagggcaagtccttagaccaactgtctggatcaggccccagaactactgcccagttctgctgaggtcctggcccccaggctgtgtggcagcctgtgattcccaacagagcaaaccagaggaatggacactgtgaagtctgcccagatcccctcctcaatgtgacccacctggcactgctgagaagcccagcagctcagagctgtgccctcactgggaagtgctgttggttgcagaaagcttcctcaagtttgtgtcccttttcagaggggttcggtttaatcaaccaagatctcaaatccttgcctcaatttaagatgccactgaatgaagggcctcccagctccagagctccctgtgtggatacctgaggcctcaatgtcaactccatcacgagtcagggtctccttctgccccgtgttgcctcccccactcccttctgaatcttctgtgcatggacatctctattgcagagttagcttccagagaaccccatctaagatggccagctgtccccaacatgggtcatcagggacctgagtaggccactataaactgaaaactctggtttctgtccaaatttgcagagtaaatgttgaaatgcccaatctgatggttccttgaatttttatggaatgaaaagggagcctgacatgccaggtgctctgggttgagggattgttggagtcagatctccctgcaggaaagcccggggcagggggagcagcctcacccctcacaggaaccacagatacacccacaaggtgagctgcaggatggatgctgcccacctccaccctccacatcctctgtaaatgttgctcctttctacaactccaaccagatatgtagatgtggcgaactacgtaaaatacggatcattcatcacatcaaaacccactgcaggacaccctggtcaacaaagaacccaatcacatccccatcaactacatagtttccaaattttccatctccagaaaaataacaataacaatatacatgaaaatcgatgtaatttatctcatacataatttcatgttgataacgtgaaaatgatagtattttgctctactgaaataaataaaatatatatatatatctgaatttatttgtcttatcttttcatatttaatgtggtgactagacactagggggtcacaggaggatcgtgtcataccactatgggacagagctcctcacaactctttcaggtgacaggtactgttgagtaacctgctgcaagcatccccatctccaccagaccatataagtgtgaacccaggaagaggcactggaacaatagagagaaaaacctgcttgtgcagaagacggtgcccttgagccctgctcctgctccatcctacgggtgccacattcatctcatggtgtaatatttcgtgccctgcctgagcttatgaccgaggggatatggcaggtctgactgtgtggttactggtgtctcatgaggttctggatgtaacaaagccctcgaatatagaagaggttgttttcaaaaggaaataattatctactgcacatgacatagacttgttgctaaatcccatgcgtctacactaggattctcctctgaagccttgccttaagcacaaggtttcagttcctatgtccagttcctctattatggtagagtctgctagtttctctggcccaatagcaggacactcactcccccacctgcacctgctgcagagcctttctactcttggccccaaaacactgggtgacacagttctcagacccatgatttatagtgtcagtattcaggcctcaggggtccctgatggcttctctggctccaagtctggaaacacagcctccatgaccatctctgggttccaggctgaggatgaggctgattattactgcaactcacataggagaggtggcactttccaccgtggtccaagttcatggggaattgagacccaaacctgccctgggctctcagcctctctcttgttctgaagatgcttcctcaccctgtgcaaggggcttcttgcagcactgccttgagaatttcccctctcccagctcctctcctttctcaccaggaagtccaaaaggaaacctgctctgtgatttctcatccaggacagtgacagcttcctgatgcttgtgtgctgtggtccctgaatgtgcaactcttcctagctcttcaaatgcaggcacatagtgagaaaagctgcctgactggtgcattcactgctgtttttaaggatgtcctcacccaaaatgcatcctcctcccaaattgtgaagaacaatctggacagaggtcattacagggagtttcaagaaactgcatcttattcaattgtgtccaccatggtctggtaaagatggccctcctggatggactattcctctgcatgtctgtcctgaagcagtgaccactgtgagaagatctgaacatgtttgtgaggtattaaggacgagaggaaactgttgtttttattattcttttgtttttgtttttgaaacaaacttttgctttgtcgccaggctggagtgcagtggcagaatcttggcttactgaaatctcagcctcccaggctctaccaatgctccctgcctcagcctcccgaagagctgggataacaggtgaccaccaccatgcctggctgatttttgtatatttagtagagacgggatttcaccatgttggccaggctggtcttgaactcctgatctcaggtgatgcacccacctcggcctctcaaagggatgggaatacacacaggagccactgcatctggcagtgttttttttatttttgctcctcctctttgcctcaatacctcaggttgctgagctggggagattttgcgtgacaggctcagtgctccctcaaaatcctcccgtctcaattcgctggggccctgtcctggaaactccccaaaagtggatggtgtccctataggttgggagtttccaaaatggccccacagggaagagttaacgtgagtccattccttcttcctcattgacatccagcatttgtaatttccatgggtgtcaatacttttgtagctgaaatctttcttaatctactaaaggtgagaatgaatttaataaatattcagacattagttgcatccaatatttaaattttatgagtcaattggtagacatagccattattatatataatttaggcttcataaactttgattaaataggttttattaaaaacaaagtaaccattttattatgtgtttagactatatcaacatgttgtgtacctgaaatatccacaagaaaatatatttcaaaaaccaaattgtatttattgtctattgttgcataaaaattgctccctaatatttagcatggtaagagaacacgtgtttgtgatcttgtcacttcggtgcatctggaattgagagcagcttagttttgtggttctggttctgggttggtcatgaagttgcagccaagctgtcaggccaggctgcattcagaggccagagcaggtggccaggcccagcctgaggggcttccactgtccctaacctgtttgtctgatgtggaaaatctcagaggaaaaggagagagtgaagtgtaaggcacctgtcccagtcccccttgtcaaaggccatcccatacctgcaccatttcttattctttcctggggcgtcataggcatagagcactgcccattcattctaacgctgtagagtattctgtagtaggattttagccatgcagcctctaatggttatcaccatgattttgatcttacaaatcacactgcagcaagcatccctgtgcagactcctttgagttcatgtgtgcatatcaccataggataaatttccagaagtggaattgctgggtcaaaaggatgtgcatttttaacttttatccattgttttcatattcccctccagttctaccagtttacaataccagccctaaatattgattggaattcattggtgaaagtgcaagtttgtgccaacctatcagatatacaaagttatcttgttacacatttatttttgatttctcctattttgcttgaggttgagcatttactcaaatatttcagtgctcattatgttttaggatttggtaaaccgtttcttcaatgcctcggtaagaggtattttagtctttgccatgcacaagacaacgttgggataatatgtatgttctgatacaccatctacaacgtaatcattaaaacatataaaaaccactatcagttctggggccattaaaaaaattggtggcaggccagggatgtcccacaggatgtggtttaacggtctctggtttctagggttatttgaagtttgaacattgcacccgcatatgttctatgtggagatctctttgtgagggacactgtaattcacctcctctaggggcctgaggtctttctttggataagaacctacctgtaccatgtgtttgattggatcttgtgtctgctcaagacagccctgtgtcacaagctcatgactttcatcttcatccatttgctctgttttgtgagagcttcagtatatcaggaatagagattcctccgaggtgaaaaattagaggcagagggaggggcaaatgggcaaggaagcttgcaccaagtcgggagtgatccagtgtaggctgagagaaaaaaggtcttaaaatcagccttgtagctgaaaccaaaaacacacaagatggttggtgttctgagcatcattaacaaatgataaatgaagttgaacttttaaatgtattgcaaatttttataaagcaagtagatcgttaaactcagaatgcaacaatggaataaagaagagagtttgagatgtttttaaaatttatttatttatttatttatttttgagatggagtctcactctgttgccaggctggagtgcagtggcacaatcgcggctcactgcaacatccacctcccgggttcaagaaattctcctgcctcagcctcccaagtagctgggattacaagctctcgccatcatgccaggctaatttttgtattttttgtagagacatggtttcacaatgttgaccaggatggtgtcaatctcctgacctcatgatccacccgtctcggcctcccaaagtgctgggattacaggcatgaactaccgtgcctggctgagtttgagattttaactgtaagtcctccaactaagttgccatgacaagaacagggatgatgagagtggaaatatgttatcctgcaaattatcgttttatgtaaaagaatattttccctcttttaggtaaaggaagcatcttctggagcaccttctctctgactatcaaagcaccattaagccacaaataaactgtaacatgaagtaggaaacaactgcccttttatataaccattgagaggtggctttatatgcataccaaaatgttgatgctcaatgctaaaattggatttagtaatttaatatgcctacaagaaattaattttctttggattatattatttctgtgtacgatttatcttagttaacttggaaatattctgctctaaaaacaactcttgttttttgggttatattttctgtatcaactatagctcttttccaaatgctgtcagagatagcccatggctactgatcacaaaattcaattttatggcatttaaattattctatactctaaattattttaaaagtgcacagatgtgaatttttcacatctgactcaaaaatgttgctgatgttgactcacttttttatttcaatcttattgaagtaggagtttacttttctggaacctggatgataacaggagactggagaggaaaccccccaaattgttttcctttaaaccctcaggatgaatcatcctggataatcacccacacttgatttgggtgatatctaaatgagagttgggtcttagagtaggtgctgagttagtttaggacttgcgctgttggaatgagttgaatgtttttacaagtgagaaagacatgagttttttggagtccagagggtggggggttattggctgaattaagtcccccaaaatgtatgcattgaagctgtaacacacaatatgtgactgaaattgtgcatagggtctttaaagaggtgactaagtgaaaatgaaaaaattagggtggattcttctcaaattggactgatgtcctcctaggaagaagaaatttgcacacacagaaatgaggcaccagaggtgagcgtgcagagaaaagaccaggtgaggattcagcaaggaggtagcaacctgcaagccaaggagagagtcctcaggggaaaccaaacccactaccacctttatcttgggttttccagcttcagaactgtgagaaaatatgtttctgccatttcggtcactaattctttcctatcttcttgtgggagctctagcaaaaacaagagggaccccaaagaccttggatgagggagaaggaggagatggagcagggtgcaggaggcggtgcaggaaggggctggaaggtcgggctctgaggtgcatctcctgggtggaatcttgactccactccctattgtctggaggacttgggaaaaacatttaacctcctaatattcactcactaataaagatgggcttgaagcacaaggctccccatcatcctattctatattacaaaagtcttcttgaggtaacacttgtaaaactctcgctaatgcatctggcatgtattatggactcataagtagcccttctgagtgatctagtgatgtgcagaaaatggcattcatgctgtgtgcaccagggggcactgtgaggtttagtctgaggcccctaatgagtccaagcccctagtaatgctcaagggcgaagagcctgactgttgcttcctatgaggccccttctagtgggtaaatctgaaaatgcacttggcccttcttctgatcttgagaaattactcagagaaggccatcaggctcagggctcagacaagaaccaggacaaatgttttagggaatggagaacagatttgcatccactgctcaccagagccacctaacgacgacacaagaataaaggaagtagatttgcatgaagagacttcccttcctatgataagagaggcctggaggttcctccttagctgtgggctcagaagcagagttctggggtgtctccaccatggcctggacccctctctggctcactctcctcactctttgcataggtgctgcctcccagggctcaaccccatattatcatgctagctgtgccaacctggccctgagcttcggctcaacacagggagtagtgtagggtgtgggactctaggcgtgaaacccttatcctcacctcttctgtcctcttttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatctcacattgacacagacagatggggaagtgagacagaaaccccttcactatctgtgtcatcctctctctccagccccagcaggactgtgaacaaagccataaacagggctggcccagttcacctgcatctgagacctccaggctgcctttccctccattcctccaggtaggctctgcagaaggtgggtcaggatgatgtgaggcttgaaggaccaggctgttctgctgttgtttagactgagtgtgccttgcctcaagatgacctgaatggaaggaccacaagaaggagatgggcagctgttgagtggtcatgatccctggagttcctcttgtgtggtgactggatctaacacaatgcctgtactttgtggcccaaatgccctggattattggtctgaactccccatgtttaactgagaccctcaagccccagctccatgcatcctgatgttctgaacaggaaagtcttttctagtgagcactgtggcatcccttggcatcccagcttcacacagcaattccccaccaaaaaatgcctttgagtgcaaagaacggcttcatgcaaagatgtgcctccttcagaatgtagttcaggagcaataactacctgatgccttaatcccaaagccatattttaatttagaatgaccttgaaatgccttctagctgagcagtcagttgtaacacattcccagtcacgcctcccacacttctttcctgacagtatgtcatgaaaccctactgcatggaatcctgcctcttagagtaggattccagggatctcaaaaattgtttagaaatgaacaaaaacagtctagttggaagagtatcaaagaggaggcagttgcacatgcagagaactctgaggtctgcaaatatacatgaactgatgagcacttgtgtgtaaagaaacacctccgaaagagaaaagaaccacgcaaagactcttgagggaacacctcacagagctcactcccacacacacccacccacgcactcacagacactcacacactacagtcacagaggaaaggcctgacttacagggcatgaggttgactcatcagaagagctttgcctcagtactggggaaaaagtcaccctagacaaaatgctgctcaggtctcaactatgaaagtgtaaaagcaaacagaaaactcaaactgtttttctgaacagtaaagtaactttactgaattcaacaataaaagacagaaatagagaatgaactgcaaaagaattctcaacccagcaggaaaaatgcacaatgccttcatcctgtcaatatttcctgcaaggtaaccagaaaatatatgctatatcaaacagagaagtgaatcaatcccaaatggcaataaaattgcacacatgatagaccttgtaggcaaggatatgaaagaaattcttataactctattctattctacttgttcttgaggatataagattgaaaaatcatattaagtggatacataaaacatataaagacagacgcaagttatactcttataaatgatccataatatgtctgcaataaaaaatacactgaatgagactgattgcagattggattctgtgaaagaatagatgagtgaacttgaagatatggcaatggcagctattcaagacgaagcacaaaagcgtaaacagagtatcagtgagttttaggacatcttcaactgcctaaattggtataatgaaagtcattaaaggaggtaagattggacagggaagagaaaaggcagaaaaacaatttaaaggaacaatgaccaaaatttcccaaattttgtgaaaactagaaacctcctattccaaaaagtttaacatgtcccaaagacacacacacacacacacacacacacagagagagagagagagagatagagagagagagagaaagagagaaagggagagagagagatacaggtgaacaacaaaatgacaagaacaaatttggtttttaaaaatttttttaattttagtggcttcatagtaggcatatatttttattgggtacacgagatgtttcaaaacaggcatgcaatgtgaaatagccacattatggaaaattcggtattcattcactcaagcacttatcctttgtagtataaactattcaattacactcttttagctttataaaatgtacagttaagttgttattgactatagtcatcctgttgtgctgtcaaatagtaggccttattgattatttctaactagttttttcttacccagtaaccatccccaggtaatagttgatttcttattagaagtaatgcaagcctaaatcagtggagttacatttagaaaatattaaatgaagaaacttactacccaaagcaatctacaaactcaatgcaattcctatcaaaataccaatgatattattcacagaaataaaaaatcctctaaaattggtataaaaccctaaaagacgctgaatagccaaagcaatactgagcaaaaagaacacagctgaagatatcacactactagaattaaaatatgctacaaactatagtaaccaaaacaggaagttattggcatgcaatcagacactgagaccaatataacaaaatagaaaacccgtaaataaatccatatatctatatatagctgactttcaacaaagatgtcaagaatgtacactgagaaaatggcacaattttcaataagtggtgctgagaaaactggatacccatctacagaacaatgaaactagacacttatcctctccacaaaaaaatatcaactaaaaatggattaaaggcccaaatataacaccccaaactataaaactactagaagggaacttaacataggggaagaacaaattctttaggacattgttctagataaaaaattatatggccaagacttcaaaagcacaggcaacaacaaataatagagatatgggacatcattaaactacaaagttcctgaaaagcaaaggaaacaatcaacagagtaaagacaacatgtagaatgagagaaaatatttgcaaactgttcacttgacaagggcctaacattcagtgtatgaaaattttaaaaaaactgaaataactcattagcataaaaaaactaataatatcattaaaaatgggccaagaatttgaagagacttttctcaatagaagatatacaaatggccaacaggcatacgagaaaaatgttgaacatcactaattagtgagggaatgagaatcaaaaccccagtgagatacaatctcaccctagctggaatggctatgatcaaaaagacaaaaaatgcaaagctggtgaaggtaggtgacttcacatttctctagtccgattctctgggaacaatgagagtgctctgtctttgctctccctctagtaactatttttcacacgcaaaaatatggaccctagtgggaaataatgcctaagaccaccaacaccttaatcatttgttcatcacactagaaatgaaactgttttccaaataatattaacatctatctgtgtctatcgccattgtgtcaatgtctgtgtgatcctataacatttagaaggcctagaagaatgcccttgctttttgcaatatgaaaatggccgatatcatagatgatatagatatagatagatagggggttgtattttgaaatgtatttctctaaaggacttctttcacttcaaatttgaaattattcttgttttaaatgtcacaaatgataaaccttatagaatgataacacaattgtatgtgttataaagtcacagggtctatcaaatgatgaaccaatcattcggtgttgaggttagtagtattttttttatttcgattctcactaaatgagaacacgttttgtattgaggggccatgccctaaccataccacatcgtggggttgctcagagactgtgaggttctgcccacactaagccagaaggagaattttattcctaagccaggatgagaattttattcctcacactgctctctgcacttgtttgtatcccataatatcccccaaaagtgagcatgagaagttcattttttaagctgcttgttcattctcttacatttaatacatgtaccaaaaattgtcttcatttttaaaataaaatgttatgctatcttgtaatctataaccctatagaataatcttgatccatacacttttgctatcacaagcagaacaagatccacttcctctctctgggataaatcccatgaccgctgctctttgagcattatttttcttaagttattttttaaacagaaatttatctgacttaccttaaccaaatgtcttttcaaagtaaccgcatttcttttaagtgaaaaattaaatagttaccttctgttatcaagaattatctgaatacaaaatatttattgtttcaactttagaaggaatgaaaaacatctacaggttactaatctaaaaatgcaggctctgggtttctatggtgttaacatgtcttccaaattttaagtaacaggtatttaaataacatgaactttgttttcaaacttagaaaatgtttcaaccttttggctgggcatggtggctcaagtctataatcccagcaatttggaaggacgagctgcgagttttgtctgatcccaggagctcaagaccagcctgggcaacatgatgaaactccatctctaccaaaagttataaaactttgccaggcatggtggcactgcctgtagtcccatctactcaagagactgagatgggaggattgctggagccagagaagttgaggctgcagaaggtaaactgtagaggctaaaacatgataaatatttaattcatcacttaaaagaaatgttggttacattgaaaagaaatttgattaatgtaattagatatatttctgtttaaaaaataattgaagtaagccctgttagcaccactgcattccagcctgggcaacagagcaaaacctgttaaagaaagaaagaaagaaagagaaggaaggatgaggaaggaaggaaggaaggaaggaaggaaggaaggaaggaaggaaggaacgaaggggaaagaaaaaaaggaagaagatatttcaagctttacagtaccagagccactctgtaatcaataagcaacaggaccaaaacagaaagagattctgtagaacagtctaaccagcgatacaattatacatttctgttcagatatcaaaaccattttcaatagtaaatatatggaatgaactccccacagagatcaagtaggatgtatgatgtgtgaatgaaattatgagttgagagtaggaaatttataaatttaatcaaacaaattaaagcattatgaggaagttgtactgctaatgtattacttggcaagctgttcagtggaacaccaagatattcttaaggaagttgcaaatatcttttaaaatgttatcattgaagtggatttttaaaaaatgaggacatgaatacctttacaaagtattcagggataaagagagaaaaataaatttagattgtgcatacatatataaaatttattttaaaagataagcttgtcttttttatcccttaaataaaaggagcagatatttaaattccttgtcttttattttaaaatttagaaaatgcttacagcttcccacactgaaatttatactaagacagataatctaatcaagggataacaaaatcaaaacagaattctcttgatgaatctattttcttgatttttaagtctcagtgtgtactctatagtaaaactatttataattgattctgctgtttgaaaatatttactgatcgtttatcttgcaccaagtgatctccagctctgaagataggtcagtgggaaaacatacaaagttgcccagcttcgttaaacttaaattctaatgaggaaaaaagaagtaattaatcagggactttaaaacaggagtgttgtgatatggcttggaattctaactgcttcctgtgcttgctgtgtggagactggattgaaaaatagggcgatagaagcttaaattcatatagaatatggctagcctgtattttgagggcccctgaaataagaatgtatagtagttctcattatttcctcaagaaatctgtgcagtagagctttggccttgggagggaagtactatagtcaccaagtggtgagggtgggaaggtgaatttgcaaataccacttggaatgagttcactttaaaggtaaagctggcaggattttcatacatgtcagatctgaaaaaatgtgtgtgcgtgtgtgtgtgtgtgttatagagagagagagagagagagagtgaaaaccagacagataccgagagagaacgacagatctgcagtgacagagagaattaaaagcggacaccacgaatattgagctcagaaactataaaatgggaggtgccattaaacagaatggggaagagcaagtttgaggagtatcagtggctccatgtggacttattgattttgacattcctaacagatgtccaaatggagaagtcagacagtgttgtgcgtagtctagtgttaaggtatcaaagaaaatatcaggaaatgagtgacacaaaaattagtaagaaagcaaagataagaaacattagtcaaagtcctgagtccagtggttatctaacacccaaaaagtagtaggccgggtgccgtggctcatgcctggaatcccagcactttggaaggccaaggcgggcagatctcctgaggtcgggagttcaaggccagcctgaccaatatggagaaaccctatctctactaaaaatacaaaattagccgggtgtggtggctcatgcctgtaataccagctactcaggaggctgaggcaggagaatcgcttgaagcagggaggtggagggtgtggtgagccgagattgcatcattgaactccagcctgggaaacaagagcaaaacttcatctcagaaagaaaaaaaagtgataaagacaagaagaaaccagcaaaaaagtactaggggtaattatcaaaaatgtcaaagggaaagtaggttaagtgttctggaattctctcaaagaaagttttgaaaaaaggagggaggaagagatcaactgctttcaatgctgctgatacataaattaagacaaaggctgaggaattatgcttcaattcatcatttaacgatatggatattgtttgtgctttgataagagcaattttcttggagtgagtaggtgagaaaccatattggagtggtttctcaaaggaatgcctgatctctggattcttaaggaaactttttattgaacagtggaggcacaaattggatttgttttaattccggggtcgggacacactctaaacatgtgcctctgcatgcctcgcttattacagctaggtatcctagtatctttcagtaacagaataatcacctgcaaaacccacacccatttaatagacacgctttacaaagactgatactagaagttgttggagaggatgtggttccacgtaatatcttatgagtcactgatgggcaagtaagctggtaaaatgtctttggaaaactcactatacctgctatactaaaacattcagataccaaacaccagaaattccatattgtaatatatttctatgagaaaaaaacaagagccctgtattaaaatatagattattattaaaaataatcacactgggtttcctgatttttttattagcaagtcagtctctgcctgattcaatagtacaacctctatctaatatatatatatagtgtttttaatcaaccactaagaaaaagtattatattttatatcaattctacattcagtgccgaaaccagcattttgtagattccagagatttgttgaataaataatgaataacttaaataagttaatatttatagtatccatatacaaataatacatcatctcagaatacaataataacgtttgttatgcagaaaatgatttcaatctcagttaaaaatattttgggcttaggagttactgtcatatatggatgctcacattgttttgtttatacgaaaatgtttgtagttaacgtacgtttttggtacttaagccttttgttcttgctgccatagcaaatagtgtgcctattaggaacaagaaccagaggtttacttcatcttaacagatttcttaataaaatacatgccatactgtttggtttaatgcataagcaaagagtcattcactccgccattgctacgtgtccctcctctaatacggctcctgaagatgttaccgatagcagaggactttgtgttcaacctaagcactttatagccctttcactttcaactaagtatgagataaaataattcagcaccaataaaacaaacacttcttaaatactgaccctttttttgagcctgtttcacgttacgcagcaagacagagtacacttctctttcccagcaaatcagtgttggcactacaccctctacactctgaaaacttgtattattggcttccttagaaacacaatttgagcttataatttagatgtcatcaaataatgtacaaaaatatgctacttccttccccttcacttctcttctcttctcttcttatcagataattgtcagttgttttttctctccaactcctttcctccgactacctgatttttaaaagactttctgcacatttccaatcttagtattgtagagacaaaatgtgtggtcaaactgcatatataggaagagctgaattatatgcaagcatttttaaatacacaattcctcctcagttttctgtgattatttcatataatcaaatgtcttccagatacacatcccaaacgagtggttgtcaagctctgctttgtggtctaatttcatcagaattatccaaaattcttatgataaatacagataaattgacataactccagatttatgaaatcaacatttccagaacccaggaatatgcattgaaaaagtgtattcctcagatgatgctgacatgatacgggatccgagtttacaatgcaaggaaaattaccttccttgcccttcagctgacccttgtatccagaggtcctcttcccctttcatattctgccctctctccttctgcacctttctcctttcctccctccagttctgctcatccagatcccaagccctcccccatggattccctaaacctcccaaatggtcagttgccactaaagttccctctgtctcatgaacaagttatgtgggcaaatgtaaaatttaagcttggaccaagctgactcaagagcggcaattacaaatttccctaaacccagaggggaccagcaaacacttgtagaagattagagatttcctgtgagtgcaaagggctcagagtgtcctgatgctgtagaccaaatcttactgtcccctccaattcatgtgttaaaatctaattccctatgtgatgggatttggaggtgaggccttggaaggtgattaagtgatgaaagcagagaacccgtgaaggggatcagtgtccctatcaaagggacggctgagaactcctcatcccttctgtcatgtgaggacacagtacaaagatggccgtctatgaaccaggaaggaagccctcaccagacacaaaatgtgctgaccactcactgctgactccagtgagtcagaggagcgcaggccacatacctgggtctctgcctccatgcctcccacagtgcccagggctgagagcagagtggcagctgctgactggggctgtgctggccacctgctctcttctacctcttgctcaagccatgctttcagccccatggctgaggccagtggctagagcaggtgccatgatgtcaggcagctccttaatgggctggtccttggcaggaccagggcaggggcaggagggctctgcagctgcctctagctccagttctgtccctgaagggggctcttcccctagtgctggcactggctcatcagctggtgctggaaggtcctggattgccgcacattgagcaggagatgaaaaagaagaaagagtcaccaatgtcagtcactttccactggaatttccacacacagaatcagcctcactgaattaaaggaattccagtccaaaaacactgcccccgcaaagtctccaaaactacaggccccccctcaccatgtgcctgtgcctggaggaactccagaggctccagcaggccaaggacaatgcacggatgtggcccggatgggatcaccagtgaggcctggcctcgtagggcctgcccagggctgtcctgtggtacctgggtgcgccttcggccagaggtgcctggggtgaggaatgagcctgcatcggcatcatgggaaaaggctgtcactctgggccctcctgaagcaggagcctcaagatatgcggatgcagcatgagaacatcttgctctcctgagcatctcccaccaagggaactggctgcgggactgtctctaggatgtgggtgcctggttaccagaattctaagttctgtgagggtatatcaccaaggaagtgaagtcacttctttaaggttccgtatcctcagccccttccttccataagacctactcagaaccccctgggctgctggctgctcaccctccccccaggccagatccttacctgtacacaggtaagtccacccagggcctgcttgtacacgtgctcctgatgtgcacctgggacctaggaatccacttagggcctgtgatccaacaggggcctaatgttgtttaaaagtaatttttattattcctacaggaaagaaaaggccttctagcaataagaagcacagtttcacatcaaaaacataaaaatgatcaaaatcttggggaagaaatgtatcaattttaatcactgaaatgttaacttttgataaatatttaagtttataaggaaaaataaaaccatgctgataaaaccacagttgtagggaatgctatagagtttctcctttgtggtttgaacacagaaaggtcccacctagttaggctcataattttctaccttaatcttcttgttcttatgattaatggaaaaaataccatgacaatgatggtgatgatggttcaagtacacactgaggtttagtgacagaaacatcaggtgctcccagttacagtgcagctgttcttattggggtgggaaaatcaatcttgtgttcagtatacacgggaagcaggagtacatgtggatatgaccacatttcactggacttatattttaaacagaagatctacagtttattcttcaaaaaataataacacttgccatgcaaagtatatatataagatgtctcaaataattgtacttacattgcatatgaaagtgatacattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacaggggctgaggagtgacctggtgcaggaagccccatctccatccataggacattggtgtgaacccagggagaggcgctggtgtaagagagatgagaacacaggtgtgaaccacctgcttgtgcaggggactgagccttcacataagttgacacttaaaaagccaccacaccccacccttgtcaacaggaaacccattcacatctccatcagccacacaatctccaagattcttcaaaaagtaataacaatagccatgcaaagtatatgatatatatcataaataattgtacttacattatatatgaaaatgatactctttttgatatgctaggtaaataaaatacattatttaaactcattgacttcttctctttgtatttataacatgacaactagacagtgggattcccatgaggctcacatcatattgtgattgaacaaggctggtctgcagggcttcaggttacaggggctgtggagtgacctggtgcaggaagccccgtctccttccataggacatcagtgtgaacccagggagaggcgctggtatgagagagatgagaacacaggtgtgaaccacctgcttgtgcaggggactgagccttcacttggagccaaagttttctttcccaggttcaatcctgaacaagagggccttctggacttctttttgttttcaggcttgtgccccttcaggtttggggctgtctggatcccagccaggggacactgaggaaatccaggagtctcacactgactgttctatttcatctgctggggccatcccaaactgctgtgtaccatttcctttcctggtgctcaaatagctgctccatgcccttgtcatggtttcagagatgaatctaggtgggaagacaggacagtgtatgttataatatttaaatggaagctgaatccattaatatttattttaatatgaaacattaaaagaattttgtcataagcaatgaggaaagaggaaaagatattcaagttattttgagaaaaaataaaaatgtatttatcaaatgtctgtgtgtcttcagtgtcgcagggttgagagcagccagctttaggttgccctgaggatgcgctcagatgggaaaaagcgagaaagcaggaaacgcgtctctgtgacctgacagataaatcacagtaatggaaataagtctttcaataattcaaacattcacaataaatatcactctgatgcacacagaaaggcctggtaacaaactttccctttgacctgctggctcatatccccatggatcacctgtgtgcagagtggactctctggtccccatttctcaggctgagaactagaggctgggaaggacaagtggcctgctcatgagtgggaagggcgggattgggagcagcagactcgggctcaggactctggccctggtcagtgctccttgttccctccacagggtccctcccacatgtgcccgtgtggatgtgggtgcactgcctggggtggctgatgtgctccagggattcaatgcggcagatgcttcagcaccaaaggtagggagtagggatgggacgaggctgcagctgtggagaccagggacccatgatgcccagcagaggtttccacggggtgggtagccccatttcctgacagtagagacagcctagaggtgggtgccaagcagagggcactgtgccatgtgcccaggcctggagggccacagagacacaggcgccacacagcagagacactgagagccaggagctcactcaggtaagggatgtcagcagatctttctctcctgagcaaatcaggtacaaaaaaattaagatcctgccatcagaatagacaaacagggactttaatctcctcggctgagccccgctgtccagggaagaagaagtctctgagcccaggcccaggtgagggtggagtgaggagaggagctcagggtgcagatttgcataaaggccccgccctcctctgaggcagaggggataagacagggctggggtcaggcccagtgctgggatctcaggaggcagctctctcggaatatctccaccatggcctgggctctgctcctcctcaccctcctcactcagggcacaggtgaggcctccagggaaggggcttcggggacctctgggctgatccttaactcctgctcctcaggctcacctgggcccagcactgacttactaaaatgtgtttcttcctttttccaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttccacagaggtccaagttcctggggaactgagaccaaaacctgccctgggctctcaggccccctccttgctctgaagatgcttcctcgcccagtgcaagcggcttcctgcagtgcggccttgagaattcttctctctcagctccttccctttccaccatgaattccaaaaggaaacccgctctgtggtttctcatccaggacagggacagcttcctgatgcttgtgcgctgtggtccctcaatgtgcagctcttcccagctcttcaaatgcagggacagtgacaaggagctgcctgagtggtgcagtcactgcttttttcagggatgtcttcaccctacatgcatcaccatcccctacactgtgggtagaattttagcaactacattctaatggttatcgccacaactttgatcttaaataacagtgcagcgaacatccctacgcagactcctttgagttcctgtgtgaatatgaccacaggattcatttctaaaagtgaaattgcaggtcagaaagattgtgtgtttgtaattttcacccattgttgtcagattcccctccagagggattgtaccaattttcaatgccagctggaagtacttgttcagagtacattgttgaaagtggaaatttttgccagcttatcagacagaaaaatgttaccttgttacagttttatttttgagtctcctgttctgcttacattttggccctttcagaaatagttcagtactttttctttttttaggatttagtaaactttataaaaaatatccagataaggagaattttagtgtttgtgggcaggcacagtggctcacacctgtaatcccaagcacttcgaaagagtaagacaggtgaattgcttgttcccaggagtttgagattagtctgggccacacagcaaaccctcatctctattaaattaatgcaaataaaaataaattttaaaaagaattattttagtctttgtggcccaagaatcaactttagggatattacataggtacttataacatcatttacaatgtaaccatttaaaaagataaaaatcactgttatctctgggccatgcaaaaacagttgtcaggccaggagtggccacaggatgtggttgaacggtccctggtttgcagagttatctgaatgttgaaaattccaccagcatatgatctaggtggggatctctctgtgagggtcactgtatttcacctcctgtattcggctgaggtctttccttggataagaacatgctcacatcatctatttgatgggctcatgggtttgcccaagacaaccctgtgtcacaatcacataacttttatctgcattgcttgttctgagttttgggagagctttaatatatcaggaatagactcctcctaagggaaaagtctgagggatatggatgggcaaggggtcaagaaagcttctaccaaagctggaatatccagggcaggctcagagagaaggatcctaatatcagcatttgactgaagccaaaaccagaagagaacatggacgttctgagaataataagtaaataaacagtttaaattttaaatgtattgaatattcttatactccatgaaaattctagaacggaatttaacaatgggataaggaagagagcttgagatgttaaactataaagaccacaaggcaagttgccaggaaaagaacaggacctttttagtggaaataggtttctgctgcaaattacctttcctatgaaattggtttttaggtataaggaaacatcccatggaacattcttctttcctacagtcaagatcaccctcaccccacaagggaacctcaatatcaaatagaaaaaataatgcactttgtataaccattaggagagtctttatttgcacatcaaaatgaggatggttaatggtaacattggaaatagtagtttaatatgcataagtgatgaatttcttttgactataccatttctgtctgtgatttatctttcttaatagggacatactctgttcttaaaacaatttaacttgtgttatcttttgttctattatctgtatcagctctgttttttttttcaaacactggcaaagttattccatggttaatgattattaaattcaatttatggatatttagattatttaaattatttcaagagtggacagatgtgatttccccacatatacctcacagatgttgctgatgctgacttgttcatctcttccaacctctgcaaacaaagtgggaaattggatttttctgaacacccagatgacaacgggagaggaggtgaaacccccctaaagctgttatcctttaacccctcatggtgaatctcccatccacacttgagttggatgatatgtaaatgagagtttggtcttagagttggtgctgagttagttcaggatttgggttattgggatggagtgaatgtgctttacaagtcaaaaactatgagtttttgtgtgcataggttggagagctcttggctgaattgtgtcccccagaattatacaatgaagttctaatgcacagtgtgtgactgaatttggagacagcctttacagaggtgattaagtgaaaatgaggtcatgagggtggcttcttctccaatctgactggtgttctgagaagagaaaatttgcacacatagaaatgagacactagagatgagcatgcggaggaaaaaccatgtgatgacacagcaaggaggtagccacctgcaagccgaggagagaggcctcagggaaaaccaaacccaccaacacctttatcttgactccccagcttcagaactgtgagaaaataagtgtctgctctttaggccagcaggtctttggtatctcattaaggtagcactagcaaatgaaaacaaaagggaccccaaagaccttgggtgccagagaaggaggagatggaggatggtgcaggaggcggggcagggaggggctggaagttcaggctctgaggtgcatctcttgggtgcaatcctgactccactcactgctgtctggggacttggggaagaatcattaacctcccaatattaattccataataaagattgggtcttgagcatagggctgctcatcctcctattccatatgatgcaaatcttcttgaggtcatgcttgtaaaacactcagcaatgtatctggcatacactatggcctcagaagtggttattctgaattttctagtgatacatagagaatggcattgttcctgtgggcagaggaggcactgtggaccttggtttgaggactcagaaagacaccaagtcctctggtagtgctcaagtgcgaagagcgtcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgcggagtagatttgcattcactgctcatcagggagcccacccaacaaggatacaagaataaaagaagtagatttgcatgaagagcctctccttcctatgataagagagggctgaaggtccctccccgctgtgggctcagagacagagctctggagcatctccaccgtggcctggacccctcccctgctcaccctcttcactctctgaactgcctcccagggctcagcccccaaaggaccagagatcagcctggacctgagcttcagctcagcacagggagtgatggagagtgtggggtctgggaatgaccctcatcctcataattacctcttctgtcctctcttataggctttgtggcttcccgtaagctgactccagagccagcagtgtctgtggacagtcagcaagggtaacctgccagggagaaaacctaagaagccatggtacaaactggtaccagcagaaccctgccagatgcctgtgcaggtcatacatggtaacaacaaccagccctcagggatcccagaccgattctctggctccaagtcaggaacacagccaccctgaccatcactggggctcaggttgaacatgaagctgactattaccgtcactcatgggacaacagtggtactcatctcacagtgacacagacagattggaaagtgagatctaaagaccttcactgtctgtatcaccctctttctccagccatagcaggactgagcagggctggcccgggtcacctggatcgaagcccttcaggctgcccttccctccagccctcccggcagactgcagagagtaggtcaggataggatttggggctggcagaaccaggctgtcctgctgttatttggaatggatgtaccttggctcaagatgacctgagtggaaggacagtaagagggagacagctactgagtgctcatggtcactgaatttcctcctgtgtgttgactgaacccaagacagtgcctctactctgtggcccaaataccctggattatttctctgaactgcccatgtttaactgagaccctcaagccccagctttgtgcatcctgatgttctgaacatggaagcctttcataatgtgcactgtgacatccttcagattcccatttcaggacttatgcacccaccatccacccagggctgcagggagttcctggcttctcacagctcttccccaccagaaactgccatgcagtacagagaatagctttgctcaaagaattgcccatttcaaaatgtgtttcatgggcagtgactccctgattgccttaatctgaaagtcatgctttaatttaagaccctgaatatcaaattgaagtgccttctagctgaacgctcaattgtaaaacattcccagtcacacactccacacttctttcctgagaatgtatcctgaaaccctactgcatggaatcctccctctcagagtaggattgcagggaactcaaaaattaaaaacaaacaaacaaaaaacagtctagagggaaaagtattgaagaggagagagagagtgcacaaggagacaactctgaagtctgcaaatattcatgcactgaagagcgcttgtgtgtacagaaactccctctgaaagagaaagacccttgagggaacactccaaagagcgcgcgcgcacgcgcgcgcacacacacacacacacacacacacacacattccagtcacagaggaaaggcctgagttatggggcatgaggtggactcatcagaagagcttcggctcagtattgaggaaaatgtcgccctagacatagggctactctgctctcaactaagaaagtgtagaagcaaactgagaaaagttaagacagtttccaagtaactttactgaatccaaaaataaaagacgaaaatagagaagaaaatgcaaaagaattataaactcaacaaagaaaacttcacaatgattggcattcaatcaacatttcctgcaaggaaaaaagaaaatatatgctctaacacagagaaaaatgaatcaatccaaagtggcaataaaattgtatacgtgatagatagaccttgtatgcaaaaattttggagcaattcttataactcttctccttgctcatgaggatagaggattgattgaaggtgttaagtgaagaaatggaaggcatgaagaaaaatccaagtttaacttttagaaatggtctctaaatatctgcattgaaaaaatgcactgaatgagaatgattgcaggttaggtgctgtgaaagaatagttgagtgaacttgaagacatggcaatggaagctattcaagatgaagtacaaaaaaagtgaagagagcaccagtgaatttcaggacatcttcaagctgacttacttggtataattaaaggcatgaaaggagataacattggtgaggggagaggaaaggtagaaaagccgtttaaaggaatcatggccaaaatttcccaaatttgttgaaagctagaaacctacaactccaaaaatcttaacaagttacacacacacacacacacgcaagtaatacaacaccaatactcatcataatgatattgctaaaaaactatgataaagacatacttttaaaagtagccatagagtaaagacatggtaggtacaggcgaacaacataagaagaagaacagatttcgttttctttgtaaaattttcttcaacatctgggggaacatagtagatatatgtatttgtggaatacatgagatattttgatacaggcatgcaatgtgaaacagtaacatcatggagaattgggtatccatcccctcaagcatttatcctttgtgttacaaactactcaattacagtattttaggtattttaaattgtacaattaagttgttatcgatgtgctatcaaatagtattgacataactctgatgcgctatcaaatagtaggtcttattcattctttctattttatttacccattaagcatccacaaataagagcagatttcttcttagaagtcatgcgagcaggaagctcgcatgtggagctatatttataaaatattaaaagaaaaaacttactacccaaacccatctccagaccatgaatttctctctggatatcttattaaaatattgtctcctatcaaatctctatcaaaataccaatgacattcacagaagcagaaaaaaaattctgtaactggtatggaaccacaaaagcccctgaatagccaagcaataccaaacaaaaaaccccaagatgaatatatcacattatctgaatcaaaatatactacaaattatggtaaccaaaacaggatcaatggtattggcataaaatcagacattgagactaataaaattgtatagaacacaccaaaataaattcatgtatttacatccaactgattttcagcataaattccaagaacatacattgagaaaaggacgcacttttcaataaatggtgctgagaaagtggatacccgtatacagaagaatggaactagacccttgtctctctccgtatacaacaatcaactcaaaatctattaaaaaccccaagtataagacccaaaactataaaacaactaggagggaacgtagaggacatagggaaagttcttcaggacattggtctagacaaaaattccatagctaagacttcaaaaacacaggcaacaacaaaaactagacatatgggacttcattaaactaaaaatcttctgaaaagcaaaggaaacaatcaacagagtgaagacaacttgtagaatgagagaaaatatttgcaaacaattcaactcaaaaggacctaagatccagtataagaaaataagacaaggagctgaaataactcatcagaatagaaaaccagtaatagcattaaaaagtgtacaaatgatatgaatagacttttcacagtcaaagacatacaaaaggccaataggttaattaaaaaatgcccaatatccctaatcaccggggcatgcaaatcaaaacctccatgagatatcatctcatcccagctaggacagctatcattaagaagacaaaaaaataacaaatgctggtgacgatgtagcaaaaatagaagacaaaaccacatggtcatctcagcagtcacatcaaatgttttcatgtaaggaaacattaccatttgctgtttttctagtcttgctagagcaccataaaagataagactagtggtgccaatactgtagaaaatgttattacatgcagagaatctcactatcccataccaaactacatggattcttactgttaaatgctaaaagattacaactctgcatttccaaatgttctggtggtcagagaccacttccttgacaagtgatgagtacggtgatgtgaaaggatagttagcatttacgcaggtattgggtgaagaatagtgatatacacaggaaagctttcaaagagagaaacacatggaggttggaacacagaagagaacataatatgtctgagaaataaagaaagtccagactcactggagctgagtgagaacaagaaaaacggcatgaaccatgtatttcactctggatatctcattaaaatattgtctcctccccaacacaccaccgatgtgaattgtaaaaatgcccgttcttaaattattttttgcacatcatgacagggtcaagcatgtgaatcaagctgagtttgatgagtccaggtctgtctgatgagtccagacccaggtggcctcagaaggacttggtggaacgagggcttgttgtcaaaagtagaggaagtgagattttccattgtggcttagacaagagattcttaaatttcagtggacacacaaggcccctgaggggtctcggtaagatgtagatgcagcctcagcagttctggatgtggccccaaattctctgtgtccagcaactcccaggtgaggctgctgctgctggtcctcccaggaccacactttgaatggcttagctcttattcacccacctcactcaagccacaggtaagactcacacaaggagagcatattctagaagcacaggtcacttctcactcctccccttgtgtcttagatccttttctgttacaacaaagaagtacccaaggctgggtaatttatagagaaaataaaaggtttatttggctcacaattccaatggccacagagttcaagatatggcatctgctcttgttgaagacctcaggctgcttctagtcatggtgaaaggtgaaggggagccagtgtaggcagaggtcaatgggggagaggaagcaagagagaagaggaagatgccaggctcttttaaataaccagctctttcggaaacagtgggaattcactcaccccaagtgaggacattaatctattcatgagagatccactcccatcaccctaaaagctcccattagttcccacctccaacactggggatccaatttcaacatgagatttggaggcgacaaagatcaaagccatagcaccctgaggtttggccacgcacttgctcatctccacatttgtccctcccctcatgactggggtcctgaccactctgactcagtctccctccacttcatggacacctggcagtcggtcatcatctgttttgctgaatcaacagcagtattgggggtattcaacattccacatttgtattgtttgaaaattgcccaatcttaggtgttttgttattgctacacaaacagactaagacatttactatttaatggttacatttcattctctttttatgaaattttgttgctaacagggactttctgcttggtcagaagattaacaattgtgtctcctggttccaccagaaacagagtagagacccacacagctgaggtatggggtcatagattaaaactaagagacataagattgattctcaggctccaagtctggcaagtgagcttctttgagactccctgggatctcagcagtcagactgatcattattgctgtcccaaacatcctatgtgatatggaagtaatatcaaaaccctcctgagattcctgacttgtgtcccgacatgaagtctgttgggattcctgtcattccttcaagattgttcaaataagcagcaacaatcactctcatatgagatatgaaaagaagaattccacatgaaccaaaccctgaagcccacactgaagtctgccaagttatctgcagtccagcgcgatggagggagcattttcgtggggacttttgagagtatggagaaggcctgaggaaacgaggctcagctatgggttccagaaacaaagctctgggatgtctccccatggcctcgacctctcacgtgctacctctcctcactctttgcacagatgctgccccaggctaagcccccacaggaccctaatcctagtcctgaccctgagctcagcccaggtgatatttcaggagatgggaccctgagaatgagccctaaagtctccttatcctgcagcccctgtggtctcttagactcagctacccccagtagagttggccatgagacacctgtcccccacctgctcaggagagagtgcagcaggcaacagtgcagagagaaccagcaggagccaggccaggcgctgcattcagagcagcccccaatccaacagattctccagctctagcctggggtacagcccccaccttctgcgggctgaagtgggcttctcaggatgggcaggccatgatggggattggcagtgtgtccatgggacacagccctactgcctgcctggccctcatgccccctccctccccatcctggttaagcaccaccccaacgggcccagtttcagaactcaggacacctgggccagctcctggacttgcccccactgctctctgttctcctgagccacttagtctcttttggcctcagtgttacctgctgtgaagtgaggagccttatactgaactgaggaagctctttcttcattcaaaattaaaagacagaaaaacaacgaaagtcatgcgaattaaagcctgatgaggggatgtcacttaatgggcttcaatgggcttcagacaaaacttcttgtctttcctctgcagggattccaagaaagggactcaaaaagagcttgctttctgtatggtgggaagagcagtccccagctgagaataagcaggagagtcccagtttaatcaggaagacagactagggtagtgtagaaatcctctcagcacaaactctgagaagtatggaatgaaataaagacaaacaagaaattaatggtgccgacggtggtgatgttagctcacagctaagctgcagaaccagaaacatgcggtgatgggctgagtctcctccaccagctgggggcagcagagctgcagccaggagctttcaggagagaggctggggctgcccagctggggcaaagagaaggccagcctggggttcaacaggtgtccaagaatctgtcttcagactgaaagtgagtgcagttcatcctatcccctcaggcttcagtgaccacgctctgagggtcagacacacggtgtcaccccaggacactgacagaagcctggcacagtgaaggcctcaccagggaaatgcagctggaggaggctgggcccagatgtgagcttgggcagcttcctcaggaaggggaatccctgggaggcgtcccaaggtcgaggtgctctaggagggggtatagtgtgaggtgatggggctcccagggcccgggttcttcacccaggatggcggcctgagcctcctgccactctcagggtgtcatccctcctggtccagcagtgtcctggggagctgagccctctgtcctgggcacttccagatacacccgacccctcctccctctgcctttccttccagctccaggcggactctgactcagggggcagctcctgtactcaggggagtctcgggtgggtgtggtggggcatttgggaccctggccctggatgggcatccccagcctccttcaggagacactcttcagagggacagggcttctcacctgcctcaggccacagctctgaccatggtgctgtccacgctcagtgacaggacactgagcaggggcctggctggagtaaccagggaccacccaatctctggagctcacatgctgtgcagagaccatgaccctgggacccttacagagaccatggacctaacgttagattctcagtccagtgtggttttctgctgctttttgcaagtttacataaaatattgatgagaaaaacatgaataaataacagacaagttgacggtgctgattgctaatctcttgtggcaatgaggggtgatgtagcaggagcagcaccacgactgaaatgagaccagatgccatgttgactccacaggggtgtgtggttgcttaaatgacccaaatattcccactgaataatcagcaagtgtcctaatgacacagcacagcatttagatgaaatgaacaagaggggactgagtctgagggaccaggaggaggaagatcatgggtccctgggccacctgctgctgagtcaggtgtcatcatgatctctccacagagcccagctcagccccatggccaacctcctggaaggtccacagctctgctgagcctggcccaggacagaccccaggtcagcgaggtttgggacagtggtcatgaggttaattcccacaaaggtctatgatcacagggcttgaaggctgcagctgattttctaaccagagaccctgcttgttcctcctgttgcctgtgctgccctcacagctggtttgagagacatctctccaggaagagccacagaggatgtaaatttgcataaacgcttaacactgactgcccccgaaagcctgagagggaataagagaggcctgcggagcccaactgttctgtgggtccaggaggcacagctctgggaatctcaccatggcctggatccctctcctgctccccctcctcactctctgcacaggtgctgaccccaggcccttccccaggctcagtccccacagattccaagttgagcctgacctgaatcctgagcaaagcccagacacagcctctgggtgggactcctggaaatgggtcctttgtcttcaagccccctctcttgttcttccttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtacttatcccacagtgacacaaggagacagggaagtgaaacataaacccctccccctctatttcatccccttccttctgccccaggaggactgtggacaaagccatgagcaggcttggccaaattcacccaaatttgaacccccaggctgcccttccctccagccctccaggcaggcgctgcaaaggagtcagtctgcagtggatttgtgcctggcaggcctggcagtcctgtgtttctttgcctggggtttgagttgttgatggagggtctgactggaaagacagacacagggagacatccatgcaggcatgtccagagggatgtggggaactctcaggtctcagttcagtgcagtcattgttgtatcctctgggaaagcattcctccagtgcacctaagacctctagacccacagagcctgaggtcgggatgagagaatgtcaaatttttgctgatggatcactaaaggcatttttgagtggagccactacaatttactccttgattctggactcgtggatcctgactgtgggagaaacagcaccatctattgggcactgatgcacagcacatgccccatcctggaagacattgcccaaccctacacatacttgccacttgcctggtgcagtaatggagtctccatgcagtcattaaaccattcatataagccacatgtctcagaatgttggggacaagagtaagaatcttgaatgccaggagaaaaggcccatagccctttatttgcggtgaaacgagttccttggtcagaacctcctgtggaataccatcgtgatgggtgcatcattctgtaatccagagataacagttttggcagaagcattgctgtcaatgaaagcaaatcctctgtacatgccaatgctagtaaggaaaaagagctgtctctcccatgatggaagagctctaatgaaattaatatcaagcaggcccctggctgttttccacagagaaggtcatcctatagggatgcctgtgttggtctctgctgttgacagattgtcacccagcagtggcttcagccaggccagctccagttagtggaaattcacattgatgagcccattatcagcctctatccctgccaccatggccacatttttttggagtctgttggacaatgacaggagtggttgacggaggctgcctggtgtccatagaacaggtcaccctactcacctgattagcaaaatcacttcattttcacagaagacttagtgagtatttatatatggaaaaaaattctcatgctttttgcccactggaggaggtctactcacacatctctccccctgacatatttgtgatcagtattcctgttgtatctctcccaagttcctgaacatccttgaccatattccaggaccctgagtcacagcccatgaattaggaacctctgcccatctctttgcaggtgacatgagccaattacactgcttaaaattctgctttaaggagaatgttcttccaccactgctgttcagggattctcagaggccaggtggagtactagcaccgttcacaccagtggtggatgcatgtcctgcagaaacatctgtaaccccagcctaattgcctcctactaggcagctgatctcagggagccactctggaggccaaggctgtagggtgagaggaaggcatggtgcagggcttgggtcatgtctgtttggccaactcttcacgcaacttacttggccctcgtaacctaatccctcaagtcacaaatacatccctgccgtgtgattggggagctgcctaaaatggccacccgggactgtgtttcagacgaaatccagcatatcagcaacttgagtctcgtggtgagctctgtggccacaatcacacagagcctctgccaaggctcaggagccctcgcagtctttctcaaatggtgttttctgctcattcaaaacaaaataagtaggggggggggctgctcacgtgcttccagtctgggacactaggaccacctaaaccacacccacgatcttgtctgattattttgattccttgttggctcagttatgcattatggcaaccaaaccacagtgtcattggccataaaatgccaatccttggtccccacctaccctgggatcccctcaaccacatcttgctacccagttaaggtttcagcaacactgagaaaaatgtatttttatattgagagaggaaacattctttcaattgtgaaaaatttataaggcaggaatgtgaaaatattttaaaagacattttacaaagggtgaaagaccctccattaaaccactcaatatatgacactgtaattggcctcccaaaccctgacttcagctctgggttgggaccttctgtaaaggggcctttcatcctcaagccctcctctcctctcctctcctctcctctcctctcctctcctctcctctcctctcctctgctctcctctcctctcagcctgtgcctcctacatacagagacagctgctctcagtcttggtggccctgagactgacaaccatgatcacatgctctggagataaactcaggataaacatacacttaggaaccagcagatgccaggccaggcctcggtgcttgtaatctggtataacagcaagtgaccctcagggacctctgcccaattcttaggctccaaatcaaggaacatggccaccatgaccattagtggggcccaggcccgcgacaaggctgactattactatactgcagataataacagtgggagcagctggcagggactcatagtaacacagagagatagggactagccacagtactgtcccacctcggcctgcctctcattctcacctgccctctgagcagctataggtcaggcctcagggtcaggtgtcctctctggtcttaacctggcccctgaggggctggaggttctgagcagcttctccatcctctcagggcctgcatgtgtccaatgagaagtggacagggtgaaggtggtcagagctgccaggacctttgtcaggtttgtggtgtacatgaacagtttaggaatccacacaaaagcacatggtcccagttgtaatcatacgtcatgcaggggaggagagagctgtcgcagagggcacagtcctgcagaatttctcctttccttgggtaaaaccagctcagtggaagccccaggggctgtgtctcctctggtttccagatgagttgacccccacattctaataggttgcctgatgcctgacaaggactggagacccagccccttttggcctcagggccctttctgtactgatatttctcagaaactgaagaggaagcacagacactacctttggtcccacctgggaactgtgtttggggcacactgacctcccatggcccccaaagtcccatcaccttccccaggtaggtcagtcctgactggatgtgcccccagcgccctgatagtttggagtttatctttgggctctgggctgctttctgaggagctcactaagaaacccttgatgccaggcccaggacctgcgcctctgctgcatgtcccagggctgcaggtgtgaagggagggtcctgctgggtgagggtgatgcccttttccaggagagatgtctgattccagtctctagggccacatttattgggctttcttttctcactaggatgtctcagtctttttatttccttctttaaaagtacaactggtttagggtgacctgctcgggtccccttccacattgtagaagctttgttatttcactcttcacaaaaaatctcgctgctgctcactctttgggtccatgccaccttaaaaaaaaagtacaactggtttaatcatgaaatcatgtgtacacactgaagtttacagattattgccatcagcatatatatatatatatatatatatatatatatatatatactgtttctggttgggacaactgtggacaaggccatactggggtctctgtctctctcgttatcacaagtgaggatactaacagctctcttttatgcagactgtggtcatgtttcccagttgcacacgaatgtctcttatggttgtttagtttccttaccagccaagacccttaagttttcatgcagacaattggatgttatttctctctgacccaacatttttcaaacagtattccttggaacccaacaaaagttccacaagaaaagctcaagtctctggtgcacagttggaccaggttcattgtgtgcagtaggaccttgctcaagtgatgggtccatttgatattttcactatcaaggggaagggtgttacgacttttgggcactgagttgatagagggaagatagcagctgatgatggccctacccaccaatgtgtgtgtgggcagtacctattgatggatttagaagttgagggaactgtttattctgcagatggaatttccagtactgaatctccagcacccagccactagcattcagcaggtgctctgtaagaagaccttcactgccaatcacagccattacacaggtgaaggagaggatgacttttaacagccactgactcacagtaaactgaggtagaaattcagcttcacaaagtgactttgagggaacagactgaggaagcaggttaattattcgctgaaggctttgcccagagcaggaacaatacagggttgatgaggacgtagggatgccctggtgtggaaggaacaaggcctgaaccaggagcaggaagaagcatgggaaagaccacgctgccacatgtgatgagtcagcacatggaaggcacagcaaatgttgcgcaaaggtttttgtgtaataacctggcaaacagctgcttctctatccagattcatgagccaaaaaatgttactgatgcattgctgtcacatgttaaaatgctgggaagcatggtgacattcaaggaaacctgttctctgcaaacacctacccaccggcacaggagacaccccagctatgccaagggctttgtcttcctctggagtaagagcctgggaacaatcaggtggcccctgaaaggggtgccgcgtcttctgctctgcatggctgagttaattggggaactcccagagaacattccagaaaacagtcaacctgtctgtgctgggtgcattgagcatgacccaggatcaatggaagagacagaagcttaatttccttatggctgcaaggtgagcactgggaggacggctgaggcaggttagccaccgcccctgagtggcttcagccccaggcaaacagggacaggtgaagggcctatctgagcgcacctgtatctaaccagtcccagcatcagcaactgcatcctgtggaccacgagggggtgtgtgtgcccagcccctcacagatcacctgagcataaacaggaaattctccaccttacacccgactgcacaacacatctgcctccagctcttcatttacaaggtgatatcacatcagacagggactgatctgggtcccagatccctcaggtttccgctatcctttccagtccccacacagagcagactcttcactgcagggtgttgagccagctcttcccctcacaatgcctgttacaggtttacaagttactgttctccaatatgattggggtttgtttcactgtttctctatatatatatatttgcattttcttgggtaagctgagccccttgtacctggtcttgagtcaggcaggggccacacagagaagaggacttcctcccctggcaccagccgtccacagatcagggcatcaaggacctgagcagcaggttctgaatccacacctagaccccggaagtccctgagctcccagccgacagtgtggagcagccaccagggggaagcagagaatcaactggcaaagcgacctggggatggggcaggcctgggtgatagggagatgctgacatgcagtaagagccagtgaccaccacctcagatttagagggaaagggtctttattgtcctagagtattgtccttgacactgatgtaaaaattctagaatcacattttgtcttcagctcttttgcatgctgactctttgtctgacacagatccaggcacttgacttctcacaacgccccctcctccacacccagttgtgctaaaactgcatccccctcatgtgcagtgtcctctctgaggtcacaggtatccccctactcccatttgatctgggaacccctgtcctgcagacatagtggctggcttctaacttcctagctgcccctccacatccaccgtccctggtctttcccgactctctcctggggaagctgccaaatcacagctcttgatttcctggtgagtcacaaaatagttgctcattaacctttagttgacttaagttcttatccattgatacattttccccagcaactggagacatcatatttataataaacattcacttctggggatcttggagtttgcagccccctctcattctctcatggagcaaacatttccttcacctcctcatctgtccctggtcctgacagcatcctggagatactgaggcacagcagcaatgacctacctagaagctcacagccaaggcagaaacttccagcatctcatggatcttccaacactctgtgcgcacttggcaaataaggaatttcattgacctctatcactcagaggttgtgggctgtggtgggacccgcacctgtccaaggtgtgcattatcacctgtacagtggagacgaagagggaacttgcattgggttctggaaagtactgtctaaaaatagatttagacctacaccagaaatgtcctctctaacataaaatatttatgataggacacattagaggcctagaccaaaatgaaatacctccctccagagccaagatagaatggaggaggggactggggaccccagataattccacagttaccagcatgactctatggtcacctcccagaccaggtcaaaacccatcccataggagggacttcatattcctttgtaaatacagacaaagtcacctctgagctctgctgtgaccaagggagcccaggagtgaggctgagcacagtgtgatgtggggatgtgtgcagagaatatggaatcaattcataaaggagatcctgtgggcaaagggtgggagggcaaggtcacccctaacctctttgggtcccttggggctgtgcccttctcgaaatcacaaggctcctccagcagcagcccctgactctgctgattggcatcatggacccttctctccaacaaggggttgagagacctgggaggagcctgcccagcctcagacttgagaagcagcattggaggcacttcagccatggcctggcccctcttttccttggtctcctgactcactgcacaggtgctgcccccagggtctcacccacctgcccagccccaggcctccaggttcagcctggccgtcagtctgagctcagcagggccctgtgtgtggtgggcaggatgctcgtgaccctgctgcagggggaggggctggttggggtgaaatgcccccactctgtgctcctgtgctcataggtgccctgagagctcttttattcctggggctcactccagccctggcaagtagccagatatccttgggttgagaccctcagtttcaagttttttctgtccccttttctttccttgtaggctctgtcacctatgagctgacacagtcaccctcagcgtcagtggccccaggacagatgaccaggatcacctgtggggaaagcagtattggaagtaaaagtgctcaatggtaccagcagaagccagccaggcccgtgtgtgggtcatctatggggatagcgggcggccttcagggatctctgagagattctctggctccaacttggggaacgtggccaccctgaccatcaacaggacccagggtggggacaaggctattactgtaagatgtgggacattagcactcctcatcccacagtgacacagggagatgaaggagcaaaacacaaaaacctcttccattggtgtcactcttgtcctccagcccaggaagacagtggacaaagccatgagtgtgtgttgcccagttaacctggatgtgagacccccaggctgccctttccacaggccctccaggcaggctctgcagagggggcatcaagagtgaatttagggctgagatgaccaggatatattgaggtgtggaggaatcagttgtgatttggggaagtggggcctggttggaagatcagaccaaggtcgacatgcttagttgggctctggatttccatagggggtgaaggctagtccttgggctgaatatcctgagtcagtttccagaactgcccagctcacgttcccgtggcatcctgccattctcttcaggaaaaccagtggagtggacactgtgggatccacccatattccctcttctgagctcacccacccagcactgctggtagctctggcagctcagagctgtgccctcactgagaagggctgtcagcagagaaaactgtctcctccaggtttatgccccttcttagcaaggtgtggtttcataactgcctgaggtgaagctctcaagactccctttcaatatgggagaaacagaaaatcctcccagcttcacagctccttattgggatggtagaagactcaatgtgggtcagagtgtccttgtgcccggtgttgcctccctcacttagtttcacacctactgtgaaagcaaagctccatctcagagtctgcttccaggcatcccaaaataacataaccagtcatcccgaacgtgagccatcaggaacctcaggaggccacagtataccagaaagcaccagtttattcctaatgatcattgtgagtttgcaaatgcccaatgagatctgagtgtttcttgcatttgtatggaatgaaaagggccctggcatgccaggcactgtggggtctgagggagagttggagtcagatctccctgcagggaaacctggggcaggaggagcagcctcatcccatgcagggaccacagatgcacctgcagggtgagctgcaggatggacactgcccacctccaccctccacattctgtgcaaaaaatcattctttccacccctccttcagcctatcaaagttgacacttaaaaagccaccacagcccacccttgtcaacaggaaacccattcacatctccatcagccacacaatctccacataaagattcttcaaaaaataataacacttgccatgcaaagtatatatataagatgtctcaaataattgtacttagattgcatatgaaagtgatactattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacagtggctgaggagtgacctggtgcaggaagccccatctccatccataggacattggtgtgaacccagggagaggcgctggtgtaagagagatgagaacacaggtgtgaaccacctgcttgtgcaggggactgagccttcactttgagccaaacaagcttcttttcctatcttcaatcctgagcaagaggactttccggacttctttttgttttcaggtttgtgcccctccaggcctgaggctgtctggatcccagccaggggacacagaggaaatccagaagtctcacaccgaccctgttgtatttcatctgctggggccatcccaaactgctgcgtaccatttcctttcctggtgctcaaatagctgctctatgcacttgtcatggtttcagagatgactctaggtgggaagacaggataatgtatgttattatatttaaaaggaacttaaattcattaatatttattttaatatgaatcattaaaaaaatttgtcataggcaatggggaaggaggaaaagatattaaaattattttgaggaaaaaaccaaaattgtatttctcgaatgtctgagtgtcttcagtgtctcagggttgacagcggtcagctttaggttgtcctgaggatgtactccattgggggaaagcaagaaagcatgaaacacacatctctgtgacctgacacataaatcacagtaaaatggaagtaaatcttttaataaatcaaacactcacaataaatatcactctggtgaacacagaaatgcctgttaacaaactttccctttcccctgctggctcatatccccatggatcacctgtgtgcagagtggactctgtggtccccatttctcaggctgagaaccagaggctgggaaggacaagtcacctgcttgtgagtggcaggggaaggattgggagcagtggactcggtctcaggactgcggccctcaggaccaatgccacctagcagaggtttccacggggcgggctgccccatttcctgacagtagggacaacctggaggtgggtgccaagcagagggcactgcagggtgtgcccaggcctggagggtcacagagacacaggcaccacacagcagagacactgagggccagaagatcactcaggtaagggacttcagcagatctttctcctgagcaaatcaggtacaaaaaaattaagatcctgccatcagaatagataaacaaggactttaatctcagctgagctccactatccaaggaagcagaagcctctgagcccaggcccaggtgagggtggggtgaagggaggagctcaaggtggagatttgcatgcaggccccaccctcctctttggcagaggagataagacagggctgggggcaggcccagtgctggggtctcaggaggcagcgctctcaggacatctccaccatggcctgggctctgctgctcctcaccctcctcactcagggcacaggtgacgcctccagggaaggggcttcagggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctccacagtggtccaagttcctggggaactgagaccaaaacctgccctgggctctcaggccccctccttgctctgaagatgcttcctcacccagtgcaagcggcttcctgcagtgcggccttgagaattcttctctctcagctccttccctttccaccatgaattccaaaaggaaacccgctctgtggtttctcatccaggacagggacagcttcctgatgcttgtgtgccgtggtccctgaatgtgcaactcttgttagctcttcaaatgcagggacagtgacaaggagcttcctgattgatgcagtcactgcttttttcagggatgtcttcaccctacatgcatcaccatctcccacactgtgggtagaattttagcaactacattctgatggttatcgccacaactttgatcttaaataacaatgcagcgaacatccctgtgcagcctcctttgagttcctgtgtgaatatgaccacaggattcatttctaaaagtgaaattgagggtcagaaagatgtgtgtgtgtaattttcacccgttgttgtcagattcccctccagagggattctaccaattttcaatgccagccggaagtacttgttcagagtacattgttgaaagtggaagtttttgccaacctgtcagactcaaaaatgatacctgttatggttttatttttgagtctcctgttctgcttaagtttgggccttttcagaaatagttcagtactttttcttttttaggatttgggaaactttttcttaaatatccagataagaagaattttaatcttcgtggccggacaccgtggctcacgcctgtaatcccaagtgtgttggaagggtaggatgggtcaattgcttgctcccaggagttgagattagtccgggccacacagtgaactctcatctctattaaattaaagaacataaaaataaattttaaaaggaagtattttagtctttgtggctcaagaatcaactttggggatattccataggtatgtatagcatcatttacaatgtaaccatttaaaatgataaaagccactgtcagctctaggccatacaaaaacaggtgtcaggccagggatggccacaggatgtggttgaacagtccctggtttgtagggttatctgagggttgaaaattccaccagaatatgatctaggtgggaatctctctgtgagggtcactgtatttcacctcctgtattagcctgaggtctttcattggataagaacatgctcacatcatctatttgattgtatcatgggtttaagacaaccccgtgtcacaatcacataacatttatctgcattgcttgctccgagttttgggagagctttaatttatcaggaatagactcctcctaaggcaaaagtctgagagagagggatgggcatgtgggcaagatagtttgtaccaaagctggaatatccagggcaggctcagagagaaggttactaatatcagcatttgactgcagccaaaaacagaagagaacatggaggttctgagaatgacaaataaacaaatagtttaagttttaaatgtattgaatgtttttataatccatgaaaattctagaacagaatttaacaatgggataaggaagagagcttgagatgttaaaactataaagaccccaagccaagctgccaggaaaagaacaggatctttttggtggaaatatgtttctgctgcaaattattattttatgtgtgtgtgtgtgtgtgtgtgtgtgtgtgtgtgtgtgtgtgtgtgtgtgtaaggaaacctcccatggaacatccttcttccctacagtcaagatcaccctcaccctacaagggaacctaaacaaaatgtcaatatcaaatagaaaaaaataatgcactttgtataaccattagagagtctctatttgcacatcaaaatgtggatgcttaacgttaacattggaaatagtattttaatatgcatatgagatgaattttctttagactatttttgtgaattatctttcttaataaggacatactcttctcttagaacaatttaacttgtgatattttttctattttctgtatcagttctgttttttctaaacactggcaaagatatcctatggctactgattaataaattagattaatgtgtatttaacttaggtaagttagttcaagagtggacagatgtgatttccccacatatcctatggctactgattaataaattcaattaatgggtatttaacttaggtaagttagttcaagagtggacagatgtgatttccccacatatcctatggctactgattaataaattcaattaatgggtatttaacttaggtaagttagttcaagagtggacagatgtgatttctccacatatacctcacagatgttgctggtgcttactcactcttctcttctaatcttagcaaataaagtgggaaatttgacattcctaaacacccagatgacaacaggagagaggaggtgaagccccaaagctgttattctttaaatcctcaggatgaatcaccctggagaatcacccacacttcagttggatgatacgcaaatgagagtttggtcttagagtggtgctgagttagttcaggatttgggtcactgggatggggtgaatgtgttttacaagtgaaaaatacatgagttttggggtctgcagggtagagagttcttggctgaattgtgtcccccagatctgggttgagtgacatcccaccaagaggagtccaggagaagtaaatttgtgtaaacaccaaacatgcactgccccactaggcctgagaggaaataagcgaggcctgggaagcccacctgtgctttgggttcaggaggcagagctctgggtgtcttaccatggcctggaccccctctctgcctctccttcctcaccctctacaaaggtgatgcccccaaccctgccttaggctcagcccttacaggatcctgagctggtcctgccctgaaccctgagctcagcctaggcatagcctcagggtgacaccactggaaatgtgtttgttatcttcaagccccctctcctttcctctcctgcaggctctgtggcctcctatgagctgacacagccacccgcggtgtcagtgtccccaggacagacagccaggatcagctgctctggagatgtactgagggataattatgctgactggtacccgcaaaagccaggccaggcccctgtgctggtgatatataaagatggtgagcggccctctggaatccctgagcgattctctgggtccacctcagggaacacaaccgccctgaccattagcagggtcctgaccaaaggcggggctgactattactgtttttctggtgattagaacaatctcacagtgacacaggcagatggggaagtgagacacaaatccatttttcatctgtctcatcttttcctccagcaccaggatgactgtgggccaagccatgagcaggtctggccaagttctactggatatgagacctccaggccatccttttgttcagccctacaggttggtgctgcagagggtagagcaggagtggatttagggctgctataatcagaattttcttgtgttttcaggcccctgaagtgacttggggaaataagaacgggatggaagatgagagagatgtagagaacaatcacttggccttagatttccatacgatggtgattgggtcactccttccaaatatcttacatcagtccccaaaaatgcccagctcagctcaacacctgagcttccaggcttccatggcagcctgggattttgaacaggaaaagcagaggaacaggaaaagcactgtggcatctgcctagatatgcttttctgagctcacccaccctcaactgctgggagcttctagaagcttagagctgtgccctcacaggaaagtgctattgtttccagaaaacttcctttctcatatttaggctcagttttgagagttttggtttgatgactgcctgagccaagaacccaaggccccgccttaatacaggatgacactgaaaggccttccagctccagacctcccattgtggatgcctgaggcctcagttgcaatcttatgatgggtcagggtctccttctggtgggtgatgcttctctcactcctttcagattctctgtgcatgaaaatgtttatctcaaagtctactttcagggaacccaaactaagacggccagctgtcaccaaaatgagccaccatagacctgaggtggccactataccctggaatgcatcagcgaatttcctaaatttccactgtgagcatccaaatgcccaacgatttctgagagatccttgtattcttataaaatgaaaagggatcctgaaatgccaggtgctctgagtcctgaaggagaggtggaggcagatcttcctgcaaggattccacggaaaagggagcagcctcactccatgcagggaccagagatgctcccacgggggcagctgtaggatggatgctgcccacctccatcctgcacatcctgcacaaacaatcactctttcacccctccttcagcttatcaaagttgacacttacgaagccagcacagctcatccttgtcagactccttcaaacctccatcaaccacacaatctcaacataaagaatctccccaaaataataatagtaacaaaataataataataataaaataatagtaacaaaatagtaatagtaatagtaatagattttcaggcacagaaatagtaatatagtagctatgaaaacttctataaaaatctcataaataattttagattgtgtgcatgtgtaaatattatttttcacactttgtgttaaataaagtatattattgaacctagtttacctttttattttttatgtctactatggtgactagacaataggattcacatgagactcacatcatgttgtgattgtacaatgctgatctggtcttaccccttcacatgacaggtgctttggagtaacctgcttcagcaagccccatctccacccataggacatatgtgtgaagccacggagaggcactggtggaagagaaataagaatatgggtgtggaccagctgtttatgcaggtgactgagtgctggagccctgaccctgctctaacctagatgtgtcacatccatctcaccagagaccactcctggcctgcctgagctcacaactggggggaaatcgcatttctggcaacatggtcacttgatgtccagtgttatcctgtctctcccagggcccagtaagacaaaagaagctgtttttagaaaggggagtaacactctactgcacatgacatggccttcttccaaaaacccaggagtctacattgggattctccaacggggtttgccatgtgcaggaggttttatttcccatggtggagtctgctggattctctggccccaacagcaggacactcacaaccctgcctgcacctgctgcagagccttcctgctctgggcctggaaaacaatgggtgacatttatggctcctgatacatggattggagtcacatccccagtagtaaaatatgctactcctagatcttataggccttgtgtctctttcttcctggggaaaattgaaggttataataacatcttttttttttttttttttttttaagatggagtctcgctctgtagcccaggctggagtgcagtggcccgatcttggctcactgcaagctccacctcccagattcacaccgttctcctgcctcagcctccctagtagctgggactacaggcacgcgccaccgcacccggctaatttttttgtatttttttattttagtagagatgagttttcaccgtgttagccaggatggtctcaatctcctgacctcgtgatctgcccgcttcggcctcccaaagtgctgggattacaggtgtgagccaccgcgctcggccataacgtgttgtttattttgtaggagactctcagctgctccagacaactaaagtcccaatttcagctaatatggaggaggaaacatctttgtttatttcccactctcaaaagtgcatggatctcacaaaagcttccaataggccgtgcccatcatgtacatgtgattgaactatgatatccagatggtctgagcccccatgatgatatcatgatagggaagggagagctaatgaagctgggcagaaaaagtgtgaatgtatactgttgtccattccacgtgaatgcacactgattctgatcctattctctgaggacaatagacaagacctcagtatctgcttcagtggtttaactgtgcacctgcagccatagcattctgttccaggagatccccatctggcacagatattgctaatgccactattgcccatctgggtctgtacaaatccaaattcatcttccaggatcattcaactattgtagagatcagtccagtaaactgaaagtgaggaccccagaagtaatcacacgtactgcaggagaggagagagctgtttcagaggccacaatcctgttgaaattcctctgctccttgggaagaaacagcccagaaaaggccccaggggctgcgtctcatctgggttcctggatgaggcacaccccctactgcactgagattccacagaagctgggggtgaagtgcaaacaccgtctttggttcatccttgggattttctttttatcacacactcgtcattttgtccacaatgtccaaagtttctaaagtgctgtctaatagatagaggttctttgtgcgctgaactaaaagctcttgggttggctaatggtgatgtttgcacatttttactgtacttactgccgcttaattacacacttaaaaatgattaaaaggatgaaacattttgttatgtttattttaccataataaaaatattgcatgctcaggaagcaaagtaatactagtttaattttgaaatcacacaactggtaaaaatggaaagaaaagcaccattttctctgttctatatgctacaactcaactttctctctctctctctttctctaattaacaatgatatcctgtctggtccaaggtcacacatttccagtgttgcaggaatgtctgttgaatctgctaatttgttgccaggaagaatactcaaacttctcatgctcatatttgattgtcaactgtctccagccaacatttctaaaccaggatcctttgacaagacttgtgaagaattttgtaaaaagtaccccccaagatgacagtgttcgctgttggcagcaggactgtttccacgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctgctggacactgagtcacacagagagacagaaggtggctgaggacaccttatctctgatgagaataaggggattagatctgctggtggaacaggaagctgaagaaacttctggctctaaacatggaatttccagccctctgtctctgctgtccatgcccttctcatctgtatgttcctgggagatgtggaccacgggggtcagaggtgaaggggattgggaagctttcatgttctctctcaccatctcccttgtttatctaacacactcttacacacctactttattagagcttctgctctacaaacatggctgagctctaaattagagacttttgaaagtgcagacggatgcaggaactcgtccatctggagactttccaccacttgaagcagtgaacacatctctgcaaggctccaaatttcaagtgacaggattttgggatttcaaagaaaactaaatctttggtgaaccacgacagaagagggaaggttcacacatttccctgctgcttgggcctcagtgaggactgactcagccagtctcaggctcctggaaacctcctaggagatgtgcactaggaaagtcttttcagtacaacctggggcaggtaagtggcccttactctgatattctgctccctgataattttgctttcagagaagaacaaagacctgtgattctgggaagttcaaagcccccagacaaggtcttctcattctcccgtgacagcctgagctctgcattcccaaaaggaggagcatcttcccggcatgaagagccaggagtagagagggagcttctcccaggggtgagcagggcagaagccaccttggtcagtgggaaggaaacgtgctcagctcacatctgacccagaatgactcagtcacacccgtgcagggtcacctgcatgtgagcatcatctatttgctccatgagaaaataccttgtgtgactcttgggtaaaatcataccgtaggtgacatttctctggctattgcttcagccaatgtttttcaaaattcactgtaggacacttacataaggtaagcatgtcaggtgtgggatgtgttgaataggaaaagcacaggcttcctgtatcaatgttcatggcttgtattcatggccataactcgtggaaatggaaaaaaaaaaaaaacagaaaagaaaatgataccctgctcaaaaaagcactgagaaataccattgtagtaatatatcttcaacttataagttgagctaattgaacattaacttagatagatcatttttatggggggattcctaaacctaaaacattgtattaaaaattttgtcaggttaaaagatcattaaaaggccaatgtttgattaaaatctggagtcttttactttgggctgcaatcagccaatgagtgcatggagttggctgccctcccagaccctgactggctccacgtcgaggtagagcagcgctcccgacaggcagctggaggaactgacgaggggaagctgtttgcatcagggcctcaaaaatttggctcaggattttcccacgtcccctccccaagcccaagctggtcccaggacactcagaagagctcatcattatgggtctaaaacttctctgatctcgctcttctttcttccttccccagagaccttggaattgtcagtccctctcacaggcccttcctttccttgtcaagtgcactccctgaattatctgctcctgggtcagcaattctctagaacttcagggaaagcagtgctgggtcacccacatggggccccagaaagctggctaaggaccagacacacaggcagcaggctaggtccccacagggctgcatggttggcatcgggtagaggggagggaccaggaaccactcgctgagtgtccgtagggccaggtgaactagggaagggctggaacctggtcaaagaattgtgtactaagcaccactttctctgttctatatgctacaactcaactttctctctctctctcttctctaattaacaatgatatcctgtctggtccaaggtcacacatttccagtgttgcaggaatgtctgttgaatctgctaatttgttgctgggaagaatactcaaatttctcatgctcatatttgattgtcaactgtctccagccagcatttctaaaccaggatcctttgacaagacttgtgaagaattttgtaaaaagtagcccccaggatgtcagtgttcactgttggcagcaggactgtttccacgcagtagggctactgcaagccacacctgtccccacacagtagcatcttcctggaggtcaagagtgattttgtttgctatgctgccccagatcacctaatttattacctgtgaatttcacacactacacatcctgcctgtccccaaattcttcacttatgggcaaatgtcacatctgacctgaactggtttacatcccagatccccttcaggcttcccactgtcctttcagatcctcacacacccaagacccttctccgcagggcacagacacagctccctgcacacgcttccatcacttgtctcttcactccttcctcaaaggaactccacagactcttcttcagggaggccttctccaatcactgaagctacagcagccagccagtcagcttctgtcagaactttcaatgattagctgcatagagcttacaattacacatttgttttttctatcgttatcttttgactgatttatttctattaatcattgcattatcagtcagaaatgctttttcactacaagaacacatgtggcaggaaccagggagcttccaattttcttccacaaaaataagtctgcacgtgcttggtggttgttttccagatgctctccagttccataggaagctcaaatatttctacctctccattccctttcaatgagatgttgactttgttttcattgttgttgatgtaagacctcagcatggctgctgcagctccagctatcacacccaagttcaagagaaaaagcaaagcacaaacccaatctagtccttccttcataagaggaaaagtttcctgagaagaatctcagccatctgactcttacatcctatggaccaacgctgggctacatggtcactgctggctagaagaaactggaaatttgcctgactttcaagtgaatagaggggatgacacacaagtagaaggtggtagggagtatctgctgggtctgtaaacccaatctgcctactgcactgatccagcaacaggacaggaaactcctcagagcaaggactgtgtcttcctcatgctgaattcctaaaatgcattcttgccaggacagagtgggtcagggtgaatatttgttgggtgaatgagcttctgtctctgttgtattgcaggagtcaccaccagtgcacattggccctgtatttgtatccagaaccaatcaaagccacccctgagtcctgcatctctcagtaccaagctccagtcccccttcaagaccacccaccacacagacgtgcagggagcctcaggagggcactgtcacctccttctccacatgtgagtgtttgtatttccatcaggaatctgagcacctcgtgcccaggtttgaggcaggaaggggccacaaacagaagagaaatttcttctctgaagtcaacagtccatgaatcaaggaatcagggacctgagcagcagattctgaagctacacctgaacccaggaggcccctgagcctccagctgacagtgtagagtggccacctgggggcagcagagagtaacctggcaaaaatccctggaaagggggtggagctgggcatcagggagatgctgacatgcagggagggtcagtgaccatgacctgagacctggagggaaagaggttcctcttttcttagaatatttgtcattgacactgatgtttaaattcttctgacctcctgtctctcagatttgactcttggaaatggtgcttatttttctgatacagattcagacaatttgcctcttctcattgccctggcccccatctcactgtcacacatgccattccattctgtagtcacgcgtgtcccacctccctgcccttttctctggtagctcgtcctgcagacacaggggcttctccttccctggccactcctccacgtccactgtccccagtctttcccaacactgtcctggggaacctgccaaatcacagctcttgatttccttatgaggcacaaaatacttgctccttaatcttttgttgacttaagtttttatccattgatatattttcccagcaagtgaagacaacttagttataataaacattcacctccagggtcttggagtttgcagccccctctcattctctcacaaagccaacatttccttcacctcctgatgtgtccctggccctgacagcaccctggggatactgaggcacagcacctatgacctggcattagaactcacagccaagtagaaacttatcacatcccatggatcttccaaaactctgtgtgcacttggcaaccaagaattgcattctcctctagcactgaggggctgtgccctggggtggggcctgtactggtgcaaggcttgtgctgtcccctgtagagtgggaagtaaaaggtccctgcattgggttctggattgtgtcttcaaaatgaatttaggcctataccaaacatctcatgtctgacataaaatatttatgaccaggacatttctagagaagcagaagaaagttaaccacctccctcctgagccaggatggaatggaggaggggactgtggaccccagataattcccccatcaccactgtgactctggtaacctcttgaacagggccaaccactatcccataggaaggactttatatcccctagaaaatacagagaaactcagctctgagtttttccatgaccaactcagcccaggggcaaaagtgggcacaatctgggtaaagatgtgaactcagaccatgggaccagtgggtggaggagaatcccatgggctgagggggtgggcaagcagtggtcaccccttttctctctctctctgtgtcccttgggactgagcccttctctggaaaccacaaagctcctccagcagcaacccctgactctgctggtttgcatcatgggctgttctctccagcaaggggataagagaggtctgggaggaacctgcctagcctgggcctcaggaagcagcatcagcagtgcctcagccatggcctggacccctctcctcctcagcctcctcgctcactgcacaggtgctctgcccagggtatcaccaacctgcccatccccagggctctgggtccagtgtggccatgactatgagctcaggagggccctgcctgtggtgggcaggatgctcatgaccctgctgcagggtgagggactggcggagctgaagtcccctcaaactctgctcagaggcttgtgagagcctgaggggctgcacctgccaggagagagtactgggttttcagttcaaaggctccatgcagagggaaagtccatgggccactggggctagggctgattgcaggggataccctgagggttcacagactctctgaagcttttccaggacagcagggcaggggatttcatacggatcttttacctaaaagccatcctctcctttttttttttttttaatctttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatcatcccacggtgacacaggcagatggggaagtgagacaaaaacaccctcccagcctcggtcaccctcttgctccagccccgggaggcctatggatagagccatgagtgaatctggtccagttcacctggatctgagcctcccaggccgcccttccctccagccccctccaggagtctctatagagcatacatcaggcatacacatggcctggaaggaccagaatcatctaatgacttggggctgtcgtgtgagttagagaatgagggcctgggtggaaagacagacagaagcaacctctgtcctctgtcttacccctggatggtaatggggtggggatgaggccagtccttagaccagctatctggctcagtccccagaaccaaccctgctgaggtcctggcccccaggctgtgtggcagtctgtgattcccaacagaccaaaccagaggaggggacactgtgaagtctgcccaggtcccctcttcaatgtgacccacctagcactgctgagaagcccagcagctcagagctgtgcccacaatgggaagcgctgttggttgcagaaagcttcctcaagtttatgtcctttctcagatggttttggtttaatcaaccaagatctcaagtccctgccttaatgtaagatgccactgaatgaagggcctcccagctccagagctccctgtgtggacggacacctgaggcctcagtggcaaccccattatgagtcagggtctccttctgcccactgttgcctccctcactctcttccaaatcttctgtgcatggaaatcattgcagtcaccttccagggaaccccatctaagatggccagctgtccccaacatgggctgtcagcgacccgaggagtccactatccactgaaaattctggtttctgtcctaaattttcagagtacatgttcaaatggccaatctgatggttccttgaatttttatggaatgaaaagggagcctgacatgctctaggttgagagatagttggagtcagatctccctgcagggaaacctggggcaggcagagcatcctcgccccacgcagggaccacagatgcacccacagggtgagctgcaggatggacactgcccatctccgccttccacatcttctccaaatgtcacccctttctacaaccccaacccaaatcattgatctccagaaaaataacagtaacaatagccatgaaaatctatgtaattcatctcataatttcatgttaacatgtgaaaatgatagtattttgctttattgacataaataaaatatactatttatccaattttatttgtcttatatttttatatttaatgtggtgaccagacactaggggtcacaggaggatcgtgtcatactgttatgggacagagctggtcaggactctttcaggtgacaggtgctgttgagtaacctggtgcaggaagccccatctccaccagacccaggtgtgaacccaggaagaggcgctggaacaatggagaggagaacctgcttctgcggaatacagtgcccttgagccctgcccctgctccatcctacgtgtgccacctccatctcaatgtggatcatttcttgccctgcctgaggtcatgactgaggggatctggcaggtctggctgtgtggccactgctgtctcatgtggttctggttgtaacaaagcccaggaacatagaagaggctgttttcaaaaggtaaataataatctactgcacatgacatagacttgttgctaaatcccatgggtctacagtaggattctcctgttgaggtttgccttaagcagaaggtttcagttcctttgtccagttcctctattatgatagggtctgcagtttctctggcccaatagcaggacactcacacccccgcctgcacctgctgcagagcctttctgctcttggccccaaaacaacgggtgacacagttctcagacccatgatttatggtgtcagtattcaggcctcgggggtccctgacggcttctctggctccaagtctggaaacacagcctccatgaccatctctgggttccaggctgaggatgaggctgattattactgcagctcacataggagaggtggcactttccacagtggtccaggttcatggggaattgagacccaaacctgccctgggctctcagcctctctcttgttctgaagatgcttcctcaccctgtgcaagtggcttcttgcagcaccaccttgagaatttcccctctcccagctcctctcctttctcaccaggaagtccaaaaggaaacctgctctgtgatttctcatccaggacagtgacagcttcctgttgcttgtgtgttgtggtccatgaatgtgcaactcttcctagctcttcaaatgcaggcacatagtgagaaaagctgcctgactcatgaagtcattgctgtttttaggggcgccctcaccctaaatgcatcctcatctcccacgctgtgcaggccaatctgcacagaagtcattacagggagtttcaagaaattgcaccttagtcaactctgtgtccactatgctctcgtgaagatggccctcctggctgggctattcctctgtacctctgtcctgaagcagtgaccactgtgagagctgagcatgtttttgagggattaagaaccagaggaagctgttgtttttcattattattattattattattattattattattttgagacagagtctcgctctgtcaccaggctggagtgcagtggcacaatcttggctcaccgtaacttcagcttcccaggttcaagcaattctccctgccttagactcctcagtagctgggattacaggtgcccaccaccatgcctggctaatttttgtatatttggtagaaacggggtttcgtcatgttggccaggctggtcttgaacttctgacctcaggtgatccacccgccttggcctccgaagtggtgggaatacacacgtgcgccaccacacctggctgcgtttttcttatttttgttcctcttctttgcctcaatacctcaggttgctgagctggggagattttgagtgacagactcagtattctctcaaaatccccctctctcacatcgctgaggccctgtcctggaaactctccaaaagtggatggtctccctataggatgggagcttccaaaatggctccacagggaagagttaacctgagttcattccttcctcctcattgacatccagcatttgtaatttccatggccatcaatactactatagctgaaatcttcattaatctactaaaggtgagagtgaatttcatacatattcaaacattagtttcatccaacatttaaattttatgagtcaattggtaaacatagccatgattacatgtagtttaggcttcataaactttgattaaatggattttatttaaaacaatgtaatcattttactatatgtgtatcctacctatatcaacatgttgttacttgaaatatccacaagaaactatatttcaaaaaccaaattgtatttattgtctattgttacataaaaattgctccctaatagttagcatattaagagaacacgtgtttgtgatcttgtcactttggtgcatctggaattgagagcagcttagttttgtggttctggccctgggttggtcatgaagtcgcagccaagctgtcaggccaggctgcattcagaggccagagcaggtggccaggcccagcctgaggggcttccactgtccctaacctgtttggctgattggaaaactcagcggaaaaggagagagtgaagtgtaaggtgcctgtcctggtcccccatgtcaaagaccattccatacatgcaccatttcttattctttcctgcaacatcctaggcatagagcactgcccattcattctaaggctgtagagtattccacagtagaattttagccatgcaacctctaatggttaacaccatgattttgatcttacaaataacactgcagcaagcatccttatgccgactcctttgagttattgtgtgcatatgatcataggataaattttcagaagtggaattactgggtcaaaatgatgtgcatttgtaatgtttacccattgttttcacatgtttcaccagtttacaatgccagccctaaatattgattggaattcattggtgaaagtgcaaatttttgccaacctatcagatataaaaaagttaccttgttacacttttatttttgatttctcctattgtgcttgaagttgagcatttgctcaaatgtttcagtgctcattactttttaaaattcggtaaactttttcttaaatgtataaataagaagtattttagtctttgccacacaggagtcaactttggggatactatgtaggtactgacagcaccatctgcaatgtaaacattaaaatatataaaaaccattttaacccattaaccatccccagataatagctgatttcttattagaagtaatgcaagccagagtcagtggagttatatttagaaaatattaaatgaaaaaacttactacccaaagcaatctacaaactcaatgcaattcctttcaaaataccaatgacattattcacagaaatttaaaaaaacctctaaaattggtataaaaccaagaaagatcctgaatagccaaagcaatactgagcaaaatgaacacagctaaagatgtcacactactagaattaaaatatactacaaactatagtaaccaaaacaggaaggtaggtattggcaatcagacactgagaccaatataacagaatagacaacccagaaataaacccatctatcatatagagccaatcgattttcaacaaagatgccaagaacatacactgagaaaatggcacaattttcaataaatggttctgagaaaactggatatccatgtacggaacaatgaaactagacacttatccccctccatataaaaaatcaactaaaaatggattaaagactcaaatataagacccaggctataaaactactagaaaggaacttagagaacattggggaagaacaattctttaggacattgttctagataaaagttgtatggccaagaggcaacaacaaataatagagatatgggacatcattaaactgaaaagctcctgaaaagcaaaggaaacaatcaacagagtaaagacaatgtgtagaatgagagaaaatatttgcaaactactcacctgacaaggacctaatattcagtataagaaaagttaaaaactgaaataactcatcaacaacaacaaaaaaaactaataataccattaaatagtgggccaagaatttgaatagacttttctcaatagaagacatacaaacggccaacaggcatatgagaaaaatgttcaacatcactaatcagcgagggaattaaaatcaaaaccccagtgagatacaatctcaccctagctggaatggctatgatcaaaaagacaaaaaatacaaatgctgatgaagatatgcgacttcatatttttctagtccaattctctgggaacaatgagagtgctctctttgctctccctttagtaactatttttcacatgcaaaaatatgggccctactgggaaataatgcctaagaccaccaacaccttaactgtttgttcatcacactagaaatgaaactgttttccaaataatattaacatctatctgtgtctatcaccattgtgtcaatgtttgtgtgatcctataaagtttagaaggcctagaagaatgcccttgctttttgcaatacaaaaatggcctaacagatatagatgacatagatatagatatagatatagatgatatagatatagatatagatgatatagatatagatatagatagatagggggttgtatcttggaatttgtttctctaagggacttatttcacatctaatttgaaattattctggttttaaacattatagaatgataacacaattggtgaaccaatcattctgtgttgaggttaacagtatttttttacttcaattctcactgaatgagagcagtttttatacggaggggccatgccataacaatatcacatactggggttgttctcagactgtgaggttctgcctacaccaagccaggatgagaattttatttgtcaaactgctctctccacttgtttgtatcccataatataccccaaaaatgagcataatttcattttttatgctgtttgttcttacatttaatacatgtaccaaaaagttgtctttgtttttaaaataaaattttatgctatcttttaatctatgtccctatagaaaaatcatgatccatacacatttgttatcacagaaagaacaagataaatttcctctctctctcataaatgccatgaccgctgctttttgggattatttttcttaaattattttttaaacagaaattcatataacttaccttaatcaaatttcttttcaaagtaatcacatttcttttatgtgaaaaattatttaccttcttttatcaaaaattatcttaatacaaaatatgtattgttttacttttagaagaaatggaaactatctacacattactaatctaaaaatacatgctctgggtttatatggtgttaacatgtcttccaaattttaaggaataggtatttaaatgtcatgcactttgtttttaaatttagaaaatgtttcaaccttttgcctgggcatggtggctcatgcctagaatccctgcactttgggaggccaaggtgggaagatcacctgagctcaagaccagcctgtgcaatatggcgaaaccccatctctacaaaaaatttcaaaaattggccaggcatggtggcaccacccacaatcccagctactcgagaggctaagatgggaggattgctggagccggagaagttgaggctacagaaggtaaactgttgaggctaaaacatggtaaatatttaattgttcacttaaaagaaatgttggttacattgaaaagaaatttggttaacgtaagttagataaatatctgcttaaaaaataatttaagcgagctgttagcactactgcattccagcctggtcaacagagcaaaatctgttgaaagaaagaaaaagaaggagagaagggaagggaagagggaagggaaaggggaaggggaagaggaagacagaggtggagggggaggggtggaggaggaagagggaaggggagagagagagagaaagagacaaagagagaaagaaagacaaagaaagaaggaaagaaagaaagaaagaaagaaagaaagaaagaaagaaagaaagaaagaagaaagagaaagaaaaagaaagaaggaaggaaggaaaaaaagaaggagaaaagaaagggacagaaaaaggaaggaacgacggggaaagaaagaaaaaaagaaaaaatatttcaagcttttcagtagcagagacacttcgtaatcaataagcaacagaaccaaaacaaaaaaaaaaatctacagaacagtctaaatacaattataaacttctgattcggatatcaaaaccatttcaataataaatatatggtatgaaaacctcacaaaggtcaagtagaatgtattatatttgaaagaaattacgagttgagagtaggaaatttataaatttaatcaaacaaataagcattatgaggaagttgtattgctaatgtattatttggcaagctgttcagtggaacaccaagatattcttaaggaagttgcaaatatctttttttttttttttttttttttgagacggagtctcgctctgtcgccccggctggagcccaccaccacgcccagctaattttttgtatttttagtagaaacagggtttcaccgtgttggccaggatggtctcgatctcctgacctcgtgatccacccgcctcggcctcccaaagtgctgggattacaggcgtgagccaccgtgcccggctgcaaatatcttttaagatgttgtcattgaagtggatttaaaagtgaggacatgaatacctttaaaaaatattcagggataaagagagaaaattaaatttagattgtatacatatataaaatgtattttaaaagatcagcttggctgggcgcggtggctcacgcctgtaatcccagcactttgggaggccgaggggggcgcggatcatgaggtcaggagatcgagaccatcctggccaacatggtgaaaccccgtctccactaaaaatacaaaaattagctgggcatggtggcgggcacctgtaatcccagctactggggagggtgaagcaggagaatcgcttgaacccaggaggcggaggctgcagtgagccgagatcgcaccactgcactccagcctggcaatagagtgagactctatcaaaaaataaaaaataaaaaaataagcttgtctctttttattccttaaataaaaggagcagacacttaaattccttgccttttattttaaaatttagaaaatgcttacagcttcccacagtgaaatttatacttagataatctaatcaatggataataatatcaaaacagaattctttgaccaatctattttcttcatttttaagtctaaatgtatactcaaagaaataaaactatttataattgattctgctgtttgaaaatatttactgatcatttaccttgcaccaactgacctccagctctgaagataggtcagtggtaaagtatacaaagttgcccagcttcgttaaacttaaattctaatgaggaaaaaagaagtaattaatcagggactttaaaacaggagtgttgtgatatggcttggaattctaattgcttcctgtgcttgctgtgtggagactggattgaaaaatagggcgatgataggagcttaaattcatacagaatatggctagcctgtattttgagggcccctgaaataagaatgtatagtagttctcattatttcctcaagaaatctctgcagtagagctttggccttgggagggaagtactatagtcaccaagtggtgagggtgggaaggtgaatttgcaaataccatttggaatgagttcactttaaaggtaaagctggcaggattttcatacatgtcagatctgaaaatctgtgtgtgcgtgtgtgtgtgtgtgatagagagagagaaagagagagaattagaacaagacagatacagacagacaatgacagagctgcagagacagagagaattaaatggggacaccaagaatattgagctgagaaactataaaatgggaggtgccattaaacagaatggggaagagcagttttggggagtgtcagtggctccacgtagacttattaattttgagattcctaaaccacatccaagtggagaagacagacagtattgtgtgtagtctagtgttatggtatcatataaaatatcaggaaatgaatgacacaaaaattagtaagaaagcaaagataagaaagataaaagtcccgagcctagtggttatctactgcctaaaaagtagtaggctgggcatggtggctcaggcctgtaattccagcactttgggaggccaagttgggcagatcacctggggttgggagttcaaggccagcctgaccaacatggagacacctcgtctctactaaaaatacaaaattagccaggcatggtggcgcatgcctgtaatactcaggaggctgaggcaagagaattgcttgaacccaggaggtggaggttgcagtgagtcgagatcgaatcattgctctccagcctgggcaaccagagcaaaacttggtctcaaacaaaaaaaaaaaagaaaagaaaagaaaagaaaagaaaaagaaaattagcaaagatgagaagaaaccagcaaaaagtactaggtataattatcaaaaatgtcaagaggaaagtaggttaagtgttctagaattctatcaaagaaagttttgaaaaaaaagagggagagatcaactgcattaaatgctgctaatacataaattaagcaaaggctgaggaattacgcttcaattcatcatttaacaatatggataccatttgtgctttgataagagcaattttcttggaatgagtaggtgagaaaccatattggagtggtttctcaaaggaatgcctgatctctgggttcttaaggaaactttttattgaacaggggaggcacaaattggattagttttaattccggggtccggacacactctaaacatgtgcctctgcatgcctcgctttttaaagctaggtatcctattatctttcgataacaaaataatcacctgcaaaaccaacacacatttaatggacacacttgtaaagtgtgtactagaggttgttggagaggatgtgattccacgtgatagcttacgagtcactgatgggcaggtaagctggtaaaatatctttggaaaactcaccatacctgttatacttaaatattcagataccaaacagcagaaaatccatattgtaatatatttccatgagaaaaaacaagagctctgtattaaaatattgattattattaaaaataatcccactgggtttcctgacttttttattagcaagtcagtctccgcctgttttcagtagtacaacctctatttaacaaatgttttgtatttttaatcagccacttagaaaaaatattatattttatatcaattctacgttcagtgccaaaaccagtgttttgtacattccacagaattatttgttgaataaataatgaataacttaaataagttatagtatccatatataaataatatatcatctccgaatacagtgataacatttgttatgtagaaaatgatttcaatctcagttaaaaatattttgggcataggagttactgtcatataaagattctcacattgttttgtttatatgaaaatgtttgcagttaacgtacatttttggtacctaaggcttttgctcttgctgccatagcaaacagtgtgcctattaagaacacgaacctgagttttatttcattttaacagatttcttaataaaatatatgccaccttatttggtttaatacataagcaaagagccatccactccaccattgccccttgtccctcctccaatgcagctccttaagatgttactgatagcagaggactttgtgttcaacctaagcactttatagcccttttattttcaactaggtatgaggtaaaataattcagcaccaataaaacaaacactctttaaacaatgaccctttttcttagcctgttcaacaaaacgcagcaagacagagtacacttctctttcccagcaaatcagtgttgccactacattctctacgttctgaaaacttgtattattgactttcttacaaacaccctttgagcttataatttagatgtcatcaaataatgtacaaaaacacgctacttcctcccccttctcttctcttcttaccagactattgtcagtttgcttttctatccaactcctttcttctgtctacttgatttttaaaagactttctacatatttactatcttggtattgtagagaccaactatgtggtcaaactacacatataggaagaactgaattatatgcaagcatttttaaataaacgattcctcctcagttttctgtgattatttcatataatcaaatgtcttccagatacacatcccaaacgagtggttgtcaagctctgctttgttgtctaattttatcagaattatccaaaattcttatgataaatacagatgaattagcataactccagatttatgaaatgaaaatttccagaacccaggaatatgcattgaaaaaatgtattcctcacgtggtgctgatgtgatatgggatctgagtttagaatccaaggaaaattaccctccttgccctctagttggccagaattacctagttgaccagagttgctctcttgttatctagaggtcctcttcccttttcacattctgctctctctccttctgtaccttcctcctctcctccctccacttctgctcatccagatcccaagcccttctccattgattctcctaaaactccaaatggtcagttgccactaaagtccctctgtcccatgaacaagatttgtgggcaaatgtagaatttaagcttggacagagctgaatcagagctgcaattaaagatttccctaaacccagcagggaccagcaaatacttatagaagattagagatttcttgtgagtgcaaagggctcagagtgacctgatgctatagaccaaatcttatggtcccctcaaattcatgtgttaaaatctaattccccatatgatgggatttggaggtgaggccttggaaggtgattagatcatgaaagcagagactgtatgaatgggatcagtgtccctatcaaagggactgctgagagctccctcatctcttctgtcatgtgaggacacagtaaaaagatggcagtctatgaacaaggaaggaagccctcatcagacacgaaacctgctgacgagttgaccttggattttaccatctccagaagcatgagaaatgaatttgtttctctgctacctagtgcagtgcattatcttttggcacccagattggctacagtaccaacatatcaacttgtacacgtaatttttgaaattctgatgccaaatctttgatggcaacaggtgattgatctgctggaggaatggactgacatgatccctctttccacaataaaccagagagtaaaaacaagcaaaagtaggtcaaggtcttctaaaagccgtacctgaaaggtttccagtaacagttgattagatggtaattcaatcacacaaacaaccacggcaaagatacacaactatcagacattttcagaatagcctctaaaacaacatctgacaacattagggagttaaagaaggcacgaactttcaaaaagtcaaactttatttaaatgttattgtagaaacttgtaattttaacactatggatgaattctagggcaggtggtggcatggcatggcgatttgggggcacaagtgctgagttttgaagcttcggttttgataccctttggagatgccccctggcctccacacccctgcccacctgtcaagaagagcctgtcctgggcagcacctcagggacaaacagcccagaagcccagttgagggcagacctccaaggttggaggaagaagccgcctctgggagcaggaggagctgctggatcccctcctcccaggtttcttttcctgccccccagcgcctcttgcaggcaggcaaacaaccccagcaggagcagcagcaggcccttcagccgcagggctgcagctctgctgaatgagagaagcctctctctggcgagtcagaggagcgcaggccatatacccgggtctctacctccatgtctcccactgtgcccaggactgagcccagcgtgggagatgcgggctggggccgtgctggccaccccctctcttccacctcttgctccagccatgctttcagctccagggctgaggccagtggctagagcagatctcatgatgtcaggtagctcctcactgggctggtccttggcaggaccaggacaggggcaggagggatctggagctgctgatagctccagttctgtccctgaaggggggtcttcccctggtgctggcactggctcatcagctggcgctggaatttcctgtgttgctgcacatggaacaggagatgaaaaagaagaaagactcaccaacgtcagtcactttccactggaattttcacacacagaatcaacctcgctgaatgtaaggtattccagcccgaaaacactgcccctgcaaaggctcatagactataggccacctcaccgtgtgcctgtgcctcgatgaactccagaggctccagctggacaagaacaatgtgcagatgtggccgcgatgggatcaccggtggggcctggcctggtagggcctgccctgggctgccctgtggtacttgggggcgcctttgcccaaatggccagaggcgcctggagtgagagatgagtgaggtattgcccctcacaagagggcattagctgcggggatccgcccacagaccctgacccaaatgacggatgaataaaacgtacactgacacagagttattctgctttgccagtcctgctgagtgtcccactgcctgcacaccaagagaggtttgtcactgcagctggccgtgaatagctcgcactgcaggcatttatttagtatagaatttacaacggaagctttgagtaaatactcttgtggataattaacatggttaagagagtagttctaccaatgattaaagctcaggtaccatggtttaaagtaaataccactgggggcaatttcccgggtctacctcccccctcctccccaagaggactatctggctcaaaggctagttaatggaagtagggtaaacagacttaactggggaagcctctattgtccctaacatttaccctatgagctaatgctctaagataagaagcagctgccttcagcctgttcaattattacaagctatgtaacctttccgccttccaaaaggtttgtgactattccctgtaactttccctaatatttccctttaatatttctgccaccatcctgagtgaatcccaatagatgagcctgcgtcagcattgtgggaaaaggctctcgctctgggccctcctgaagcaggagactcgagatgtgggaatgcagcatgagaacatcttgctctcctgagcatctcccaccaagggagctggctgcgggtctgtccctaggatgtgggtgcctgattaccagagttctaagttctgttagagtccatcaccaaggaagtgaagtcacttctttaaggttccgtaccctcggctccttccttcaaaacctactcagaaccccctgggctgctggctgctcaccctccccccaggtcagctccttacctgtacacaggtaagtccacccagtgtctgcttgtacacctgtgcctgatgtgcacctggggcctgggaatccacttagggcctgtgatccaacaggggcctaatgttgattaaaactaattttgattattcctatggagaaggaaaggccttctagcaataagaagcagagttccaaatcaaatacgtaaaaatgatcaaaaccttgtaaaagaaaagtatcttaattttaatcactgaaatgttaactttttgataaatatttaaggttataatgaaaaataaaacaatactaataaaataacagttgcaggaaatgctattgagtttcttgtttgtggtttgaacactgaaaggtcccacctagttatggtcataatttcctaccttaatcttcttgttcttatgagtaatagaaaaaaacacaatgacgatgaatgtgatgatggttcaaatacacaactgaagtttagtggcagaaacatcaggtgctcccaattacagtgcagctgttcttactgaggtgagaaaaaaaatcttgttttcaatacacacgggaagcaggagtgcacgcggatatgaccgcatttctctgaacttatgtttttcacagaagagctacagtttatcctgcattctccgttctgtgatcaaaaaccatggaacagagaagagcatttcaacctgagactcaattataagaattgcgtctgccccacctccctgcaaccatatatgccacctctctgtgctgagcctgaggggttcacatatggcacagactgaggctggactcaacagtccttaccctcgcaggtgacaggcgttctggggtcacttggaggagggaagctcctgggctctgtcttctccaccagcagggggcagcacagctgcagacagaagagaggctgaggctgcccagaaggagcctaagagggaggccagccatgaaggctcaaaaggtgtccaaggatcagtcctcaatttggaagtccagtaaagtgcatcctatcccctcgggctgcagtaactccgtcctgactgtaagactcatgcagcgtcactcagggcactgacaggagcccagggacagtgagagcctcacctgggaaatgtagctggaggcgcctgggccccggtgtcagcctggggagcttccacagggctgggattccctgggagacgccccgaggtcaaggtgctctaggagggggccacagtgtgagaggacagggtttccagggcccaagcccttcacctagtattgctgcctgagcctcctgccactctcatggtcttgtccctctctgatcagcagcattctggggagctgagccctcagtcctgggcacttccagagacctccccccgccaccccttctccctctgcctttccttccagctccaggcatactgtgactcagggggcagctcctgtgctcaggggagtctcacgtgggtggggtggtgcactcaggaccctggctccaggatgtggcatttccagcctccttgaggagatgctctccacagggaaggggattctcacctgcctcaggccagagctctggccacgaggctgtccttggctcagggacaggatacacctcattgcaggaaccaaggaccacccaccctgcagaccccacaccctgtccaaaggctgtgtccctgggatgcttacagcgaccatggggcttaaagttgaatttcccatcaatatttcatgtaaacttgcaaaaagcacaagaaaaccacactgggctgagaactctggtgctattttgctgttttttacaagtttacataaaatattgattggaaaaataaacaatggcagagctgaggatggcaatggctggtctactgtggggatggggatggcctagaagtatcagccccatgggtgaaatgagaccagacgtcctgatgactccacatgggtgagtggttccttaaatgactcaactattctcactgaaatagttaactagtgtcctaatgacacaatccatcatttagatgaaatgaccaggatgggacatttcctccagccaggaagactgtggacaaattcatgaactgggctggcccagttcacctgggtctgagaccccctggatctgagtccctccagccctccaggcaggctctgaagagggggcgtcaagagtggatttagacttaggtgaccaggatgtattggggtttgaggactcagctgtgacttagggaaatggggcctgattgaatcatcagactgaggtagacatccatcagctgggctctggatttccattggtcatgacaagccagtccttggcctgaatatcctggatcagtccccagaactgcccagctcaggctcaagtcattctctacagaaaaaccagtggagtggacactgtaggatctgcccagattctttcttctgagctcacccacccagcactgctgggagcttgtggcagctgagagctgtgcctttcctgggaagtgtggctcagcgcagaaaactgcctcctccaggtttatgcccttcctcagcaagattaggtttcatgactgcctgaggccaagttctcaagactctgcctcaatataggaggaaatgaaaatcctcccagctccacagctccctgtaggaaagactgagacctcaatgtgcgtcagggtctctttccgcccagtgttgcctccctcacatcctctgtgcatgaattcctcatctcagagtctgcttccagggaacccaaattaagatcaccagccatccccaacatgggccatgcggaacctcaggaggccactgcacactggaaagcgcccatttattcctaaattagcactgtgagtatccaaatgcccaatgagatctgagtgtttcttgcatttgtatggaatggaaagggagcctgacttgccaggtgctctgggtctgagggagagttggagtcagatctccctgcagggaaacccgggacaggaggagaagcctcaccccatgcagggaccacagatgcacccacagggtgagctgcaggatggacactgcccacagggtgagctgcaggatggacactgcccacctccaccctccatgccctgtagaaaaaatcattctttccacccctccttcagcctatcaaagttgacacttaaaaagccaccacaccccacccttgtcaacaggaaacccattcacatctccatcagccacacaatctccaagattcttcaaaaaataataacactagctatgcaaagtatatgatatatatcataaataattgtacctagattatatatgaaaatgatactttttgatatgctaggtaaataaaatatattatttaaactcattgacttcttctctttgtatttataatgcgatgactagacagtgggattcccatgaggctcacatcatattgtgattgaacaaggctggtctgcagggcttcaggttacaggggctgtggagtgacctggtgcaggaaaccccgtctccatccataggacatcagtgtgaacccagggagaggcgctggtatgagagatgagaacacaggtgtgaaccacctgcttgtgcaggggactgagccttcactttgagccaaagaagtttcttttcctatcttcaatcctgaacaagagggctttctggacttctttttgttttcagatttgtgccccttcaggtttggggctgtctggagtcccagccagaggacagtgaggaaatccaggagtctcacactgactctgttatatttcatctgctggggccatcccaaactgctgtgtaccatttcctttcctggtgctcaaatagctgctccattcacctgtcatggtttcagagatgaatctaggtgggaagacaggacagtgtatgttataatatttaaatggaagctgattccattaatatttattttaatatgaaacattaaaagaattttgttataggctatagggaaagatgaaaagagattaaaagtattttgaaaaaatgtatttatcgaatgtctgtgtgtcttcagtgttgcagggttgagagaggtcagctttaggttggatgtgctcagatgaggaaaagcaagaaagcaggaaacacgcggctctgtgacctgacacataaatcacagtaaaatggaaataaatctttcaataaatgaaacattcaaaataaacgtcactctggtgcacacagaaaggcctattagcaaactttccctttgtcctgctggctcatatccccatggatcacctgtgtgcagagtggacactgtagtccccatttctcaggctgagaactagaggctgggaaggacaagtcacctgcttgtgagtgggaggggcaggattgggagcagtggactcgggctcaggactgcggccctggtcggtgctctgtgttccctccacaggatccctcccacatgtgcccgtgtggatgtgggtgcactgcctggggtggctgatgtgctccagggattcgatggtgcagatgcttcagcacaaagcttgggggtggggatgggatgaggctgcagctggggagaccagggaccaatgccacccagcagaggtttccacggggtgggcagccccatttcctggcagtagagacagcctggaggtgggtgccaagcagagggcactgcagggtgtgcccaggcctggagggtcacaaagacacaggcaccacacagcagagtcactgaggaccagaagctcactcaggtaagggatttcagcagaactttctctcctgagcaaatcaggtacaaaaaaattaagatcctgccatcagaaaagacaaacaagaactttttatctcctcagctgagccccactgtccagggaagcagaagtctctgagcccagcccaggtgagggtggggtgaggagaggagctcagggtggagatttgcatggaggccccaccctcctctgaggcagaggggataagacagggctgggggcaggcccagtgctggggtctcaggaggcagcactctcgggacgtctccaccatggcctgggctctgctcctcctcagcctcctcactcagggcacaggtgacacctccagggaaagggtcacaggggtctctgggctgatccttggtctcctgctcctcaggctcacctgggcccagcactgactcactagagtgtgtttctccctctttccaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttccacagtggtccaagttcctggggaactgagaccaaaacccaccctgggctctcaggctcccttttgctctgaagatgcttcctcaccctgtgcaaggggcttcctgcagcacggccttgagaattcttctctctcagctcctctcctttcccaccatgaaatccaacaggaaacctgccctgtggtttctcatcccggacagggacagcttcctggtgcttgtgtgctgtggtccctgaatgtgcagctcttcccagctcttcaaatgcagggacagtgacaagcagctgcctgattggtgcagtcactgcttttttttcagagatgtcttcaccctacatgcatcaccatctcccacactgtgggtagaattttagccaaatatggctgggcgcagtggctcacacctgtaatcccagcactttgggaggccaaggctggcagatcatgaggtcaggagatcgagaccatcctggctaatacggtgaaaccccatctctattaaaaatacaaaaaattaaccgggcacggtggcgggcgcctgtagtcccagctacttgggaggctgaggcaggagaatggcatgaacccgggaggcggagcttgcagggagccaagattcgtcactgcactccagcctgggtgacagagcaagactccatctcaaaaaaaaaaaaaaaaaaaagaattttagcaactacattctaatagttatcgccacaactttgatcttaaataacagtgcagtgaacatccctatgcagcctcctttgagttcctgtgtgaatatgaccataggatacatttctaaaactgaaattgcgggtcagaaagatgtgtgtttgtaattttcacccattgttgtcagattcccctccagaggggttctaccaacttacaatgccaaccataagtatttgttcagagtacattgttgaaagtgtaaatttttgccaacctaccagactgaaaaatgttatcttgttacagttttatttttgagtctcccattctgcttaaggttgggccttttcacaaatagttcagtactctttatttttttagtatttggtaaactttttcttgaatatccaaataagaagaattttagtctttgtggcaaggcacagtgggtcatgcctgtaatcccagcagtttggaaggcttagacacgtaaattgcttgagcccaggagttcgagattagcctgggcaacatagtgaaccctcatctctattacattaaagaaaataaacataaattttaaaatgaagtattttagtctttgtggcccacgaatcaactttggggatattacataggtacttacagcaccatttataaagtaaccatttaaaatgataaaaaccactgtcagctctgggccacacaaaaacaggtgtcaggccagttctggcagggtgagggctactatggtgggaaagggaaatggaagccagtagagcttctcctacctagaaaaatagtaaatcaaaaacagtgtcatatccctggagggattgcagagattagtgccaccatcaaggacttgaaagacacagaggtggtgatcagcaccacatccctgttcaactctcccagttggcctgtgcagaagacagatggatcttggagagtgacaatggattatcataagcttaaccaaatggtgacttcaattgcagctgctgtaccagatgtggtttcattgctcaatcaaattaacacatctcctggtagctggtatgcagccattgacttggcaaatgcctttttctccattccggtccattaggcccaccagaagcaatttgccttcaactggcaaagccagcaatatacctttactgtcctacctcagagatttatcaactctccagctttgtgtcataatcttgttttttttttcttttgagacagagtctcgctctgtcaccaggctggagtgcagtggtgcaatctcagctcactgcaacctctgcctcctggattcaagcaattctcctgcctcaacctcctcagtagctggggctacacgcgcgcaccaccacgcccagctaatttttgtaattttagtagagacggggtttcaccatgttggccaggatggtcccaatctcttgacctcgtgatctgaacgcttctgcctcccaaagtgctgggattacagacctgagccaccatgcccagccctttgtgtcataatcttattcaaagagatcttgatcacttttcacttctgcaagatagcacactcgtccattacattgatgacattattggattggattcagtgagcaagaattcacaaacacaatggacttatcggtgagacatttgcatgccagagaatttgaaataaatctgactaaaattcagggaccttctacctcagtaaaatttctacgggccaagtggtgtggggcctgttgagatattccttctaaggtaaaggatacgttcctgcatttggctcctcctacaaccaagaaagaggcgcaacgcctagtgggcctatttggattttggaagcaacacattcctcatttggttgtgttactctggcccatttattgaatgaccctaaaggctgccagttttgagtgggttccagaagaagagaaagctctacaacaggtccaggctgctgtgcaagctgctctgccacttgggccatataacccagcagatccaatggtgcttgaggtgtcagtggcagatagcaatgctgtttggagcctttggcaagctcccataggtgaatcacagtgcggtcctccaggattttggagcaaggccctgccatcctctacagataactactctgcttttgagagacagctgttggcctgttactgggctttggtggtaactgaacattgactatgagtcataaagtcaccatgggacctgaactgcctgtcatgaactgggttctttctgatcaatgtagccataaaatgggtcatgcacagcagcattccatcatcaaatggaagtggtatatacatcatcaggctcgagtaggccctgaaggcacaagaaaattacatgaagaagtggctcaaatgcccatggtctccactcttcccccctgctttctctcccccagcctgcaccgatggcctcatggggagttccctatgatcagctgacagaggaagagaagactagggcctggatcacagatggttctgcaagatatgcaggcaccacctgaaagtggacagctgtagcactaaagcccctttctagaacatccctgaagaacagcggggaagggaaatcttctccgtggacagaactttgagccgtgccactgggtgtgcactttgcatggaaggattttagccaactacattctaaaggttattgccacaactttgatcttaaataacagtgcagcgaacatccctgcatccctgcatggaaggaatgccatttcccataaatcaccaaatcactcagaatgactacgcataagcccttaatatacgccagatgcattggttattgttttacaagcgggacctcaagaagactttcataatacggaataggatgatgcaaagccctatgctcaaggcccgatctttactagaaaactagtattgggaggttacatgttttccccaaacagatctttgaggaatcccgcagatgccaaagacctgctggcctaagagtagacacttattttctcacagttctgaagctggagagccaagataaaggtgtttataggtttggtttcccctgaggcctctctccttggcttgcaggttgctgcctccttgctgtgtcctcacatggtctttcctctgcacactcatttctggtgtctcacttctgcgaatgcaaatttttattagcctgggttaataatttttatatcagcctggcagattctatcactgatttacttgattatcctatttacttgattattaaactccttctctgctgaggtcacccattggtgagcactcgcatgggatacaaatatcttcacagtttttgatcactcagagggatccatccacatagctcttccccaaatttctttgtcatcaattttccaatcatgcttcttccaagtccctgatcatccaaccaaaccattggctacagcctatgaatcagtataaaattgcatatctggacatttctccttccaggcagtgctgagaaaagtggacatccacatgcagaacaatgaaactggacccatctctctccaaataaaaaatcagcccaacaaggattacaaacctaaggataagacctgaagctataaaacaactagaagggaacatagataaaattcttcaggaccttgggatacacaaaaatttttatgactaagacttcaaaagaacagacaacaaaaataaaaatagacaaatgggagtttattcaactaaaatgcttctgcaaagcaaacaacagattgaagacacccttagaatgggagaaagtattcatgtgaataggtcctaatatcctgttcatctgaaaaggcataatatccagtgtaagaatagaggacaaggctctaaaataactgattagcattaaaaaaaaaaaaagtgggcaaaggacctgaatagacttttctctaaagaagacatacaaatggcaaacaggtatgtgaaaaaatgcttaaggtgactaataatcagggaaatgctaactaaaacccaaatgagatatcatctcaccgctgctggaatgactatcatcaaaacataacaaggctaggcgcggtggctcacgcctgtaatcccagcagtttgggaggccgaggcgggcggatcaagtggtcaggagatcgagaccatcctggctaacatggtgaaaccccatctctactaaaaatacaaaaaattagctgggcatggtggtgggcacctgtagtcccagctacttgggaggctgaggcagaagaatggcatgaacccgggaggtggagcttgcagtgagccaagatcgcaccactgcactccagcctgggcgacagagcgagactccgtctcaagaaaaaacctaacaaacacccgtgacgatgaagagaaaatagaagaaaaaatcacatgactgtctcaacagtcagatcaaatgttttctttcaaggaaacatttttgttggttgttttttctagtcttgttagagcatcacgcatgataagatttgtggtacagaagttagaggggatgttgttccatgcaaaatatctgaatatcccatacccaactcttcggttacttactgataaatgctaaaaggttacaattttgtattttcaaatattctggtggccagaaacctcttccttgacaagtctggagtacaggtatctgactccagatgattagaatttaggcaggtattgtgtgagcagtgaggtcacacacaggaaacgttccagtcaaagagaaaaacagacggaggctgaaacacagagatcatatgtctgagaaataaggaaattccatactaatgggagctgagtgagaacaagatatgaaccatctatttctctctgaatatctcattgggatcttgtccctttcccagcataccactcatgtggattttaaaattgtctgctcttaaaacatttcttgcacatcattagagagtccagcactggaatcaagctcagtttgatgagaccagggcagttaagcaccaaacccaggtgttcttagaagggcttgtagaagacaaaggtgtgttgtcaaaagcagagaaagtgagactttccattgtggtttaaaccacagcttctggaatttcattgggcacacaaatcccctgaggattctggttaagatacagctgtgccctcagcacatctgggtatggccccagattctccatgtctagcagcttccaggtgaggctgatgctgctggtcctccaaggacattttgagtggcttagctcctattcaccctcctcacgcaggcacaggtaagactcacctaatgaagaaacctgagaagcacaggtgaactctccctcccctcctggtgtcttagtaccttttgtgttgctataaaggaatacctgaagctggatagtttgtaaagaaaaaaaagggtttattggggtcatgcttctgatggctggaaagatcaagattgggtatctgcgtctagtgagggcctcaggctgtctccactcatgatagaaggtgaagggaagccggtctgtgcagagatcactgggagagagaaagcaagctttttttcctaacaaagctgcagggatgtaattgagtcatattcataaagtgctcaatacagggcgtaacatattcaagtgctccttagtggacagcaattattactgaccttgctcatgaaaattagacctcagatggaggaaaggcagtgccgagggttttagattgttcgaaataagagagattaaaatgatttaaaatagaggcccaggagctgaggcaagcatccccaggtgttctcctgccaactccccccatgtctcagaagctgttttcaggcaagtcagccagggaggaaagtgggggagtttgtagaaccaaggattgcaacttcatccatgaggaggaggtgtagccagccaggtggggagaggctgctaagctcatctgaaggctgttgaaggctttctggccccatggtcctgggccatccctccctgcccagggccgcattcctcagctgacagccacaaccttgagagaggcctgtgagtctgatcagaaatcctgccagggccccgagggggcaggcatggaagggaggtgtctaaggtcacaggagacactatttgctgcctgtggggctgggacaggctccttgagaggaaattcgggcactgtacgggaggaaaacacaggacagggaggcctctccccaaaggattgtgatgatagagaccaaagcatctgcaaagagcccagccctacaggggattctctgaacacagcattcctcggggcgtctgtgttattttgccagggttaccataataaagtagcacagactggatgctcagagaaaagaaatgtcttctccactaatctgtaggtgatgttagaatctgagatcaaggtgttggcagggttggtttcttctgaggctgagcgagggcctgttctgtgcatctccctggcttcaggtgcttctggaaggatgtgctgttccctgaattacagacaaacaccccaatctctgcctccatgttcatatggcattttccctatgtgtgtctctgaccatgtttcctcggttttttgtttgtttgttttttgctgttgttgttttgttttgagatcgaatctcgctctgtcgcccaggctggagtgcagtggcatgaccttggctcactgcaacctctgcctcccaggttcaagtgattctcctgcctcagcctcccaagtagctgggattacagatgcctgccaccaccttcagctaattttcatatttttagtaaagatggggtttcatcaggttggccaggttggtctcgaattcctgacctcaggtgatccacctgcctcagcctcccaaagtgctgggattacaagcctgagccactgcattcagccatttcccccttttataacaacaccgctcctgttggattgggagcccactctacttcagtatgatgtcatgttaacccattacatctgtaaccaccccattcccatataagatcccattttgaggttctggggctgaggacttcaatatcaattcggcgggggggagcctacaatgtaaatttgtaacattgtctctgtcatgggccagctgtcaatattccctgaatatccaggatccacccatgctctctggccatcaccagagtgagcaaatccctgacacatggataagagttgcttccatgggctcccagccaggctggaaattcttgattcatggaatcaagaatctttctccagtgggtggggctaaatgcagctgcctccctgacagtctccctgggacactaggcttatcagcttttctcctaaagctgcaggtcctgactgtcctgagccccagctctgctgtggtctttgcatcttaagatcttattcaactcgcttttgtgcctcagtggactgacttacaggaaaacagtgggagatgcccctgctctctctccccagggtctcctcccctcagtggcacaagacctgccctattgactggcagtccccccatgcccatctcaacctccacactgcccactgtgcacggtcacaggtcacaaactgattgttcactttgggcagatcaccttgacagtttctgcagaactgggtgcttcttcccagaatcaggaatttacaaacaaggccagttctagagatgcaactgggagagtaatgtgcatcacagcgaatctggacaagacaaagtggttttgctgtagttctcctggaacacattctggtgatgtgtccatctcccaggatagtcttagcaagttacatccaatgctgcatcaggacccacaagaaaaggaactggcctgcatgagtggccggcagggtcctgggaggagaccctgagatgcccagtgacaggaggagtggattcttaggttggtaagcgtgtggaggaactgcgagtgatgtgctcagccaggtacaggagcaggcgtattggtgacctgtggcctcatcttatctcagttgtctctttagaccaaactccaggaaatcagcacatagagacttctgtctgtctccgagatcatcgcaggacttcacacgtcttttctatttataatacaacatcatgttgtgattgaattactttcatcacagcctcaacagtcctaggtctgaaaactaatacatatacttagaatattaattaaggaatactttcttgtcaattatgtttattaaattaaaagacttcagtatctagtgttacagctgtcctaattcaacagccttgaccttcttagaaataaaatcctgatcccaaatttttctggggatatgactggcacaaggagccaagcagacatctggatgtcccagtgtcactgctgacatgtgcttttttgttatctgtcatggggtgaacagaggaagtgtccctacctctgtccacagaacccatcaaagacagtgcacctgattaaagaagagagggttgtgatcagaggggtccggggtcctgggatgaggtgggaggaggagactcatgggaagaaaggaagcagggcaggaagaagctgaagttcaggctctgaggtgcatctcctgcatggaatcttgactccactcacttctgtcattgtgtaatctttcaatgttggttctgtcatcagtaaacttgaggagaggttatgccataagcatagggctgaggaagggttattataaatatccagtcatggttgtgcctataaaacactcaccaaagactctgaatatattaaggtctcataagtagttgttttgcataatctagtgatacatggaggatggcattcctcctgtggacagcaggaggcactgtgggtgtatcgtttggggatgctaatagctccaagtcccccagtagagctcacgtgcaaagggtgtgactgatgtttcctttcaggtccagtctttttgagtacaatccactctccactcctgacacccacttggcccttctcctgcctttgagaaatgactaccctgaggccatcagctccagggctcagctatgagctcagacagacacgcttgggaatagagaacagatttggattcaatgctccttccttcttgagcttcaagaagaggataagataggagctggttgtgtccaggctccactgggcagcctcgatcagagctctcggaagtgcctcccaccacggcctgtgtctccttctacctcctgcccttcatattctccacaggttggagcatccagagaattcagggaaaccctttcactgctatttccccccagcactggtcctcagtggcattctttccagttctcctgtgcattcagcatcattcatgaaattatatgtttccaggtctctgtgctctgtctgtgctgacccagcccccgtctgcatctgcctggctgtgagcctcagccaaggtcacctacaccagtgaatagtatcaacagagaccaaggaggtccccctagtgtataatggaggttaagagtaatggcagcgacagcaaggggaacaggatccccagtcacttattgggctccagccctggggctgaatgctacttaattatcttcaacctccaatctgaggatgaggccgagtatcactgtggagagagccacatgtttgatggtgaggatgggtgagccacagtgacacagaccaagaagtgaggccaaaacataccccctccccttcctcttcaaggactgagagtgagaagccctatgtcatctccattgaccctgagaatgttgactctccccctttcaaatttcatcatcccagatgtcctccctcaagacacccttaggcagaggcagatgcaggccatgattgaggccattttgataagtcatcaatctgtttccaccacaccagcctgtggggactacactgggagagaccagaacagcccaggcaggaaaacggccctgagagaggggtcgggctgagatgactgcatccagtgagtgccattgcaccctgcacccctgcctcaggggactgtcatggggctctgcctgaggaggcaacatggatcttgacatgtccccagccatttatgagaactgtagttgtgtgcatcctcattaacactcaatattattgtcagtttttgtttaaagccactctaatagatctgtagcgattcttattaattttttaacttgtattttcttagcaacatcaggctgagcatcttttcaggtgcttgttatctgtatatcttctttggtgaaaagcttaatcaaatcttggtctatttttaaaattcacttttccccatattccccttcatgcagtatttttcaaaaatggtgaataaatgaaagttttgctgacatttaaaaactcacagaattgttcaccaccagactgttgctattagaagggtaaaggatatccctagacagaaggaaagtgatgtcacattgaaatgtgaatttacacaaaaaagtgaaaacatcaggctgggcccagtggctcatgtctgtaatttcagcactttgggagactgaggcaggagtattgcttgagcacaggagtttgaggctgatgtgaggtatgatcataccactgcagtccagcctgggcaacatattaagaatctgtctctattaaaaaaaaaaaaggaaataaaaaaattaaatatcaggtacagtaactacatagatacttgtgaaaacctctgtattatgttaatgccaataaaatacagttcactgatcaaagataaattaataaaatacattgtgatttataatgaaaataaaggcaaattatatgacaaagacagcacaaaatctgtggtgggtgaagaacatgttatcaaggtctcatatgggaatgtgtaacaactgcaggtagattttcataagatctctatatacataaaccttaaagtagtcattaaatcaaaccttttgatcaaaaaagaattagagcgaataagctacattagggttatccacagaaacaaaattggtaagatatatatgtgtgtataacatacatatgtgtatatacacatgcatgtatgtgagcatatcgagagagagagagaaacttaaaagaagaaattggttcataggattgtcctgtctgacaaggataaaaatctcttgggcaggctgaaggctggaaatgcaggtaagagttgatgttgcgtcctgagcctgaattcagcaatacaggacttaagaaatcctcactctttgctctaaacacctaaacactttcttttttttttttttttttttttgtgagacagagtctcactctgtcacccaggctgggttacagtggtgtgatctcagctcactgcaatcgccacctcccagcttcaagtgattcttgtgcctcatcctcccaggtagctgggattacaggtgtgcaccatcacatccacctaatttttgtatttttagtagagaccggctttctccatgatgaccaggctggtctcgaactcctggcctcaagtgatcctcctgcctccttggcctcccaaagtgctgggattacaggtgtgagccaccaggcctggcctgctctatacactttctactcatgaatgaggcccaccgcattgtgatgagtaatctgcttatacaaagtctactgagttaaatgtgagtcacatctggaaaatatcttcacataaacttctatgtttgtactggacaaaatcaacctggaaccacatcctagtcaatgtgccacttaaaattaaccatcacttaagccggcatgaagatagaaaggaaccattttttaaagcaatcaaaaacagagacagagaaagggaaagaaaaacaaggaacatatccatagattgtattttttaagtcactttttgaggttttctgttgttttcctgttttctatttcattgatatttggctcttaactatattaataccttttctctatttaaattgaatttcaatgctctccttttccttagatttatgaggtagaaccttagtttattttagatcttgcttctttccactgccaaacattcaatccaatagatttatttaaaactacttacttatatctattttttaaattttaatacatttgtttttgtgttttaaaagttcagtattttctaattttgttgtgatttttttctttgacttatgaaatatgtagttttatcttctttcatttccaaaaaattgaagatttaccacagttcatcatgtatcaattccatttaattagttaattctgcattaaatcataccttgcatgagcttcatattttcaaatttgttaacatttgttttgtggcctagaataggaagtatcatgaaaaatgttccctgtgtatttgaaatagcaatgtttattctgctgctgtgggtatagttttctacgaattcaattagcctaagttggctaatagttcaaatatatattcttactgtttttttgtgtatttattttgtaggtctgtgagagagagagctattgaaatgaacaacactaattgtagaatttcccattgcttcttttgagagaggaaaatttccagtcatggttcttaatactttattctcctgacaaaaggtcacctatgattttccaacactaatcaaggaaaaaaaaaaggcagagttaaagccacactcatggatgccacgggagcagtgggtgaccacatgatgtccctccactggttcagtagatttagcgagacattatattttggcttttaaaaatcataaatctggctaagacatccatgaacaaatttgaagacatacacattgaataaaatatgaaaattaaaagaaaggtaactgcatacgtaaaacattgctatcacagcacctgactcatgggaaatggataaaaagtattataaattcaattacatttacttacacattaaacaaatatgaatttaaaccagttcactaaactgtctcatatactgtttaggtgatggagatttattggtgcacaaaaaagacaagaatacctgctctcagagtggcatcatggaagatggtggagtacgaagctccagcaaatggtccctcctgtgaaattacttgaagtggcaagagtcatgacattaactctcataaaacaacagaatcttgtcccacatttgcagtattcagggatgtgccgatgaagagagagacataaaataatctctgtcaggtcaatttctggccatggaaataattgaacagaaactgcatggatcactctgacaaggaagctggtccttaccaaaatattttggaaatgtcaccacgcaattgaataacagcacctttcagcaagcaacatcagccaaggcagagaagagagacaatctgatttcgagagtgacaatatcataacatccaaaatacccagatctcaagaaaagtttacaaagcagacaaacataaaagaaagcaagacccactaaaaggaaagaaataaatcaactgaatgcattcctcaggaagcacaggcattgcacgtgctacacaaacacttcaaatgaactgcccgtatatgctcaaaaagcaaaaggactccatggaaacagaactaaaggaaagcagggaaatgatgtttgaacaagcatgaaatatcaataatgacaagttttataaaggaaccaagcagaaatactgaaactgcaaagttcaatagctgaaatcaaaatctcaccagaggagttaagtagtggtgtgagcagacagaagaataatcggtgaacttgaagatacatcattgaaattccacaggatgagcataaatttttttagaaaagaataaatgaacaaagcctaagagacatatgagacaacatcaagcatatcaatattgctttatgggagtttcagaaagagaagaaaaacaggaaaggaaaaataaaatacataaagaaaaatagctcaaaacttctaagtttgatgaaagattagaatctatactttcgaggagctcaataaactccaagcaagttaaactgaagtctgcagtgagacacattctgatcaaagcatcaaaagccaaatacaaaaggaaaagtgtaaatagtaacaaaaggagagttggggtagctaaagcaatttcagacaatataggcttcaagttaaaaatgcttacaagagacaaagaaaggcgttataattgatgaaataaccaactagtcaagaagacagaataattatgcaccaagggatagcacttcaaagtacataaaggaagaccaatttgaaaaaaaaaatatgtagatctataatataacttggagacttcacttctccacttttactgaccacctaggccgggcatggtggctcacgcctgtaatcccagcactttgggaggctgaggcgggtggatcatgaggttaagagatcgagaccatcctggctaacacagtgaaaccccgtctctactaaaaatacaaaaaaaaaaaaattagctgggcatggtggtgggtgcctgtagtcccagctactcgggaggctgaggcaggagaatggcatggacccaggaggtggagcctgcagtgagcagagatcacaccactgcactccagcctgggcaacagagcaagactccatctccaaaaaaaaaaaaaaaaaaaaaaaaaaaaaaagataataagagaagagacacaaataagtaaaatcagaaatttgggacaatagtacaaagcttatggaaatttaaattataatagaagaacacacaagcaattgtatgccaaatcttagaagatatggacaaattcatagtaaacacagattgccaatctgactcaagaaaaaagagaaaaaaatcaacagaaatatagaaaataagggatgtaaatcagcaatggaaacttccgaaaaaagaaaaactcaaaaccagatggcctcactggtaattctgctaaatgtaaaaaggagttgatatcaaccataatcaatctcttcccaaaacagattaagaggaagtacttcccagcacattcgaagaccctagcattagcctgacaccaaaggcaaacaaggatagtattttaaaaaaactaaactaaaggctaatattccttaagaatgagcatgcaaaaatcctcaacaaaataaaagcaaaccaaatccaacgttaagttaaggggaataaaggatttcaaagatggttctacataagaacatgaatcaacgtaatatatattaacagagtgacagaaaaagtgtatgatcatctgagtagatgcagaaaaagtgtttcacaaaattcacattttcctgattaaaaaaaaaacacacactcagcaaactcggaatagaaggaaacttctacaaactaataaaggacctttatctaaagccacagtgtacatcacattaaatggtggaagagtaaaagcttccctactaagatcagggacaaaacaaggactcctgcctccacaactactatttgacattgtacagaagttttagtcaaagctcttaggcaaagaaagaaataataggtatctagaatggaaatgaaggagtaaaatcatccctatttgcacagaacccgattctaaacgtacaatatcccaaagaatacacgcacagaaaaactaacaaagtgaataaacacattgaaccaagtttcaaggtacaggaacaactggacttgccacaacttttctttgttatcctgggcattagttctcttggcctcaattttatctttaaaactgggaggcttatactgcagttgagaaaaagacacaaaaagaacctgttagttaaagatggaataagtgaatctcagagggtggacataggttggtgaggtcctgtccatctctgggggcatttttctggagtgtgggaaagcatgttcccagatgtgttagcaagatactcgcaattttctcaaaacaacagacaaggatagtgtagaaatcctcccaccacaaattgtgaacagtgtgtgatgaaataaaaataacagtcatagaaaaagatggcgatgatgatgataatgacttaagtacacaactaaggtttagtgatagaaacatcaggtgttcccaaattcaatgcagcttttcttataaaatgggggcaccagtcttagttcccatatatttaggaattgagggtccccatgaggtgtcgctgcatttctctgggcttttatgtttatcacagaagagctacagcttaccctgcactctccagcccgcaatcaaaaatcatggaccaaagaacaacatttcagcacaagactccattatgggaattgaatctgcccaccctcccgaaaccatatacacctttctgtgctgacatgagaaaaccacagtggatcacactggctcaaagtgaggctggactcctttgtccccaacctcccagatgacaggtgctgtggggtcacccggaggagaaaagctctcctaggctcagtcttgtccaccagcaaggggcagcagagctgcagccaggagcagccagaggctggggctgcccaggtggagcctaaggggtaggcagccctgggaggtctacaggtgtccaaggttcagtcctaggattggaagtcaggacagtccatcctattgcttctggttacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgaggtgctctaggagggggcccagtgggagaggatggggctcccagggctcaagtccttcacccaggatggccatctgagcatcctgccactctcggggcctcgcccctccctctccagcagtgtcctggggagctgaaccctgtcccaggcacttccagggacgcctgacccctcctccctctgcctctccttccagctcgagactgactctgactcatggggcagctcctgtgcgcaggggagtctcaggtgggtggggcggcacattcagggccccggttcctgggtggggcttcccgggcctcctagaggagatgctctccagagggaagggggttctcacctgattcaggccagagctctgaccacaaggctgtccttggctcagtgacaagagtctgctgcattgcagagaccagggaccacccaccatccagagctcacactctgtgcaaaggctgtgtccctgggatatttgcagagaccaccgggcctaaagttgaatttcccatcaatatttcatgtaaacttgtaaaaagcaccagaaaaacacactggactgagaaccccgatgcttttctggggccttttacaagtttacacaaaatactcataggaaaaaataaataaataatggaagagctgaggatggcaatggctgatctatgtggggatgggggatggcctaaaaggagcggcaccatggctgaaatgagagcagacgtccagatgatgccacaagggtgtgtggttgcgtaaatgaaccacctactcctactgaaataattaacaagtatcctgacgacacagtacgttatttagatgaaatgaccaggatgggactaagtaatgctgggggacccagagaggagggggaatatggtgggttcttggtccacctgctgctgagtcaggtttcatcaatgatctctcagcagggccaaactcagccccaagccaggtttctagaaggcccgcagccctgctgagcctggcccaggacagaccacaggtcagagaggtttgggacagtggtcatatggccagtccccaggaaggtgactgtgatcacaggcctcagaggtcgaggctaattttctgaccaaagacccaactccttcttcagtcacctgtgctgcccccacagctagtttgagtgacatctttcaatgaggagtcccagaggatagaaatttgcatgaacaccaagcacttactgccccatagggcctgggaaggaataagagaggcctggggagcccagctgtgctgtgggctcaggaggcagagctctgggaatctcaccatggcctggacccctctcctgctccccctcctcactttctgcacaggtgcttctcccaggccctgccccaggctcagtgcccatagaccccaagttggccctgccctgaaccctgtgcaaagcccagacacagtcttagggtaggacccctgggaatgggctcttgatcttcaagccccctctcctgttttccttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatagcacagtgacactggcagatggggaagtgagacacaaaccccttcttcatctattttaccctctccctccagccccaggaccgctgtggaccaacccataagcaggtctggcagaattcacctggttaggagatccttaagctgcttttccctccactcctctaggcagactttgcaggaatgagtcaggagtggatttgggcctggcagggccagactgccctgtgtttccttgcccacggtttgagttgtgaatggagagtatgagtggaaagacagacacagcgggacatccatgcaggcatgaacagcccagagcgacaggggaaactttcagctctcagttcaatgcagtcattgttttatctcttggaagaagcatttctccagtgcaactaagactctagactcacagagcccgaggttgtgggggaggacattaaattttgctcatggatcactaaggacgtttttgagtggagccactacaatttattcattgattcctggactcatggatcctgactgtgggagaaatagtactgcatattgggcactgctgtacagcgcatgccccatcctcaaagtcattgcccaaccttacatgtttttgccatcctgctgccacagtaactgagtcttcaagcagacactgagccattcatataagccagatgccacattggtgaagatggtaagacacttgaatgccatgaggatgggcccatggttgctgtttatttgctgtgatatgagttccttggtcaaagccccctgtggaataccatcatggtgggtgaagcattctgtagtccagagataaaaggtttggcagaagcactgcagtcaaagaaagcaaatccctgtctatactaagtgtgtattctggcaagagcaaagagctatccctgccatgaaggaacagctttaatgaaattaatatcaaccaggcatcctatagggatcttcctgttggtcttcactgttggcagatggtcactcagcagtagctacagccaggtcagctctagtgagtggtagtccactttgatgagtccatggacagcctccttttctgcaaccatagggcatttgttattgagccaattgggcaatgatggcagtggttggggcagactgccaggtgtccagagagccacccatcctaccaacctgtttagcaaaatcaattccttctcatgtcagacttcacaaaatattcacataggagataaatattctcatgctttctgcttgctcacacatctctccctcagacacagttgtgatcaatattctgattgtatttcctgtgtccctgaacatccttgatcatcttccaagtccctgagtcacagcccatgaactaggaacctctgcccgtctctctttgcagatgacatgaaccaggtacactgctctaagttctgccttaaggagagtgttcctccaccactgctgttcagggaagcccagaggccaggtgggatactagcactgtccacagcagggatggctgcatgtcctgcagaaacctctgtaaccccagtctaagtgcctcctcctaggcagctggtcccagggagcccctcaggaggcccaggctgtaaggtgagaggatggccatggggcaggagttggcccgtgtctatctggccacctcttcatgcaacttatttgtccttgtgacctgatccatcaggtctcaggtacagcccagccatgtgatggggaggccactataaatggccacctcggactgggggtcagataacatccagctcattggcagcttgtgtcccatggtgagctctgtggccacagtcacaaagagcccctgttgaggcccaggagcccccccagtcttcctctaatggagctttctgctcatttagaaaaataacaatggggaggttgctcgcctacctcaggtctagggtcactgggaccacctagaccacatccatgatcttgtctgattattctgattccttgttggcttagctatgcattagtgtaaccaagccacagtgtcttaggcactaaaatgccactacttggcccctgcctaccctggggtcctgtcaaccacatcttggtatccaattcagttttagcaccactaagagaaatctatttttatattgagaacaggaaacattagttatttctattgtggaaattttataagacaatagtgtggaaatgttttaagagacattttacttagagtgaaagaccttccattaaaccactcaataaattgctccataaatggccagcccaaaccctgagttcagaccaggcacagcctcggtgttgggaccttctgggaatgggtctctgtcatcaacccttctctaccctcctgtctgcacagccctgggcctcctacatgcagggacagctcccctcagtgtcggtagccctgggacagatgaccatgatcatatgctctggagataacctcggaataaacacgcattttggaacaagcagaagccaagccagacctcaatgtcggtcctctagtataacatcgaccagccctcagagacctctgcttaatttttaggccacaaactagcgaacatggccaccctgaccatcagcagtgcccaggccagggacaaagctgactattactgtgcctcagattgtgacagtgggggcagctggcagggactcacagtgacaaagacagatggggacttgcaacaaactgtcccacttcagcctgcctctcattcttacctgccctctgagcagctgtaggtcaggcctcagaatcaggtgtcctctctggtcctcacctggtccctgcagggccggagattcgtaacagcttttccatactctcagggcctacatgtgttcaataaaacctgtacgggggaagctcgttgaagctgcaaggaccttttacaggtttgtagaacacatgagaacttcaggaatccatatagtgtcacatggctccatgtgtaattacacgtcacacagggaaggagagagctgtttcacagggtgcaatcctactggaattcgtcttttccttgcgtagaaacagcttagtggaagccgtgtctcctctggtttcctagatgagttgaccccacattgtaatggggcacctgaggcctaaggaggacaggagacccaacccctgtgggccccaggagccttcctgtcctgacatttcacagaaactgcagaggaagtgcaggcccaacctttggttccacctggggactgtcttcagggaacactgacctttcccagtccccaaattcccaggacctgtctgacctgactaggtgtgcctccagctccctgatagcttggattttatctctgggctctgggctgctttctgaggagctcactaagaagtccttggtgccaagtgcaggacttgcccctctgctccatatcccgggtctgcaggcacaggggacaggtcctgctaggtgaggctggcaccctcttccaggagggatctctcatcccaggccctagggacaggttcactgggctttcttttctcacttagaatctcttagtctttttgtttccttctttaagagtacaactgctttttggtgaaatcatgtgtatacatcaaagttaacagactactgtcacaagcgcatatatatacacatcctcttcctagatggggtaaccgtggacactctgccatagtcgtctttttgtttctctctctctaccacaagtgagactattaatagcactcttctatgcagaccataatcatattctccagttgcacaagaacgattcttatagttgctcaatttccttgcctttcaggaccctgaagtttcccatgcccacatttggttgccatgtctctctgatccaacagtattccttggaagccgaggcttatgaaacattttgcaaaaagttccacaagaaaactcaagttccttgtgcacagttggaccatgttcattgtgtgcagtagaacctcgttccagtgttgagtccattttatgttttgaccatcaaagggaagggcattatgacttttggggactgagtcgatggaggaaagatagcagtcgatgatgaccttatgcactgacgtgtatgtggccaatgtctatagatggatttggaacttgaaggagctgttcgttctgcagatggaatttccagtgccgcatctccaccacccagccactagcactcggcaggtgctctgtaagaggaagcccttcactgccaatcagccattacacaggtgaaggtgagtgagacttaatagctattaaccctcaaaacaaactgaggaataaactcaggttcacaaagtgactttgcgggaacagcctgaggaagcaagttaattagtagcagaaggttttgcccagagcaggaggaatcacaggatcactgaggacctagtgataccatggtgtggaggtgctgtgaggcatggtgacattcaagaaaacctgttctctacaaacacctacctacccacaggcacagcagacaccccagctatgccaagggctctgtcttcctctagagtaagagcctggtagcaaacaggtatcctctgaaaggcaggtgccccatcagtcagctctgcacgactgaaacaaaaggaaaattgccagagaactttccagaaaacagtcaacctgcttgtgctggtgcattgatggtgacccaggatcagtggaagtaacagtagcttaatttccccatggctgcatgatggacaccgggagagaagtgtggaggcggattaaccaccactctaagtggcttcagccctaggtaagcaggaacaagtgagggggctgagcccacttgtgtctaatcagtcccagcctcagcgactgcatcctggagaccaacagggagtgtatgcgctcagcccctcccagattgctgagcataagcaagaaatttccctccgcacacctgacgcaccacacacctgcccccagctcctcacttacaagacaatatcaaatcagacagggactggtctgggtcccagatcccctcaggttgccgctgtcctctcagatccccacacacagcagactcttcccctcacactcctgttccaggttactcttctccaatatgatgggggtttgctttcattgtttctgtattttttgtatttttatgggtaagctgagccccttttacctggtcttgagtcaggcaggggccacacagagaagaggaattcctccccaggggccagcagtccacggatcaaggcatcagggacctgagcagtaggttctgttcctatgcctggacccaggaggcccatgagcctccagcagtcagtatggagcagccaccaggggggcagcaaagagtcacctgggaaagccacctcgggatggggtggacctgggcatcagggagatgctgacatgcagggagggtcagtgaccacgacctgacacctggagggaaaataggtccttctttttctagagtgttgtccttgacactgatgtaaaaattctagcatcaaattttatcttcagcttttgtagatgctcctatttccctgacaaaggtccaggcacttgacttccccacacatcctctcctcacacacccagttgtgctaaaatgctgtccctgtcatgcacagtgtccttcctgaggtgacacgtgtccccctccctgccctttgctctgggagcccctgtcctgtagacacagcagcttcttcttccctggctgctccccatctccactgtccctgggctttcccatctgtctcctgggaaagctgccaaatcacaggtctcaatttccttgtgaggcacaaaatagttgctcattaaccttctgttgacttaattaagtttttaattccttgatttgttttccccagcaactgaagacaacttagtcataataaacattcacttccaggggtcttgcagtttgctgacccctctcattctctcatggagcaaacattttcttgacctccttatctgtcattggtcctcacagcaccctggggacactgaggcacagcatgtacgacctgccctggagctcacagccaacgaggaaacttaccgcatcccatggatcttccaacactccatgtgcacttggcaaccaagaaattttattcttctctagcactgaggagctgtgccctggggtggggtctgtacctatccaaggcacatgctgtcacctgtagagtgtggatagagggtccttgcattaggttctggaaagtgtcttcaaaaacggatttaggcctacacccaaaatctcctctctggcacaaattattcatgatcaggatacatctagaggcctagaccaaaattcaccacctccctcctgagccagaatggaatggaggaggggactggggaccccagataatttccccatcaccactgtgactctatggccacctcctgcaacagttagggataatcacataggaagggcttcatgtatcctaggaaaaacacccaaagtcatttatgagctctaccatgaccaagtgagcccaggagtcgggttgagcacagcgtggtgtggagatatctgcagagaccgtggaaccagtttgtaaaggagatcctgtaggctgagggtgagagtgcaaggccactcctccccctctctgcatcctttggggctaagcccttctctggaaaccacaaagctcctccagtagcagcccttgactctgctgatttgcatcacaggctgctctcttcagcaaggggataagagagggctggaaggaacctgcccagcctgggcctcaggaagcagcatcgggggtgccgcagccatggcctggaccgctctccttctgagcctccttgctcactttacaggtgctgcccccagtgtcccagccacctacccagctccaaggctctgggtccagcctggcctgacagtgatctcagcagggccctgcctgtggtgtgcaggatgctcatgatcctgctgcagggggaggggctgctggaggtgaaatccccccacactgttcttctgtgctcatggtcccctgaggacacttctattcctgaaactcaggccaggcaggtgggaaggcattgttgggttgagcctctcagtttcaagtctattctattctctccccttttcttgcaggttctgtggcctcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaactcggggaacacggccaccctgaccatcagcagagcccaagccggggatgaggctgactattactgtcaggtgtgggacagcagcactgcacacagtaacacaggcagatgaagaagtgagacacaaaccctttcgccatctatgtcaccctctttctctaattcaaggaggactatgaacaaagccttacgcagatctggttaaattctctttaatctctgcccccagcctgtccctccctccagtccttcaggcggggtctgcagaaagtgcatcagtagttcatttagggtgatgtgatcaggatggactggtgttttggtgactcagctgtgacttgggaaaatagggcctgcatggaagatcagactgaggtagacatccacagttgtctctggatttccataggtggtgacaggccagtccttgccccaaatgtcctagatcagtccccagaactgcccagctcaggctcctgtggtagcctgtcattctttagagaaacaccaatggagtagacactgtgggatctgcccagatcccctgttctgagcttacccactaagcactactgggagcttctggcaggtcagagctgtgtcctcactggaaagtgctgttcggtgcagaaaacagactcctccaggtctatgccctttctcagtgaggttagatttcatgactgcctgaggccgagttctcgactctgcctcaatataggaagacctgaaaatcctcccagctccacagctctctgtaggaaagacttgagacctcaatgagggtcagggtctcctgcccagggttgcctccctcacctcctttcacatcctctgtgcatgcaattcctcatctcagagtctgcttccagggaacccaattaagatcaccagccatccccaacatgggccatgtgggacttcaggaggccactgtatgctggaaagcacctgtttattcctaaattagcactgtgagtatccacacgcccaatgagatctgagtgtttcttgcatttgcatggaatgagaagggagcctgactcgccaggtgctctggggtctaagggagagttggagtcagatctccctgcagggaaacctggggcaggaggagcagccttaccccatgcagggaccacagatgcacccacagggtgagcttaagtatggacactgcctacctccaccctccacatcctgtgtaaaaaatcattctttccacccctcctccagcctatcaaagttgacacttaaaaagccaccacaacccacccttgtcaacaggaaacccattcacatctccatcagccacacaatctccacataaagattcttcaaaaaataataacaatagccatgcaaagtatatgatatatatcataaataattgtacttagattatatatgaaaatgatactctttttgatatgctaggtaaataaaatacattatttaaactcattgacttcttctctttgtatttataacatgatgactagacagtgggattcccatgaggctcacatcacattgtgattgaacaaggctggtctgcagggcttcaggttacaggggctgtggagtgacctggtgcaggaagccccgtctccatccataggacatcagtgtgaacccagggagaggcgctggtataagagagatgagaacacaggtgtgaaccacctgcttgtgcaggggactgagccttcactttgagccaaataagttttctttcccaagttcgatcctgaacaagagggctttctggacttctttttgttttcaggtttgtgccccttcaggtttggggctgtctggagtcccagccaggggacagtgaggaaatccagcagtctcacactgactctgttgtatttcatctgctggggccatcccaaactgctgcgtaccatttcctttcctggtgctcaaatagctgctccatgcacttgtcatggttttatagctcaatctagatgggaagacaggatagtgtatgttacaatatttaaatagaacctgaatcccttaatagttattttaatatggaacattaaaagagttgcatcataggcaatggggaaagatgaagaaagattaaacgcatttggaggaaaaactaaaaatgtctttattgaatgtctgtgtgtcttcagtgacgaagggttgagagaggtcagctttaggttgtcctgaggatgtgctcagatgggggaaagtaagaaagcaggaaacgtgcatctctgtgacctgacacataaatcacagtaaaatggaagtaaatctttcaataaacctttcaagataacatcactctggtgcacatagaaaggcctgttagcaaactttcccttttccctgctggctcatatccccatggatcacctgtatgcagaacggactctgtggtctccatttatcaggctgagaaccagaggctgggaaggacaagtcacctgctcatgagtgggaggggcaggattgggagcagcggactcaggctcaggactgtggccctggttggtgctccttgttcccttcacagggtcccacccacatgtgcccgtgtggatgtgggtgcactgcctggggtggctgatgtgctccagggatttgatggtgcagatgcttcaggacaaagcatgggagtggggatgggacgagctgccgctgggcagaccaaggaccaacgccacccagcagaggcttccagtggggttgggcagccccatttcctgagaatagagagaacctggcaatgagtgccagaaagaagttacttcgaggtgtgcccaggcctggagggtcacagagacacaggcaccacacagcagagacactgaaggccaagagctcactcaggtgaagggcttcaacagatttttctctcctgagcaaatcacgtgcaaagaaatcaacttcctgtcatcagaatagacaatcaggactttagtctccttggctgagccccgctgtcaagggaagcagaagtctctaagcccaggcccaagtgagggtggggtgagaagaggagctcaggatgcagatttgcatggaggtcccgcccttctctgaggcagagggataagacagggctgggggcaggcccagtgctggggtctcaggaggcagcgctctcaggacgtcaccaccatggcctgggctctgctcctcctcaccctcctcactcagggcacaggtgatgcctccagggaaggggccacagggacctctgggctgatccttggtctcctgctcctcaggctcacctgggcccagcactgactcactagactgtgtttctccctttccagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttccacagtgttttaagtcaatgaggaagtaagatcaaaacctgccctgggctctcaggccccttcttgctctgcagatgcttcctcacgctgtataagggtttcctgcaggatggccttgacaattctcctctctcagctcctctcctttcccaccatgaggtctaaaaggaaacctgctcgtgatttctcgttcaggactgtggcaacttccttttgcttgtgtgctctggtcccttaacgtgcaactattcctagctcttcaatgcagggacgtagggacaaggagtttactgcttggtgcagtccctcctgttttcaggaacatcctcattctaaatgcatcccccatctgccacactatgcagatcaatctggacagaagccatcagggggatggcttccagtttccaggaattgcatcttgttccactctgtgtccaccacgctctaatgaagatggccctcctagctggtctattcctctgcacctgggtcctgaagcagtgaccactttaagaagacttgaagatgtttttgagggattaagaacaaagaggatgctgctgtttttctttttattgctcctgctctttgccgaaattcctcaggttgctgagctggggagattttgagtgacaggctcagtgctctcgcagaattctcctcccctcacatcgctgaggccctgtcctggaaactcctcacaagtggacggtcttcccataggatgggggattccaaaatggctccacaggaaagagttaacctgagtccacctcccttcctcatggacatcgagcatttctaattttcatggctgtcaatacttttgtacctggaatccctaataatctaatggtgagaattgatttagaacacattcggacattagctgggtccaatatttaaattttctgagccagttgttaaatacagctattatcatatatagtttaggctccttaaacttcgattatacagattatatttaaaacaaagtaactagtttactatatatatttacaaagtaactactatataacatcatgttgtgtacctgaaatataaacactaaaatttatttcaaaaaccaaagtgtattgtctattgatgcataaaaaaacactcacaaaacttagcacactaagagaacacatgtctgtgaccttgtgacttggatgcacctagaattgggagtagcttagtttggtcattctcgctcctggttaatcacgaggttgcagccaagctgtcaggccaggctgcattcaggctacatctgccaaagaggttaggaactgtggaagcctccctctggctgtggaagcctccctctggctgtggaagcctccctctggctgggagacttccgcagttcctaacctctttggcagacgtagatcatctcaaggataaaggagagagtggagtgaaggcccctgtccttgtcctccatgtaaaaggccatcccatgcatgcactattttttattctttgctgagacatcctaggcatagagcactgccccattcattcaaaggttgtagagtattctatggtagaattttagccaactcacttttaatggttattatcactattttgatcttataaataacactgcagcgaacatccttatgtagactcctttgattttatatgtagacatgaccatagaataaatttctagaagtcaaattgctgagtcaaaaggatgtgtgcttgtaattttcactcactgtcctcagattctcctctagaggggttatctacaaattcgcaatgtcagccataaatattcgaacagagtacactggggaaagtttaaatgtttttcaacctagcagatttaaaaatgttatctttttttagttttgatttctcctgttctgcttgaagttgagcattttctctaatacttcagtgctatttatttttataatttggtaaacattttcttaaatgtccagataagaaggattttggtctgtggttcccaagagtcaactttgaggatattctgtaggtatttttagcaccatttatagtgtaaccatttaaacctataaaaaccactctcagctctggggccatggaaaaacaggtggcaggacagggatggcccacaggatgtggtttaacggtccctgatttgtagggtaatttgaagtttgagaattccaccgcatatgttctaggtggagatctctatttgaaggatactgtattttacctcctatagtggcctgaggcttttggataagaacatacttgtatcatctatttaattggatcttgggtcttcccaggacagccctgtgtcacagtctcatgtttttcatctcatccatttgctctgagttttcagaaagctttagtatatcagaaatagactgaccctaggtggaaaatcagaggtaccgggagcagcaaatggtcagggaagcttgcaccaactctggaataaaccagtacaggctcagagaaaaacatcataaaatcagcattgtagctgaaaccaaaaacatgcatgatctttgaagttctggggattataaataaataaatgaagtttaaggtttaaatgtgttgcaaatttacataaagcatgtagattttaaaactcagaatgcagcaatgaaatatggaagcttgagattttaagctgttaaggccctacaacaaattgccaggaacagaacaggaacttgatagtcataatgtcttatgctggaaattatcattttctctaaatgaaatttttttcccttttttcttagacataaggaaacatctcattgaacacccttcttttccactgtcaaacacccttacccagaaaggaactgtaacattaagtaggaaacaactgctttttttcataactattgagagatttctttatttgcacatcaaaatgttgattgtcaatgctaaaattggaattagtagtttaatatgcacacaagagattaattttgtttggattatcccatttctgtctattatttgtcttagttaactcagacatattctgcttttggtattttttgttttattttctttgccaactacatgtaaaccaaaaataaaattctaatgctcccccaacaaccccaccatctgagtggactctcttctcttggtgggggcactccaaagttaatctgaaagactggttcaggccatggcagaaaaggggtgtcagacatgtctcattaagcccttttcctttttggaattcaggaaaagccaacctgcacttaacatcaatacaaatcttaagtctgataagaaacatttacaatctattctctctgaagcctgctacctggaggcttcctctgcatgataaaactttggtctccacaacttattataacccagacattcttttctattaatactttcaaccaactgctatcagaaaaatttaaaatctatctataatccagaaggccccacaaccctgcctcccatcaccctcttgttttgacttatcctgcctttctggactgaaccaatgtatatcttgaatgtatataattgatatatcttgtctccctaaaatatataaaaccaagctgtgccccaacctccttgagcacaagctctcagggtctcctgagggttgtgttcaccagtcatggtcactgatacttggctcaggataaatatcttaaaatattttacacagtttgactctttgtcaacatatggctcttttcaaaacaccatttgacacccagacataacccgctgctaatgattacaaaattcaattttattagcatttaaattattactttaaattatttcaagaatgcatggatgtgatttcccccacatctaactcacaaatgttgctgatgctgacttgctcttttctttcagtcttagcaaataaagagggagtttacttttcttgataccagaagataacaggagaaagtaggtgaaactcccgaaagctgttatcgtttccaccctcaggatgaatcacacaaggagtcacctgcacttcatttggatgataaataaatgagatggatcttagagttggtgctgatctagtcaatgatttgggatgttgggctgaggtgaatgtgtttcacaggtgagaaagacatgagttttagagtccacagtgtggagggttattggctgaagtgtgcccgagaattcatacaatgaagctctaatcacagtgcatgaatgaattggaacataggtctttaatggggtgattaagtgaaaatgaagccagtaggatgggttcttttccatctgacaggtgtcctctgaagatgaagaaatttgagcacacagaaatgagacaccatagatgagcatgcagaggaaagatcacgtgaggacacagaagaagggagtgatttgcaagccaaggagatgttacagtagataactaggcagacgtgacagggcaggagaccccctgccccaggaatgtcacgcaagcatcagatgatggtcaggtagttgttaaactgtctctgtgaattaataattagtcacagccggcaccaaggaaaggcggtctcccaatagatagaaaatacctgaagctggtgatcagcagctttctgataagatctcaggccttgggtgagtgggctcaagcaggcaaactaaaaggcaaaacagaggccaggcatggtggctcacccctgtaatcccagcactttgggaggccgaggtgggccaatcacttgaggtcaggagctctagaccagcctgaccaacatggtgaaaccctgtctctactaaaaatgcaaaaattagccaggtgtggtggtgcatgcctataatcccagctactcagaaggctgagccaggagaatcacttgaacctgggagatggaggctgcagtgagccgagattgcatcactgcaccccagcccaggtgacagagcaagggtccttcaaaaaaaaaaatgcaaaatagcagagtttaacctggatctgagactcccatgctgcccttccctccagccctacaggcaggctctgcagagagtgaatcaccagtaaatacacaaacaaatatgattacgttccttttgtttaagaagtagaggaatgattgaatatattaagtgaaaataaggaataccaacacaaagaaaaatttaactgtaagtatggttaaaaatacactgggtgagatagacaagttagatgtcgcaaaacaagagattagcaaactgtatagtgtaacactagaaactattcaaaatgaaacacatagcaaaaaataacgataaaaataaacagcatcaatgagatgtaggagaacttcagacaggctaatatacgtgtaattgaagtcctcagaatagaagatggggtaagaatgaaaagaaaaaatatttgaatgaataatgacaaaatatgttccacatttggtgaaaaccataaactgatataacccagaagctcgataaaacttaagcataggaaacacaaagacaacaactccaaaacacatcataatcaaattaataaaatctagtgatgaaaagtagtcatttaggacaaaactacaaagagcagatttctcattaggagcaatgcaagcaagaagatagtgaagcaatgtcttgaaaataataacatgcaaaatccaacaaccttgaattctttatccaccagaaacatctttcaaaactggaggcaaaataagactttttcagacatgtgaaatcctacagaattgatcaccattagactctcgctattagaaatgataaaggacacccctaaacagaaagaaaataatcctacattgaaatgtggtttgacacaaagaaatgaaaaatcagatatggtagctacctggatcaattagaaacctctgtattatgtaatgtctataaaaagaacagtaatgtctataaagagaactgttcagagaaaaattaataagaatacactatgatttgtaataaaaataaaagcaaactatatgacaaagcagaaaagcgaaggtgggtgaagaacatgtaataatggttttgtactatatgtgaatatataatagcacctgaaggtagattttggtaagttatgtatttactgtataccctaaaacaaccattaaaataaaaccctcaacaaaaaagaaatatggctagtacgctatattagacttgtccaccaaaaattaataggatatgtatggatatgaatatatatgtataatgtatctatatggtgagagagacagacagaaacttattttaagaagctggttcatacaatagtggtggctgatggacaaaatctgttgggcaggctataggctggaaatttaggtaagagttgatattgccgtcctgagttcaaattctgcaagaagctaatgtttccccaagacagcatcagctgttattatgcacactggctccaaatcgaggaaagtgtcccccctgaccattagcagagctcatgccaagaacaaggctgatcattaacatcaatcactgggaaacttcagtatttattctaaaaaccttgaactcattaatgagactcacacacattgtggaaagtagtattgatacaggagacagaaattatttaggcagatagtgagggtgacagggtcctcagcagagcttctcatctaacaaaaagcagccctaaaaatcatttcttttataacaaagagcagcctgaaaaaatcgtgctgcaaacatagataagcaagctggaagcttgcatggggcaatgccagcagctatgccaatagaaaagtactacctgggggtcagccatgtccaacatggaggctccatcttccctttttttgtcaccatgtgtatagcaatagagaaatgggcaacatggagcagctcaggcagataacccacctgcgtaataacagattagggcagggttggccagaaatgtgcaccctatgcaaatggtacacctagtcctaatcagtttttcatgccctgtgcaagtagcacacctggtctaaccagtctttgacacccaccttatgtagatcagatactgcctcctcaccagctcatctataaaattccctacatttcactgcagatccggcaacccatttttctgggtcccctctctgcagcagagagctattatctttctttcacctattaaacttctgctgtcaacctcatttgttgtcagatcatgtcctagttttccatggccctgagacaatgaactttgagtattcaccccagacaatgaggctatttcaatatgcttatacaaagtctactggtttgaatatttatcacatttgaaaaatatcttcatgacaatgtctacactggtgcttaacaaaatcaacctggtaccatgtcttagccaatctgacacttaaaattcaccaccacttaagccaggagctaaagaaaaccaatttttaaaaataaatttcaaaagagagaaaaaggaaagaggaacaatgaacatataagacaaatagaaaaaaagagcaagatggtatattttaacaaagtatattcctaatcacattaactataaatggtctaaataccacaattaaaaggcaggtattatcatctatattctaaaggagttcaggtagggttggtatgctttcttccataaaaatgtgataccagtgaagctatttgggtataggtgggcttttcttagcacggagattttaaattgctactttaatatctttaagtgtcatagacttattcagattttctatgtattcatgagtcaattttcataatttatgtctttccagaaattttacttcatttatctataattttggcatttactgttcataatattccctataaccattctcacccttttagtgtctatagtgatgtcattattttagccatggttttggcaacttgtgtttctttttcttttttttatcatggtcactttacctaaagataaaaatctattgattttattaatctttttgaagagccaagtgttttttttttttttttttgaggttttctattgttttcctattttctatttcatgaatgtttggctgtgatccctattattaccctctattcacttagaatttgaatgttcaccttttttaggtttatgaggtagaagcttagattattttctttaattctttcttctttccaatactaagcatttaatgccatagtttttcttcaaagcagacttagctgcattccttaaattttaatatgttgtgtttttatgtttaaaaaggttcagtatcttctaatttatgttgtgatttttctttgattcatggattacttaacagtctgttctttcactttcaaataattgaagatttcctatggttcttccggtattaattcaagttaattagttaattctgcattaaattatatcttctatgattttcatcctttcaaatttatcaatatttgatttatagcctaaactatgaactatcatgaaaaatgttccatatgtatttgaaaagataacatgtattctgctgttgtgggtgcagttttctacaaatttattataattaagataacttggcaaatggttcaaatctatattcttactagatttctgtgtagttattttgtagatctctgagacagagctattgaaatgaacaacacaaactgtagaatttcccaatgattattttgagagagatcatttttaaaatcatggatctaaataatttattctcctcacaaaatgtcttctatgatttccaaatactaatcaagggaagaaggcagagttaaactcacacttgtagataccacgggaacagtgagtgatcatgtgatgtgcctccagaggttaggctaatgtagttagagtggtttatatttatttatttatttatttatttatttatttatttatttagacagagtctcgctctgtcacccaggctggagtgcagtggcgctatctcggctcactgcaagctccgcctcccaggttcatgccattctcctgcctcagcctcctgagtagctgggactacaggcacccgccaccacgcccagctaattttttgtattttttagtagagacggggtttcactgttagccaggatggtctcgatctcctgatctcgtgatccgcccacctgggcctcccaaagtgctgggattacaggcgtgagccaccgcacccggctggttttttttttttttttaaacacacagttgggctaaaatatccatgaaaaaatttgaagcatgtaccttgaataaaatatgaaaatcaaaaaagttaattgcacacgtacaacattgttaccacggtgcctgccgcatgggaaatgaacaacaagtgttattaattcaattctattttcttacacattcaatgaatatgtattgaaacaaattcactgaatggtcccagatactgaataggtccttgagatgtactggcaaacaagacaaaaaaaaaaatacatgttctccgggtggcctcatggaagatggtggagtaagaagctccaagaaatggtccctcctgtgatataactattgaagtggcaagaaccatcagcattcactctaataaaactatggtatctcatcccatatttgcagcatccagggaagagctgaagaagaaagagacaggcttaaggaagtctctgtcaggtagatctctgaccacagagataactgaacagaaatttcgtggatcactctgacaagaaaggtagtccttgcgaaaatattcaggaaaagtcacaacacaaataaacaactgcacccctcagatgaacaactgcacaatatcagccaaggggcataatctgataatctgatcctgggagttaacaacatcacaatattcaaaatactcagatctcaacaaaaatttgcacagcatacaaagtcacaagagagcacgactcattcccaggaaaataatcgactgaaaatcttccttaagaagcattcatttgctcccatcttctcccttggttatataacacgtccttccacatatacttgattagagcttgtgccccacaaacatgcctggcatgtacattagtgacttctgagagggaggtgggggcaggaaacagtccctctggatacatttcgcatcacatgaaccagtgaacacatctctgcaaggtcctgcattctaataaacaagatttttctgtttaaaagaaaacttaagtctttcagaaaactgcatttcaaaagggaaccttgtctctgctgcttgggctgcagtgaggacagatttactaagtgctggttgctgtgttttgtcttctagtgtgggtacacacatctagaaaagttttaaagaagattggggaacccccacccagcactggtgggactttgagtttgctacggttgtgaacagaacatggaacagaggacaaggtggcccctcctgaagatgagagttttgcttcttgctggaagtccctggactcctggagtgttctcaggggacctcttaacaggatctcaagggaaagaatccagggtactggatccacacaatcaacctcacggatttctgagtaggtcattaacctatcatgcctttagcgttatctcaaattatacatggtatcatctcaactaatgtctaaaacaatatacggcatagatatctaaagaactagtggtacatggaggatggctttctacctctgagccctagaagggactgtgggccttggtttggggactctaatgactctaagtcccctggtagtgctcaagtgcaaagggaatgactgacgctttttttgaggccccttctattgtgtaaaatttattctgtacttgtgacacccacctggtccttcttctgaacatgggaaattgccaagatgaagtctccaggctaacggctcagacaggagctcagataaacatgctgggaagtggagagcaaattgacattcaaagctcctcccaacaagcttcaagaagagggtaacacaagaagtccttgtaaccaggttccacggggcagcctcaagcagagctcttggaagtccctcccaccacggtctgggtctccttctacctcctgcccttcattttctccacaggtcagaacatccagggaattcagggaaaccctttcactgctatttctccacaagctccaatcctcaggggcattctttccagttctcccgagcattcggcatcattcatgaaattctatgtttccaggtctctgtgctctggctgtgctaactcagcccccgtctgcatctgcctcactgggagcctcagtcaagctcacctgcaccctgagcagtgagcacagtacctacatcatcaaatggtatcaacagagaccagagaggtccccctagtatataatgaagtttcacagcgatggcagacacagaaaggaggacaggatccccaattgcttctcgggctccagctctggggctgactgctccctcaccatgtccaacctccagtctgaggacgaggctgagtatcactatggagagagccacaagattgatggccaggatgggtgagccacacacagtgacacaaagggaaagtgaggccaaaaccccccacctcccctttctcctcagggactcagagtcagcagtcacatgtccccttccaagtccctgagacttctgactctcctcctgcagagacacccctaggcagaggcagatgcaggccatgatttaggccattttgacaactcatcattctgtctcctcaacaccagtctgtggggaccatactaggagagaccagagcagcccaggcagaaggaccctgagagagtggccaggctgagatgaccgtgtcccagtgtctcactgtgccctgtgctcccttaccgggctctgccccaggaaaggacatggatcttgacctgtcaccccccatttatgagagttcaatgtgtgtgcatcctcgttagcacttgatattgtcagtttttccttaaagtctttcagatagagctgtagcgatatctaattatgtttttaacttttatttctttaatgacttattatgctaagtatcttttcaggtacttatctgtcctttgtatgtcttctttggtgaaatatttaatcaaatctttgcatttttaaaattcaggtttctcaggttcacatttcctcatgtatttgtatgagtttatatgcatgcatgtgtgtctatgcattccattctgtgtgatttcccaacatgtatcagcacaggtatccaccactacaatcaagacacaaaccaggtccatcacaacatttcctggtgtttccctttgataatatctacctcctcccacccagttccctcccttgcccaaccctggcaaccactgatttggttccctattcctaaaattttgtcttgcaaaaacgtgatacaaatacaaccctattgtagtagacagactttggggttggaattttttacttagcatcattccctataaagtcattggaaaggtgtgtgtatcaatagtcagttcctttcaattgctgagcagtatctcttggtattagtttaacaaaacctgatgaattactcacccaccgaagggtatctggattgttttcagtttggagctactacacctgagggtgctacgaacatcagtttgtatgtttcttgtgaacataagtattcagttctttgaaatgaaggtccaatattataattgctgtgtcatacactaattaggtctttagttttctgagaagctgacaaactgttccctgaagtgaatgtaacatttttttctggccagtaatgaaggaatgatcaaatttctctgcttctttgggaattgtgtgtttttactctttttttaggtaactattgtgataggtgtgtagtgatattccattttttaaaatttcatgtctctgatcgttaatgatgatcaccttgtcctgtgcttatttgccatctgtatgtcctctttgatcacgtttgtgccctttgcacattttctaattagattgtcttttgttttgctcttaactggtattcagtgttgggtgttttgtttttttgagacaggattttactttgtcattcagcctggagtggagtgatgcaatcacagctcactgtagcttggactttcctgactcaagcaatcctcttgcctcagcctcccaagtagctgggacaacacgcacacacactgcctcactaatcgtttacagaattttctttgtagagacaagatctccctatttgcccaggctggccacgaactccttaggctcacgcaatcctccctgctcaacctcccaaggtgttagaattacaagcatgagccaatgcactcggccagttttcactgttctttatgtattttttatactagtcatttactggatatgtgattggcaaatacttaatgccagtctgtagcttctgttcacatcctctcaagagagatttttgcaaagcaaaaattgatggttttgttaaggttcaatttatcagtctttcatttcatgacttgtgtacttggtgaagtctaagaattctttgcatagacatagatcttgaagattttctccttttttttttctttttttttgacagagtctcgctgtcgcccaggctggagtgcagtggcgtgatctctgctcactgcaagctccacctcccgagttcacaccattctcctgcctcagcctcctgggtagctgggaccacaggcacccgctaccacactcggctaatttttttgtatttttagtagagacagggtttcacagtattagccaggatggtctcgatctcctgacctcatgatctgcccccttcgacctctcaaagtgttggtattacaggcgtgagccaccgcacctagccgattttctcccatttttaatataaaaataatagtatcgctgggcacggtggctcacgcctgtaatcccaacacgttgggaggccaaggtgggcagatcacaaggtcaggagattgagaccatcctgacacggtgaaaccccgtctctactaaaaatacaaaaaattagccgggcatgatggcaggtgcctttagtcccagctacttgggaggctgaggcaggagaatggcgtgaacccgggaggcagcgattgcagtgagccgagatcgcgtcactgcactccagcctgggtgacagagcgagactccgtctcaaaaaaaaaaaaaaaaaaaacagataaataaaaaataaatctgagagatggctgagcaatttcactgagtttcatcatggaattctggcctcccaaacaccagcatggcccctgttcctacaatctcctgcttcaagatcaacccaaccctgctacccagaccagatgctagatggtcaagacagggctgtgagagctaaagaatcttcagggtccacgatgaatttacattggagcttccttttccacggatattcacatcaatagagaagatgactgagttcttgcctacctctgtgaatacctgagacatgaactgagatgtgtgtgtgcatatggtgcgggcagcacttcctcactcaatactagggagagtgtgaggaaactggatacagacctggagatagggcacatttttacactctctattaagccctgtccttctgtgctcaccaaggagtcacccaacaaggccacaacaggaagagaagcaggtttctatgaagagacttctctttttgtgatgagggcccaggaagtccactgtctagctatgaactcagaggcagaactctgatgcatctccaccatgacctgaatccctctcctctactcacccttcctgctgtcggcacaggttctgccttccagggctcagccccataagactagggatcagcctggccctgaccttcagctcagcacagggagtgacgcagtgtgtggggctctgagaatgagaccctcatcttcagactcacctctcctgtcctatcttgtaggctcagtggcctcctctgagcggactcagttgcctgcagcgtctgtggctttgggacagagggccaggatcacctaccagggagacagcatagaatacttttatgcaaacttttgtaccagcagaagctaggacaggtccctgtgctggtaatctatggtgacagcaactggcactcagtgattcctgaacaactctctgactccatatcagagaacatggccaccctgataatcaatgggccccaggctggaaacaaggctattactgtcaatcatgagacagcactgatactcatctcacagtgacacaggcagacaggaaagtgagacacaaaccccttcccacctatgtcaccctccccctccaacctcaggaggacagtggtcagagctataagcaggtctggcccagttcactcagatttgagacccccaggctgcccttccctccagccttccaggcaggctcagcagagtgtaaattaagagtggatacacaatgaattattagaattgtatttcagtttttcaagaagtagaggaatgattgaacatgttaagtggaagtatagaataccaaaaaaggactaattgagcttgtactgctaataattacagcatctgagacattaaaaacacactggatgtgattaacaacagatgatgcaacacaaaagattagcaaactcaataatgtagcactagaaaatattcaaaatgcagcacataaagaaaaaataatgatgaaaatgaagagagtgttacagtatatttatagaaaaaatgaagagtgagttataggacaacttcaaacagcctgaggttggctgggaggggtggctcacacctgtaatcccagcactttgggaggtctcggagggagaatccttttgagactagaagctcaacaccagactagacaacataacgagacttcatctctacaaattttttttaagaaaattaactaggcatcatagcctgcagctgtagtcctacctacttaggagcctgagacaggaagattgcttgagcccagaaattcaagatggcagtgagtgaggtacgatcatgccactgcactctaacctaggacacagagcaagttcctgggtctcactctgtggttcaggctggagtgccatggtgcaattacagctcactgcagccttgacttcccaggcccaagagatcctcccagctaagcctcccaaagtttctgggactacaggcatgcatcacatgcctggttaattctttgtattttttgtagagatggggttctccctatgttgcccaggctggtcacaaactcctgggctcgagcaatcctcccgactcagccccgcaaagtgttgggattacaagcataagccacgccacctgatgtgaagaaatatttaaatacaacaacctaaagtatgtataattgacatccatggaatagaaaagatgaggtggagggtcagtagaaaatatatttgaataaataatggccaaatatgttccacatttggtgaaaaccaaaaattggtatatccaagaaggtcaacaaaactcaagcacaggaaacatgaagaaaacaactccaaaacacatcataatcaaattataaaatctagtaatgaatacccactttaaagtttaattccaagagcacatctctcattagaagtaatgcaaggcacagtggaacaatatttcgaaaatgctgaaaggaaaaacttgtgaaccttctgttatttatctaacagaaataacattcaagagcggagggtaaataaaatgttttcagacacataaaaacttacagaattgatcactatcacttttggcattagaaatggtaacagacatccatagacagaaggaaaatcatacccagttgaaaagcaaattcacacgaagaaatgaaaacttcagatagggcaatgacatggatacctatagaaacccctgtattatgttaacatctatgaaagataactgttcaaaggaaaattagtaaaaaaatcactgtgatttattgtgaaaacaaaattaaattatatgacaaacagcacaaaagcagagaggagtgaagaacatgttataatggtcttataccctgtatgaatatctaatcacacttgaagacagattttggtaagttatatatgtaccattaaccctgaagtaattattaaaataaacccttttaacaaaaaagaattatgactagtagtaacctgtattaggattctccacagaaacaatatcaatcagatatgcgtgtgtgtgtgtgtgtgtgtgtgtgtgtattgagagaaaaaagagtgaaagaaatgtattttgaggaagtggatcatatgattgtagtggctgacaaggattaaatctgttgggcatgctgaagtctggaaattcaaataagagttaatgttgcggtcatgcatgcaaatttagcaagccagcacatcaggaaatctccatatttgttctaaataccttcaactcactaatgagtcccacctacattgtgcagagcaatctgcttatacaaggtcaactaattaaaatgttcatcacatctgaaaagtatcttcatgttaactcctatactggtgtttgacaaaatcaacctggcccatatcctagcctatctgacacttaaaattaaccatcatttaagccagaaagaaaattttaaaaatatttctaaaaataaatcagaaaaggaaacaatagaaggggaaaaataacgaacatatgggatgaataaaaaatgaggagcaagaaggtatatttcagtaggattatattactaatctcattaattgtaaatggtctaaatatcacaactaaaatattgtcaaattgaaattaacagcaagactcaactatatatgctacctagaataaacctacttgaaattttagaaccacaaaaagccaaatacaaatcaacgacaatcttcccaacccctggtttcccaacaaagcattacaaaccgaattcacagggattaacacatagttaaaaaatatgtctcacttccaccaacactcttacctctcttcagcctctaatgcctagatcccagtaccagagttgcaagaaaacagggcacacaaatgttaaatcaaggttactaagggtcaccctcaagaggtaggtgaaaagagaatgagggaattgaagccacaagggtcccacttgcatggggcagctcctgcatcacaatgttgattgatacattattgatgagtttttgtccatgttcatggtggacataggtctataactttcttttcttgtcatgactttggctttggtattggagtaatgcaggcctcaaagagtaagtagaaaaatgtttcccctgctgtataatctgaagaagttcttgtaggattggtatcatttcttaattaaaaatttgatagaaatttactatttaaaactgggtgagcttttcttagcaggaagacttttaattgccaattcaataccttcaaataccatagatctatttggattttccatttcttcctgagtcagttttgatcatttatgtcttttaaggaatttttccacttaagtcatttatacttttggcattaattgcttgtaataatttccctaaccattttaacttttgtaaggttggtagtcatggcactcttttatcatggttttagtactttgtgtcctctttcatgttttcctagtcagtctacctaaaagtaaaatcaataggttgtatttatctttttgaagagccaagttttgttttttagaggctgtctattgtttttttttgctatttcattaatatttggctctgatctttcttattaacttttcttttttttgctttgaatttaaatgctcacctttagcctaaatttatgaggtacaagcttagataattcattttagatctttcttctttccaacattaagcattaaatgcaatagatttccttcaaagcactgatttaagctgtatttcttaagttttgatatgttgtctttttgtgttttaaaggttcagtatcttctaatttatgttgtgttttttctttagctcatggattacttagttgtgttctttcctgctcaaataattgaagatttcccatagttcatcaggtattaatccaatttaattaattattttggcattaaataataccttctatgatattcatccactgaaatccactaagatttgacttgtaacctagaacacagattatttcaaaatcatttaaaaatgtgctaaatgtatttaaaagcataatgggtattctgctctcatgtttgaaagtgtaatgggtattctgccattgtgggtgtagttttctacaaattcaattaggataaattggctatttgggaggctgaggcgagcaggtcatctgaggtcaggagttcaagaccagcctggccaacatggtgaaaccccgtctctactaaaaaataatacaaaacttagccaggcgcggtggcaggcaccttaatcccagctacttgggaggcagaggcaggagaatcgtttgaacccaggaggcagaggttgcagtgagcctagataaagccattgcactcaaacctgggggataagagagggacttctctcaaaaaaaaaaaaaaaaaaaaaaaaaaagataaattggctgatcattcaagtctgtatcttgattgaatttctgtatagttgttgtgtggatcaatgtcagggagctactggaatgatttaacactaattttagaatttctgattgattttttgagagaggaaattttcatgggtctaagtactttattcttctgacaaaaggccttttatgatttcccaagactaatctaggaagaaaaggcagagttcaagccacagttggtgataccatgggagcactgaatgatcatgtgaggtgcctccactggttaggtgtatgtaaatgaagattttttaaaaaactaattgggaggccgggtgcagtggctcatgcctgtaatcctagcactttgggaggctgaggcaggtggatcatgaggtcaggagatcaagaccatcctggttaacacagtgaaaccccgtctctactaaaaatacaaaaaaaaaaaattagccgggcatggtggcaggcacctgtcgtcccagctactcgggaggctgaggcaggagaatggcgtgaacccaggaggcagagcttgcagtgagccgagatcgtgccactgcactccagcctgggcgacacagtgagactccgtctcaaaaaataattaaaaaattaaaaaatacaaaacaaatctgggctaatatgtccagaaattttgagaaaatgtatgttgaataaagcatgaaaatgtaaagcaaggtgattgcatatgtataacattgctaccacaaggccaacctcatgggaaagaaacaaaaactgttagcagttcattatgtttacttacacactgaacaaacatgaattgaaaccaattcaatgaactgtcccagatactgtttaggtacttgagatgtattggtgaacaaaagagacaaaagtacctgatctcacagtggcattatgaaagatgatggagtaggaaattccaggaaatggtcctttctgtgaaataactactgaagggtaagaaccatcagaattaaccataataaaatgaggaaatctagtcccacattcgcagcattgaggcaagtactgatgaagaaagaaacaggcataagaaaatctctgtcaggttaatttttgcccatagaagtaactgaacagaaactttatggatcactctgataacaaagtccttgcaaaattattttggaagagtcaactacacaaacgaataactgcacccttgagcagcaacatcagccaagaaggagtagggagacaatctgattttgagagttacaacatcacacattcaaaatacacagatttcaacaaaaacttaaaaagcagacaaagttaaaaggaagcatgacccatttacaggaaaaagtttaatgaactgaatgtactcacaaggaagcaaaggcattggacaaatgacacaaatacttcaaataaccatttacatatgttcaaaaattcaagaaaaccatgcgagtaacaaccaaacaaaactggaagaataatgttagaacaagtgaggactatcaataaagaaaaagaagttataataaaagaacccaagcagattttctagaactgagaagttcaatagctaaaatcaaaatttcatcagataagttcagcagcagtttgagcaggcagaaaaataatcagtaaacttaaagatacattgttgtaattacacagaatgagcataaattttaaaagaataaataaaatgagcagagcctaagagatacatgggacatcatcaagcatatcaatatacgcattgtgggagactcagaaggaagagaaaaaagaaagtataaaatacatgtaaaaataatggctagaaacttccaaaattgatgaaagatatgaatctatactttcaaggagctcagtggccttcatcaggttaacctgacacagactcacagtgaggcacaatatgctcaaaccatcgaaaaccaaatacaaaagaaaaatattgaaagcagcaagagaaagagactcatcacaaacagtagattctcatgaaattaacatttggtctttgatcagaaacaaaacagtccaaaaggcagcacaataatctataaagtgatttataaaaatatattatctaccaattctgcatttagtcaaacaaatcttctaaaataaaaaataaaataagataatcatagataagcaaagtttagtagacctggtagatctgccctaccagaaacactacaggaagtccttaagtctgagaaaagacactacataatttgaatacatgtgaagaattaaagatctcttttaaatataaagctagtgctgttgtattgttggtatggagctgctgtgttttccatgttatttatgagatatatggaaaaaaatcaataattataaagccatgtacataggcacaaaatgtttaaagatgttatttgtgacattaacaaggtctaaaaggagaggaaatggaactggataggaacagaattaatggatattattgagactaagttcgtagcaattctaacaattttaaaacattaatcgttactccaatgataactagtaaaaactaaattgagtgtataagggaaagaaaatgaagaaggaatccaaatggacccagaaaaaaattaatagaacacatgggaaacaattattggggtaatttaggaacaacaacaacaaaagataaaagatatgtagaaaacaaacagcaaaatgacagactttctttgttatcagtgattactttaaatataaatggattagattcaccacttgaagcaaaataacaaaatgaaatttttaaaagtaaaaaaaaaaaatagaatccatgatctatctacatggtgtttatggagaaccaatttagacccaaagacacaaataggttgagtaaatagtaacaaaagaactggtgtggctgtcgtgacatgatgcaatattgacgttaagtgaattatagttgtaagtgagaaaaaagggtattccttattgataaaatggtcaattaatcaagaagatataatagttatacacacgtatgcaccaagcaatagcacttcaaaatatgtgaaggaagacacatttaaaataaaagctagagagatctataatataaattggagacttcagtaccccactttaaaaaagaatagaacatatgaacaaaagattaatagaaaatgcagctattgaacactataatccagctagacctaacagatatatacaaaatactgcacaaaacaaaagcagaatacacatctactcaagagcacatggaacattctccagaatggacgctattttaggccttaaaacaattctcaacagttttttaaaacttgaagtcatacagggagtcatctaaaaccaccaggaaacgaagtttgggtaggggaggaacaatatttccttctactcaacttagatttattggccagcagtccctatcacacaagacagattaaaaaataaactcatgcacatttattaaatataatttttacttggcatgggagctttaataaggaaatgaaaactcagagaaatggctgaacctgaggactttacatttaggtatgatgaggagaatacaggtgtggagaaatatgactaagaatgaagtaaatgcagtaaatgggggaaagagcaaggcctgtgttcattcttctcagcacaccttcattttagaggaaacaatgctctcttttcctcttctttctaatcaacaactcaactttacagctcatggaacaagaaagagaaaagcaaacttaaaccaaagtccacagaaggaaagaaataagaatcattagaccagagattaaagaaatagatgagaaaaaaaactataaagaatataaatggcataaaaagttcctacttggataagaagaagaaaattaacaagctgttaggcaaaccaactaaaaccataagagagaagacacaaataacaaaaataagaaatttgggataatacaaccaacgttatgggaattaaaatgattataagagaacaccataagcaactgtatgtcaaatctagaagaaattgacaaattcatagaaaaatacaaattaccaatctaactgaagaagaaataaaaaatcagcataagaaatagattaagtcggcaattgacaatttctctaaaaagaaaagcccagagccagatgtcctcactggtaattctactagagatttaaggaggaagtaataccaatcatactcaatctcttccaaaaatagatgaggagggaacactgcctagcacattctagaggccagcattagcctcgtagcaaaaacaaacaaggatactataatacagaaaactattggctaatactcctgaagaataagcatctaaaattcctaaattaaataagagaaaaccaagtctaactacacattaaagagaacacatggaatgaaaaagcgagatttatcccagaattgcaaggatggttctacataagcaaatgaatcaacgtaataaacaatatcaatagagtgacaagaaaaagcatatgatctcagaagatgcagaaaaagcatttgacaaagttcatccactttcaagacaaaaacacttagcaaactaggaacagaaggaaacctgcacaaattgattaaagaagggcctttatcaaaatccacagtgaatctcacagtaaatggtgaaagagtgaaagcctccccacaaagatcagaagcaaaacaaggactcctgctttcacagctgctattcaacattgtccaagaagtcttaaatttcattaaaacaaaaaaggctagtgctacctcccaccacaagcatggatcagcgttaggaaattaaaataatggtaatagaaaaattataatgacagtgatgatggtgatggttttttaagtacacaactgaggtttagtggcagaaatccggtacttccaattacagtgcagctgtgcttattggggtgacggaatcaatctcgttttcagtatacatgggaagcaggagtacatgtagggtacaactgcatttctctggaactgtttttcacagaagagctacagtttatcctgcactctccattctgtgatcaaaaaccatgaaacagagaaaagcacttcaacctgagactcagtcacaagaactgcacctgccccaccttcccgcaactatatatgccacctctctgtgctgaaccatgaaggccagaggggttcacatgtggcacagacggaggctggactccctggtccgcaccctcccaggtgacgggtgctctgggatcacctggagaaggcaagtgcctgggctctgtcttttccaccagcagagggcagcagagctgcagccagaagagaggctggggctgcccaggaggagcctatgaaggaggccagcctttgtggggggtggtcaacaggtgttcaagggatcagtcctcactttggaagtttggtatagtccctcctgtcacctggggctgcagtgttcatattctgagggtcagacacacagcatcacccaggatactgacaggggcccaggcacagtgacggcctcagctgggaaacacaactggaggcacctgggccctggtgtcagcctgggcagctcccatagggctaggatttcctaagagacgctccgaggtcaaggtgctctaggagggggaacagtgtgaggggacagggctcccggggctcaagcccttcacccaggatggctgcctgagcctcctgccattctaagggtctcattcctccgtgtccagcagcatcctggggagctgagccctctacacttggcacttccagagacaccctaccaccccctccctctccctctccttccagctccaggccgactctgactcagaggcagctcctatgctcaggggattctcaggtgggtggcgtgggacatttgggatcctggtccctggatggggcattcccagcctccttgcggagatgctctccagagggaagggaatgttcacctgcctcaggccacagctctgaccatgggactatcctgggctcagtgacaagatctgtctggctggagggaccagggatcccccaccctccagagctcatgggtgttcagagaccacgacgctggaaccctcacagagaccaaataacctaaagttagtttctcagtcaggtctgggtttctggtgctttttacacatttatatgaaacactgatgagaaaaaataaagaatcaaagagcagaggatggcaatttctagtctattagagagatggggggtgtcatacaaggagcaactcaggtgagaaacgagactagactgtgtaatgaatccacatgagttgtggctgctcaaaggaccaaaccatggtaatggaaatcaagtttaggatataagtatcctaaagacacagaaccacattctaattaaactaccaggacaggaccaagtgagtctgggaaacccagagctgacttggaggaggaggaagatgatgggttcctggcccacctgctgctgagtcaggtgtcattgatgatctctcagcacggcccagctcagccccatggccaggctcctggaaggtccacagccctgctgagcctggcctaggacacagcacaggccaggatggtataaaacagtggtcatgtggccaaactccaggaggtgactgtgatcacaggccttcaaggatggagtctgatcttctgaccagagaagcagataaagtgagctgggacccacttcttcttcctcagtctgctgtgcttcccacagagctggtttgagtgacatccttcagtgaggagtcccagaggatgccgatttgcatcaaacactcactgcctcaaacggcctgagaggcaataagagagagctggtgagcccagctgtgctgtgggctcaggaggcagagctctgggtgtctcaccatggcctggatccctctcctgctccccctcctcactctctgcacaggtgctgcccccaagcccttccttcaggctcagaacccataggatcctgagctgggcctgcccaaacatgagttcatcccaggcacaacctcagggtgggaccccctgggaacagattcatcatttacaagcctcctctcctgtcctctcttgcaagctcctatgagcttacacagccaccctcagtgtcagtgtcaccaggacaggcagccatgatcacctgctcttgagataacctcaaagatgagtatgtttactggttctggcagaagccagaccaggcccatactggtgatatatgaaggcagcaagcggccctcaggaatttctgattttctgagtccagctcagggaacatggccaccctgaccatcagcagggctcagactgaggacgaggctgactattactgtcacaggtacaatagaaacagtgatgagcccacagtgacacaggcagattaggaagtgagacacaaaccccttcccaatctgtgtcaccctctttctccagccccaggatggctgtggacaaagccatgagcagggctggtccagttcacccagttctgtgacccccaggctgctcttccctccagccctccaggcaggttgtgaagagggtgagttaagaagagatttgaggctgtgtgacaggctatcctggggtttttctggccaaggataaagctggtgaaagagagcctgaatggacgggcagacagagtggcccatgcacgtagtggcaaaagacctgggtttccacatgccagcccttcaggcaggctctgcagagagtgggttaggaggagatttgaggctgtgtggacaggctgttttggggttttctaacccaggataaagctggtgaaagagggcctggatgaaaggacacacaaagcgtatctttcatctagtggtaaaggatgtgagttccatatggtgaagcctgggtcaccccttggcccagacgtcctaggttagtcctcagcatttccctagcacttaagttcctgaatctcctggcagccttatattcaaaacggtgtaagctggagtggacgctgtggggtccacctagactccacgttaaggtcgacccacacactctcagagcctacgagtggatacccatgctgtggggcacatgtcacctgacagagtggctgaccacccctgatctcttctttctgaccacttgggtgtttggcactatgtccatcatggacactctatgggctattaacctatgattcaaagtttcttctgtgtggtgcccgtgcccaaagaccacccacaggcttctgcccatactccacttcccccatttccaagtttttctcttgcagtccctggaacacctgcccaggtcatttcccactgccctaagcccctatctgccctggcatccggccactcacctttcctcacaaaatgaatgaccaggcgccatgccctcatgcaggaaagatgtcccctctccattgtctcttaatgccaccccttagtacacccatatagtgcagctgtgctctacttcatggtgatccagttcattgctgggctactctggaaatttttgctccatcagctgagcagagggactgctacccacacaacgtaagtgtaaacccagggagcagtgctagagcaagagagatgcaaacttggctgtggaccacccacaggttactcagctctggggccctgctcctgctccatcctagctgtgtcacatctgtctcaccagggatcgctgctggggtctgcctgagcacacgacgggggaatctggcagttctggctgcttggtcactgaatgtccgatgctgtcctgtatctaccagggaacaagagcacatggggagagttgttttccaaatgaatataattctctcttgtggatgacatggaattgttccaaatcccatgggattggaatcccattgggaaaatctcatgggattttcccatgagagattgcgtaaacatgagttttcagttcctatcataaattcttccattcctatcaccaattctgtgactatggtagagtctgctggattctgtggtcccaacagcaggacactcatacccctgcctgaacctggtgcagaacctccctgctctgggctccaaaacagtgggcgatgttcatggctcctgatatatgagttggagccacatccccaagggttaaatatgctgcctctagacaccagaatgaccttaaagctttgtgtttctttctggtgggaattgtaagatctaataacgtgctctttattttgtgagagatactaagctgctccagagaactcaatcctaaacatttcagctactacacaggatgaatggtcttagggcttgtttcgcactctcaggaatgcgtgggtctcaccaaagcttccaatagacagggccccctcatgcacatctgatccaaatacagaatagagccctaggaggttctcctgggtgttcagatggtcaaagcccctatgacaatatcatgaaaaagaagggagagttaatgaagttgaaaaaataaaagtataaacctatactgctgtctactccttgtatgcacaccgtttctgatcctgttctgagaggaatagaatgagtttctgcattgatggtgcctgctgtgcacctgtagccatgcatggtggtgtgttctatcagggtcttcatctggcacagcaatggcagatggaactaccagctgactgcgtctgtagaaatccacttccatcttccaggatccattcaacaattgtaggaatcatttcagtaaaccaaacacaagagcctcaactataactacaagtcctccaggagaggagaacgctgtctcagagggtgcattcctactggaatttctcttctctttgggacaaaccagcccagaggaggcacaggggctgtgtgtcatctggtttcctagatgaggtgtctcctcctcactgtcctgagattttgaagaaactggggagattggtgcagacactccttggatccttacaggaaacttccttcagaccacacactcctcaatttgttcccaagctccaaagtttctaaagtcactgtctaaagggcccacagtgtttttgtggagtggtggaaaagctctggggatggaaagtggtggtggttgcaaagcattctgaatgtacttactgttgctgaatgcacacttacaaatgattgaaatggtttaaaaattgttcattttgccataataaaaatactgcacactctggaggaaagtaaacctagtttaattttgaaattgttcaatggataccaatcaaagaatagtgtagcaagcaccatttcccctctcgctatagcagcaactgatccccttgtgctcttttggactctctcccctgctctctctctctcaataataagcaatgctcttctctccagtccaagctcacacttccccagttgtgcaggaatgcctattgtaactgttaatttatttccaggcagagtcctcaagattcctctgctcatattctgttctcagctgtctggagccagcatgacaagtgagccaagatcacttgtcatgagagacttgtggaaggttttgcaaaaagttccccaagaaaaaacaatgctcattgttgacagcaggtccatttccacacagtagggccatgctgggtgtgcagtggggctgtgcacactgtgcccacaggccaggctctgcactgctgactctgatcctgtgcttggtaggaccttgtgcactgctgagtccactgcagactcgaccctgaatgggaaggtggttcctagctgctgggcactgagtctcatagagggacagatggtattgaggatgcccggcccctgatgtacataaggggacaaggtctgctggtagaacaggaagatgaaggaacctgtggctctaaaggtggggtctccagccctcagtctcagctgcccatggcctcatctgtgtgcaccttgtcaatccagaccatgtgaattagaggtgaagggaattgaaggactttcccattttctcccattttctctcttggttacagaacgcacccttccacatatactgtattagagcctgtgctctacaaacatacctgacactaaattagtgacttttgaaagtgcagataggtacagcaaccagtccctctggagacatttcccataacatgaaccagtgaacccatctctgaaagccctcatgttttaaaagacaagatttttgaatttcaaggaaaactaaacctttgaaaaaaacatgattcaaaagagaaccttgccactttccattcctgcttgggctgcagtgaggacagatgcagcaagtgcttctgatgtctgtgtctgttcccctgtgtggacgcacatatccaggcgagtttcagtgaggtaggagacttcggcagcattggccgggctctggtttgcttctggtgctaacggaacatggaagagaggacaaggtagcgtgtcctgaagatcacatatttcctttttgcaggaagtgcctgggctcctggagtgttctcagggctttgatccaggccaccggctccgcaatcaacatcactgatatttcagcaggtcattgacctaattccattttagtgctatctcaaatggaaacattattttcttgtaactattcatatagcaacatagcacttaaatatctaaataacacacacagaaacagtagtctcaaatgcaaagctgtcacctccccacaccacacactttctcacccgagcccctgagcccacccttccctcggccccccctctcctgtgctgttagaaatctctgtcttctaacagggacagtgacacaaaacagccccccctcccgcccagcactcacaccgcagagcccctagtccatctcctgagggaacgtttacgtttctattctgacagagagaagtcgccgtgaatggagtctttaccccaaacccaggagtttctgaggaacacatggggtcagccactgtctgtgtggggaggcttcacctcagggaggcgcccggctctgggctgagggggactcaacgtgcactaaaaggcaggactaaggcaagtcccgggtcacagtgtgagggacgcacgcgccctgaggaggggtccctggtgctaggcctgacccaattctaaccccaggcacctttcctcagctcctgtggccctgggacacctccctaccctgcttcccatgaggctggtcacagctcttgtgagcaccgcctcctccatgtcacactttttctgtcaacattttgaggagccagttggttttctcctcattccatgttcctgtcccacctgcctgctgggggtggatttatttcatgtatgaggtttcctcagcctgagccacagctgcctcaaggacaccaaccctgtgggacactcctctgggaaaagcaaacaagtgccaagaggagcatctgaagctctggtgtgggagatgtcctccaccctgggtcaggggagtctggaggggatgagaagggaccaggggcctgggattgagctgtgaagggaaccaaaaggcaggagggacagggcaggggctgtcagctatgactcaggggaggttcctgggcctcaggatcctccctctgaggccaccagggggcgggggtggcacatgcctggacctgggaggtccctgctgggcttcaccctgggtgggtcctaggagctccttcctcctaagtccccctaaagagacagaggcattctggggtcctaaatctgtcatgcccccataaatgcatttctacgagggccaataaatgaactccaggtttatccaagcagcagcttcaggcgtctgcagacacagagcggggaggaattagccaacctgaggcaccctagaagggctgaagggggctgaaggggactgaagggtccctgtggggcctgtggtcctggggaggggagagctggggtgtctcccagccactctgggccctgtcctgacacttctcccacaaagaagggaagggaaatcctgggaccccacagccaggaccaaccgtgaaccacaggacaggaaggacagggacccccaaggctggctccatttcccaggcactgtcatgggctgagtctcaggaaatccaagtcaaggagtttcaatccccctggctgagccccactgtccaaggaaacagaagtctacgggcccaggcccaggtgagggtggggtaagaagaggagcttaggatgcagatttgcatggaggccccgccctcctctgaggcatcagggtaagacaaggctgggggcaggcccagtgctggggtctcaggaggcagcgctctggggacgtctccaccatggcctgggctctgctcctcctcacctcctcactcagggcacaggtgacgcctccagggaaggggcctcggggacccttgggctgatccttggtctcctgctcctcaggctcacctgggcccagcactgactcactagagtgtgtttctccctctttccaggctcttgggcccagtctgccctgattcagcctccctccgtgtccgggtctcctggacagtcagtcaccatctcctgcactggaaccagcagtgatgttgggagttatgactatgtctcctggtaccaacagcacccaggcacagtccccaaacccatgatctacaatgtcaatactcagccctcaggggtccctgatcgtttctctggctccaagtctggcaatacggcctccatgaccatctctggactccaggctgaggacgaggctgattattagtgctgctcatatacaagcagtgccacttaaccacagtggtccaagttcttggggaactgagacgaaaacctgccctgggctctcaggctccctttttgctctgaagatgtttcctcacccagtgcaacgggcttcctgaagcacagccttgagaattcttctccctcagcaactctcttttcccaccatgaaatccaaaggaaacctgctctgtggtttctcatccaggacagggacagcttccttttgcttgtgtgttgtggtccctgagtgggtgcaactcttcctagctttttaaattatgggagggtgacaatgagctccctgactggtgcagtccctgctgttttcaggaacatcctcatcctaaatgcatctgaatctcccactgtgtgcagaccaatctggacagatgttattagggggagtttccagaagccacatcttactcaactctgtatccaccacactctggtgaagatgcttttttggtgcccatcctcttgggtaaagtccactctctactcatgacagccatgtgtcccatcttctgaacttgggaaattgccacaccaaaccctcaggctcagggcccacataggagctcagaaagacgcactgggaaatggagaagagatctgcatccacccctcagtggagagacacctaactagataataagataaggaagtaggtttgcatgatgagtctccccttcttatgataagagagacctagagacccccttctcaggtgtgcgctcagaggcagaactctgaagcatctccaccatggcctggacccctttcctgctcaccctgctcactctctgcacaggtgctgcttcccagggctcaacccccacagcaccagggaacagcctggccctgactttcagctcatcacggcagtgatgcagggtatggcactctgagaatgagaccctcatcttcagactcacctctcctgtcctcgcttgcaggttttgtggccttctctaagctgactcagctgcctgaagtgtctgtggctttgggacagatggccaggatcacctgccatggagaggacttagaaagctattatgcacactggtaccaacacaagtcagtccaaacccctaatctcattgtatacaatgatagaaagctgtgctcagagatcactgagcgattctctggttcctgctcagggggaacagccacactgaccattactggggctcacgttgaagacgaggctatttttgtttttctggagataaaaacacattcatagtgacacagacagatagggaagtgaggcacaaaccccatcaccatctgtatcactctctttcttaagccccaggagtattgtggacaaagtcgtgagcagggttagcccagctcagctggatgtgtgaccccgaggcacctttcactctagtcatccaggaaggctctacagagggtgggtcaggagaaaatttggggctgaaaactaagctgtcctggtgttgtttagctaggtatgaattggcttaagatgacctgactggtaggacagtcacagcaagataaccattgagtaatcatgttgcctggatttccttttgtttaatgaccaaacctaaggtagctctctggtccaaaatgccctggattagtcccctggactcctcattctttaactgagacctttgatcccagctgtcatggcatcatgatgtcgtgaacagggaagtccattgtaatggcaactgtgacatcaggggtcatttacccactatctacccaaggccgcagggaatccttggcttctcacagctttttctcaccggaaaatgccattgagtgcagagtactgtgtcttccaaggatgtgccccctccataatgtggtttgggagcaatgattgcctgatgcctagattccaaagccatgctttaattcaggatgaccttgaagtgcctcctgctgagtgctcaattgtaacacattcccagaagagcctcccacacttattttctgggactatatacccgaaccctactgcatggaattcaacctctcagagtaactttccaagaaacccaaaaattaaaaactaaacaacaacaagaaaacaatatagagagaagagtatcaaagaaaagcaagttgtacaaagagagaactctggagtcttcaaatattaataagcatcaagcagcacatgtgtggacggaaactccattttcagacaaacagcagtccaaagacactcgcgggaacactccacagagcattctttctctctctctctctctctctctctcacacacacacacacacacacacacacacacacacaaacacaaaatatgaatcctgcttgttcctacagtcacagaggaaaggcctgagttaaggagcatgaggtcgaatcctcggaacagctttgcctcagtcctggagaaaatgtcagcctagacaataggctggtctggtctcaactaagtaagttaaaaagcaagttttaaaaagtaccaagtttccgagtaattatactaaatccaagaataaaagaccaaatagacagagaagtgcaagtatattctaaatccaacaaggaaaaactcaaaatgtctagcacctatcagatttccttgcaagaaccaagaaaatacatgctataaaaagcagaaaagttcatcagtccaaagtctccctgaaattgcacagatgatagactttgtaggaagaatacaaaagcgatacttataactatcttccacttgctcaagagggtacgggattgattgaacatgttaagtggagacacggtagacataaaaagatcaaagttgaacttacagaaattacctctaaaatgtccgcgataaaaataaatacataaataaataagggccaggcatggtggctaatgcctgtaatctcagcattttgggaaatcatggtagaaggattatttgagcccaggagtttgagaacagcctgggtgacacagggagaccctgtctctacaaaaaaataacaaaatcagatagatgcatggtgcacacccatggtcctagctacttaggaagtggtggaagaattgcttgagctctgtaggtcaggatggcagtgacctgtgatcatgccgctgaactttggcttgggtgatagaatgacaccgtctcaaaaaaaaaatgtctgagaataattgtagattagctcccgcaaaataatagattactgaacctgaagatataacaatgaagctcttcaaaatgaaacaccaaaaaagagaagataaaaaattacactgagcatcaatgagttttacgacatcttcaaggagccttaattgtataattaaatgaactaaaggagacaagattggtggagggagagggagggtacaaaaaccacttaaagaaataaggaaaaacgtgcaaaatttggtgaaaactataaacttatgatttcacatagtttaacacaacccagacacccacacacaaacacaaacacacagacatcatatacacaaaaaaacacacacataaagaaaacatcaacacccgccataatcaaattgcaaaaaaaaaaaaaacaaaaacaaaaacaaaaaaaaactgtgatggagaaatgctcttaaaagcagccagagagaaaagacatgtttgatgcaggtgaacaccataatgatgagagtagctttcccattagaaacaatacaagcaagaaggcagtggaggtacattcataaaactttttaaaacttactacgcacagcattgtacatattcagtgtaatccctatcaaaacaccgatgtcattcttcacagaaatagaaaaaaaaaatcaatcttgaaatttatatggaattacaaaagacactgaatagccaaagcaatagtgagcaaaaagaataaagctgcaggtgtcacaccacttgttttcaaaatatgctacaaggatatagtaacccaaattatactatactgttttatagtataaaacagacacagaccagtgtaacagaataggaaacacagaaataatccacatatttacagacaactggtttttgtcaaaggcaccaataacatacattggttaaaagacagccttcttggtgctgctgagaaaactggacattcacaggcacaagaattaaaatagacctcgatctctcaccacatacaaaagtgaattcaaactggattaaagacttaaatgtaaaacttgacactactaaactactagaagaaaacacagggaaaatagggaaaatgcttccggacttatgtgtagacaaagattttatacctaagctttcaaaagcacaggcgacaaaaacaaacatagaccaatggagctacattaaactaaaagtttctgctcagcaaagaaaacaataagcaaagtaaagagacaacttgtagaacaggagaaaatatttacaaactgttcatctggcaatggattcacatacagaataagacaataagacaagaaagcaaaacaattcaacagcaaaaaaaaaaaatgccaaataataccattaaaaagaggtcaaagaatttgaatagacatccctcaaaagaaacatacaaatggccaaagggtgtattttttaaaatgctcaacatcactaatcatcagggcaatgcgaatcaaaatcacagtgagacatcatctcaccccagctagagtgactaatatcaaaaagacaaaacataacacattctggcaagaacgcagtgtaaaggaactcttatacactgttatatactgttggtgagaaggtaaattttaaattaatacggccattatgaaaaacatgatagtgtttcagaaacactaaaaatagactatcatcatacaatgcaataatcccactactgggtatttaatcacaggaaaaaacgtcagtatatctaaggaattcctgcactcccacgtttactgcagcactattcataatagcaaagctatagaatcaacctgttttcatcaacagatgaatgcataaggaaaatgtggcatgcatacacgatgaaatactttccagtcataaacaaaagaatgaaatcttatcctctgcagcaacatgatggaactggaggtcattatgttaagtgaaattagccaagcacagaaaaacaaatgtcacatgttctctctcatgtgggagctaaaaaaagctgatctcatggaggtatagtgtagattaatagttaccagagaggctgggaagggttaggggttgtggggatgaggggtagttggtcaatgggcacaaacatacggttacataaaagcaataaggtctattgttgtatatcacacagcagagtgaacatagttaacataatttattgtacatttcaaaatacatagaagatttgaaatattcccaacatatagaaatgacaaatgctcaaggtgatggatatcctaaacactaattcgatccttacatactgtattcatgcatcaaaatagcacgtataccccataaacatatacaattataatgtatcagtaaaacatgttctttaaattaaaaaaaactgtcaattctgaattctttactcagtgaaaatatctttcagaagggaaggcaaaataaaatggttttaaccataaatatacttgcactattcatgacctgcagacacacactatagaaaataataaagaacacttctcagatagaaaatcatactaaagatgtgactctgaataaagaaaacaaaaacatcaaatatagtaactacataaaaacatatagaaatggtaaataaacatagatataaacgacttaaattacattacaaaacaactagacttaatagacaactatagaacagtccatccaacacagcagaatacataataatctcaagtgcatatggaacactctccagggtagaacctgcaaaaaaaaaatgagtaccttaaaaaaatagaaaatctataaagtatattctttgtgttacttcactcttgtattgctataaagaagtacctgagcttgggtaatccataaagaaaagaggtttaattggctcatggttatgcaggctctacaggaaatctggtgccagtatctgctgctggtgagggactcaagaagcttacaattatggtggaatgtgaatgaggagcaggcatgtcacatggtgagagtaggagagagagaggtggaaagtgccacactcttttaaacaaccagtctcacatgaactgggagcaacaactcattgtcatgagggcagcaccaatttattcacgaaggatccacgtggccccatgacccaaacacctcccactaggcccacctcaacactggcagctacatttcaacataagatttggatgggacaaatattaaaagtatataattccacccctggcccaccaaatctcatgcctttctcacattgcaaaatgcaataatcccttctcaataatcccccaaagttctaagtcgttccagcatcaagtttaacatcctaagtctcatctgagactaacctcctgtcacctatgagcctgtagaatctaaacaagttatttacacctaagatgcaatggtggtacaggccttgggtaaacattaccattccaaaagggagaaaacaaccaaaagaacaggccccacacaagtcctaaacccaatggtgcagtaattaaatttcaaacttccacagatctctagggcatgaaaagaattcagccaagctttttactaaggcatcacaagggtgaactttgctccagttcccaataactatctcattccatctgagacctcagcagcctggacttcactgtccgtatctctatcagcatcttggtcacaaccagctgaccagtccccaggaagctccaaactttccctcatctgtctgtcttcttctgagccctctaagctcttcaaacctgtactttttacccagttccaaagctgctttcacatttgcattatccttacatcaacaatctacttttggtaccaattttctgtgttctttcattcttgcatttttatagcacctttatagcaccgctataaagatgtacctgaggctgggtaatgtataaggaaaagaggtttaattggatcactgttctgcaggctgtataggaagtatggtgccagcatctgcttctggtcaggcccttaggaagcttacaaaaatggtggaaggtaaagtgaaaccaggcatgtcacatggcaagagaaacaaaaagaagaaagagagaaaggaaaggaaaggaagagagggaaggagggaagaaagaaagaaggaaagaagcaaaaaaggaaaggaaagaaacaaaacaaaaggaagaggaaggaaggaagagagagagagaggaagaaagaaagagagagagagagaagagatgagacgagacggggggggagagaggcagggaaggagagagggagggaggaggaaggagggagagagagagagtgaaagaagaaagagagaaagaaagaaagagagaaagaaaaaaagaaagaaagagaaagagagagaagagtggggaagtgccacactcttttaaacaaccagatcttgtttaaactagtggttagaattcattcgttattatgaggacagcagcaagccaatcatgaagggtcagccctcatgacccaaacacctcctactaggcccacctcctacagtggagttcatcttccagcatgagatatggaaggaataaacaatgatatcatcctctgaacactgatattgaaaaataaaaggtattatatgagaacactgtgaaaagctgcataccaaaaattagatgaaaagaaaaaatccctaaaaacataaaaactactaaactggctcaaggaggtatagaaagtctgattaacactataacaagagtttaaattagtcattgaaacctcccacaaagaacggcccaggcatgaagggtttcattgatgaatattatgaactgtttaaggaattaataataattattcataaacccttccaaaaatataagaaaggggaacatgagcagctcattctatgaggccagaagtatgctgatacaaaaacaaaagacatgaaaagtgaactggagcacaacagcctctatgaaaacagatgcaaaacaaccacacttcaacaaaatactagcaaaatataaaaaggattaaacaccataactaactagtattcatccccaatattcaagggattcttaacctatggaaattaattattttaatgctccctattaaagaataaaaccacatggttatttcaacagtcacatcaaatgttttcatgtacgcagacaggacttcctgttgttttcccattcctgttaaagcatcataaaaggcacgatttgtggtgctactggatggggtgctacttcatgcaaactggatatgtcatgtccaaccatgaatatacttagccataaatgctaaaagattgtaatttggtgtcagagacttggtggtcagtgaccacttccttggcaagtggtaagtacagacatctgaaaggataactaggatttaggtaggtattggataaggaggtgagttacacacagaaaaagtttcacttaaaaactcatagacgcttgaacacagaagatggctcaataggtctgagaaataaacaaagtccagaataactggagctgaatggaaacaaggcaaatgacatgaaccatctgtttctctctcgacaactcactggggcattgtctcctccctataccacccacgtggattgtaaaaacatctgttcttaaaactttcttgtgcatcatgacagcatgtagcacctgaatccagctcagttaaatgagggcaggacagtcaaccacaaaacccaggtggcccaggaagcacatcagggagacaagaccttgctgtcaaaagcagaggaagtgagattttccattgtggctaagcccagagcatatgaaatttcaatgggtacacaaaaaccatatagggtttggttaagctgcagatgcagtctttgcaggtttgaatggggccccagattctccatggcaaatagcctccagttgaggttgattgatgctggtcctccaaggaacacactttgggtggcttagctcctatgcaccctcctcactcatgcacagctgaaactcacctacataacgcaccttctgagaagcataagtgacctatttctcctccactaatgtgtctcagtcccttttactaaaaaggaatatctgaagttgggtaatttgtaaagaagcaaaggtttatttgggtcatgcttctgatgtctgtaaagttcaacagtgggcatctgcatccagtgaagacctcaaactgcttccactcctgacagaaggtgaagatgagccggtgtgtgcagaaatcaattggaaacagaaagcaagttctttcctaaaaatactgcaggagtttaatgatcatatttacaaagtgtttaacacagagcctgacacaccctagctgctcatgagttggcagcaattattgctgatgtcattcatgaaaattggacctcagatggagaaactgcagtgcagagagtttgagaagtttagggacaagaaagacttagtgacttaaaatcgagttctaggaactgaggagagcatccctgggcattttactgccatcttttccaatgtctcagaaactgtttcaatgtgacgtcaaccagagaggaaagcagaggggtttgcagaaccaggggctacaacttcatccacgggagagtgatgtagtaagcgggtgggaaggggcagctgagctcatctgaagggtgtttaaggttttctggcccagggatctttggccatctctccctgcccagggcctcattcttccactgaccggcaggagctggagagtggcttctgagtctggttagagatcccagcagcacccagagggggaagacattggagagacgggtctaaggtcactggagacactgtttgctgcctagagggctgcgacaggctccttgaaaacaaaattcagacactttaggggaagaaaacacaggatgggaaggctcctcaccaggggattgtggataacagagaccaaagcatctacaaggagcccagccctactggaggtgccctgaacacagagatcctaggggtgtctgtattattttgccagggctgccatagcaaagtagcacagccctatggctcaaagaacacaaatgtattttctcactattctgcagatgatgttagaatctaagatgaaggtatctacagggttggctccttctgagcactggagaatctgttccatgcctctcccagcttctgctggctgcggaggtgtttgctgttccctgccatggagggaaatcaccccaatctctgcctcacattcaaatggagtattcctcatgtgcgtgtctgtgtcacagtttcccctttttataaggacatgagtcgtgttggattgggtacgtactctgctgcagtatgaccttttcttaactaatttcaactgtaatcaccctatttaaatataaaatcccactctgaggtccttgcagtgaggacttcattatacaaatttgaggggactgaaattcaaattcctaacagtgtgtctgccatgactcaggcctctccttggggctctgcaggtgggatgtgcaccaccaacctctcaggtggggcattacctgacagcccagaaggaccccaggccctctgaaaaatgacgtctctttcatccaccttgagggacatgttttctggctgtccttctcatcctttgcatgctgacatgggagacatcatcctctgctttttaaagaaggactccttcaccttcccaatcaccccaagtagatgcccatgctggttccacagaatcaaaccacggtgggttacgagttatattagccaccagctgacaatattccctgaatgtccaggatccacccatgctctctgaccatcaccagagtgagcaaatctctgatatgtgggtaagagtttctcccatgggctcccagccgggctgtaagtgaggcaagaccccttcttcagtgcacggggctcagtgcagctgcctccctgaccaagtcttcctgggacactaagcttatcagtttctctcccccagggacagtttttggttgtcctaagcctagctcagctctgctatgaactttgcatcctaagagcccattaaacacccccttgtgcctcaatggaataacctggagtaaatagtgtgaggtgcccctgctttctgctcccagggcctcttctcctcggtggcaccagcactgccctattgaccagcaatcctcacctgcccattcaggcctctacactgcctaccgtgaacagtcacagatcacaaactgattgccaaatttgtgcagatcatcttgacagtttctgtggaactgggtgccttctcatagaaccaggaagtcacaagccaggccagctctagagaagcaactgggggagtaacatgcatcacagcgcctggacacaacaaagggattttgctgtagtcctactaggacacatcctagtgatgtctctgagaaccagtcttggtccctgcaacagaaagcctactaaacaggacagtaggctgcaaggttgggcacaatttgtgccgtgtgtgagccatgtagattgtgcatgtgtgtatgtgtgtacatatgtgtacatgtgcatttagtgttgcaaggaagggttgtgtcaaatgtcccaactcaaaacttttctgttttcctaagttatctgcttctatctttactacctttgtactatcataagaataaggataatgattagggttgaaataggagaaggaataatgtttaattattcattcttatgtgtttaatacatatcaagcactcttcaaaacaattcatatttattaaatcactcaatacgaactactccatgagccaaatattgtcattatctctccatttccagttggagaatctgtgatacagattttgacacatgggaaagctaaggcaaagaaaggaaaaggactttgcccgatgtcagaactagaaagtgcctgacccaggagcagaacctgagtcttccagtcccagagaccctgttctttaacaacagcctgtgggcctgtcactgtgctttaaggtaaagcactgacatctccctaagactccagaaagttctctgtactttttgaatcaagtaactcatacttgcagtgatttccaatgcagtaggaattctctggtgctgaggagtctactaggaatataatttcaatgcctttaaaatttttcagtagccacattttaaaagtaataaagaacgggtggaagcaactttcgtactatattttctttaactgagcttacccaaatattatttcaatatgtaatcaacataaaaatattgagatattttatgttattttcctacaacctttttgaaatccggtgtgttttacccccacatcacatcttaacttgaactacccacattttaaggactcagaagctccctgggactcatggttgctatactggacagagcagatccacatgaatgatgatccatttggatcacagcccctgcagtacttacttagaaccatcttggggcaatggagagtcctatgacccagagggcctccttagggaagaatggctgttccattttccaaccaaagtagaaatatggcgggctctcagaaaccagggaatttttacaatgtgtttcacacttcttcccttctcaaagacattgactataacttccagttcgaagataaatctgagccatcaaaggcatttttttctattggtcagtggaatgaatggcaatggtccctgtggattgtgctccaaggatccctttctgtgggaagattcttacaataaaaccaactaaaagtaggaagttattgtttatatgtagatctagatgaaagggggctgatcatgaggaatatagtattgaaggtgagtgtgttgctattcttcacaaagggctatttttgcctaactcacaagcatcaatcatttttatgaaggtgtattttcccagagtggtcttagcaagttacatccaacgctgtatcaggacccacaagcaagggtgtcagaactgacctgcctgagcggtcagcaggaaccaatgtggagactctgaggtctccacaccaccaaccatgtccaacctccagtcaagtgacaggaggagtggaagcattggttgggaagggcttggaggagctgcagtgacatgctcagccaagtacaggagcaggcatattggtgtcatgtgacctcatcttatctcagttatctcttttcaccaaactccaaggtgcaatgtgtggaggcatctgtctgtacccatggacaccttgggcttcacacattatttctatttctaatgaaccagtgttttgttaatgaattcatttcatcacatccttagtacttctaggttggaaaagcaatacatgtctctaagatattaggtaggaaatattctcccgccactcgtatttattaaagttaaaatgcttcagtatctaatgtgacagttgtccaaattcaatacccttcaccttgttagaaatggaatcctgatcctaacttgtctggagaggaggctggcatgaggagcatgaccacacatctggatgtccccagtgtcactgctaacacacgctcttttgttacttgccgtgaagggagcagagggagcatccacacctttgtccaaaggacttggaggacagtgcacctgattaaaaaatgcagggctgtgataagtgggttccgggtcctggatgagggaagagaagatgaggaggcatggggtaggaggcagggcagggaggagctgtaaggtcaggctctgagtatgggtgaaatcctgactccactcactactctctgggaggatttgataaatcttgtaacctcctgatgttggttctcccatcaataaactaaaggagaggtcgtgtcttaagcgtatgcttgctgtggggctactgtgaatgtgtggttgaggtggtgcctgcaaaacactctccaaagggcctggcacgtattaatgtctcaaaggagtcattctgcttaagctcgtggaggatgactttcctcctgtgtgcactagagggccttgttttgaggaccccagtgacttccctggtagggctcaagcacaaagggcatgactgatgcttcctctgaggccccttctattgggtaaaattcatgctccactcatgacacccacctggcccttcttctgaccttgagaaattgccaatatgaagccctcagactcagagctcagacagtacctcagacagacatgctgtaaagtggagagcagatttgcattcaaagctcctcccttcttgagcttcaagaagaggataagacaggagctcatagtgtccaggttccactgggcagtctcgaatagagctcttggaagtccctccaaccatggcctgggtctccttctacctactgcccttcattttctccacaggtcagaacatcccagggaattcagggaaatgttttcactgctattttcccatgagcaccagtcctcaggggcattctttccagttcttctgtgcattcagcatcattcatgacattctgtttacaggtctctgtgctctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcggttgagccacagtgacacagatgaaggggaagtgaggccaaaacctcccacctcccctttctcctcagggactcagagtcaacagccctgggttcctctccagtaccctgagacctctgactctcctccctccaagacacccctaggcagaagcagatgcaggccatgactgaggccattttgaaaactcatctttctgtttcctccacaacagcctgtggggaccatgctgggagagaccagagcagcccaggcaggaaaaggaccttgagagagtggctaggatgagatgaccgtgtcccagtgtctcattgtgccctgtgctctattaccaggctctgccccaggaaaggacatggatcttgacctgtcagccatcatttatgagagttcaatttttacattttttaaaatataaaaactacaatctccaagatgctaggagcaatttcactgagtctcatcatggaattctgacctcccccagcatgtcccctgttcctacaatctcctgttcaagaccaactcaactccattacccagaccagctgctggatgatcaagacagggctgtgagagcctaagaatctttaaggtccacgatgagaacacgtcaagaaggatttatgttggaacttccttccccatggatattcacatcaacagagaagatatctgagttcttgcctacacctatgaatacctaagacatgaagtgtgtgtgtgcatatggtgtgggcagcacttcctcactcaacaccagagagtgtctgaggacactgggtacagacatggagacagggcatatttttatacactcaattaagccctcgtccttctctgctcaccaaggagccacccaacaaggccacagcaggaagagaagttgatttccatgaagagccttccctttctaagagtcctggaaacccactgtctagttgtggaatcagaggcagagctctggggcatctccaccatggcctggaccctcccctgctcaccctcccgactctctgcataggtgcttcctcccagggaataagccccatggaaccaggggtcagcctggccctgaccttgagctcagtgcagggagtgatgcagggtgtggggctatgggaatgagaccctaattctcagtctcacgtctcctgtctcctcttgcaggctgtgtggcctcctctgagctgactcagctgcctgcagtgtctgtggctttgggacgtacggccaggatcatctgccagggagatagcataggtgactctgatacaaactcgtaccagcagaagccaggtcaggtccctgtgctggtaatttatggtgacagcaaccagccctcagtgattcctgagcaattttctgactgcatatcagaggacatggccaccttgattattaatggggcacaggatggaaacaaggctattactgtcgctcggaacagcactgcttctcatctcacagtgacacagcatacagtgaagtgagatgcaaaccccttcccatctatgtcattctctcccttcaaccccaagaggactgtggtcacagccatcagcaggtctggcccagttcattcagatttgagacccccaggctgcccttccctccagtcctccaggcaggttcattagatggtaaatcaggggtggatacacaactattaaatatcatcatgttccaatttttcatgaagtagaggaatgattgaacatgttaagtagaagcacagaataaccaaaaaaggactaattgagcttgtgtacagctaataattgcaatgtctgtcaactttaaaaacatactggatgtgattaacaacagattagattatgtaaaacaaaagattagcaaacttgatcatgtagcactagaaaatattcaaaatgcagcacataaagaaaaaacaatgacaaaaatgaaaaagcattatcggatattcataaagaaaatgaaggtgagttataggacaacttcaaacagcctgaggttgactaggagtaatggttcacgcctataatcccagcactttgggaggtctaggagggaggatcttttaagactaggaattcaagaccagactaggcaacatagctctataatttaaaaaaaaaaaaaaaacttaaaaattaactgggcttcgtggcttgcacctgtagtcgtacctacttataaacctgaggcagtaagattggtagagcccagaaattcaagactgcagtgagtgagctatgatcatgccactggactgcagcctgggcaacagagcaagttcctgtctctaatatagggtctcaatctgtcattcaggctggagtgcagtggtgcaatcatggatcactgcagcactgacttcccaggcccaagtgatcctcccagctcagcctcccaagtagctgcgaatactggcgtgcaccaccatgcccagctaatttttgttttttctggagagactgggtctccttatgttacctaggcttgtctcgaactcctggactcaagcaatcctccagcctcagcctcccaaagtgttgagattacaggggtgagccgctgcacctggcctaaaaaaaaattttttttaatacaacaacctaagtatgtataattgacatccatggaatgtaaaaggtatgggtgggtagaaaagaatatttgaataaataatagtcaaatgtgctccacatttggtaaaaaccaaaaactggtatatccaagaagttcaacaaaactgaagcacaggaatcatgaagcaaatgactccaaatgacataatagtcaaattagtaaaatctggtgatgaagagccacttaaaagtatgattctaagagtacatttctcattagaagcaatgtaagcaagaagacagtggagcaataattttaaaatactgaaagaaaacagctgtcaaccttaaattctttatccaacaataataactttcaaaagtggaggataaatataatgttttcagacatataaaaacttacagaattgattactatcactcttgtcattagaaatgacaaaagacacccctagacagggggaaaatcataccaaattgaaatatgaattcacacaaatatcagataatgcaactccatttgaatatataatcacatttgaagacagattttaataagtgatatatgtatcacaaagcctaaagtaaacattaaacttttttataaaagaattatgactagtaagctgtattaggattctccacagaaacaacataaatcagatatgcatgtatgttatacgtgtgtgtatatatatacatatgtgtatagtatatatatgtgtgtatatatatacatgtgtatagtatacatatgtgtgtatatatacatgtgtatagtatacatatgtgtgtatatatacatatgtgtatagtatatatatgtgtgtatatatacatatgtgtatagtatatatatgtgtgtatatatacatatgtgtatagtatatatatgtgtgtatatatacatatgtgtatagtatatatatgtgtgtatatggtgagagaaaaagaacaagagagaaactaattttgaggaattggatcatatatttgtggtagctgacaaggatgaaatatgttggtcaggctgaaggctggaaattcaagtaagagttgatgttgcagtcctgcatccaaatttagcaaggcagcacttcaggaaacctccacatttgttctaaaaacattcagctcactaaagagtcccacccacattgtgaagagaaatctgcttatacaaagtttactaattaaaatgttcatcacatctgaaagttatcttcatgtcaactcctatactggtatttgataaaatcaatctggtgcatagcctacccaatctaacacttaaaattaactatcacttaacccagcaaggaaataaaaagataatttaaaaaatcaatcaaaaaaggagacagcaaaagggaaagaaaactaacgaacatatgggacaaatataaaataaagagcaagaagatccttccagctcagcctactgagtttctgggactacaggaaggtttgtagttctccttgaagaggtccttcacatcccttgtaagttagattcctaggtattttattctctttgaagcagttgtgaatgagagttcactcatgatttggctctttgtctgtctgttgttggtgtataagaatgcttgtgatttttgtacattgatgttgtatcctgagattttgctgaagttgcttatcagcttaaggagattttgggctgagacaatggggttttctagatatacaatcatgttgtctgcaaacagggacaatttgacttcctctttttctaactgaataccctttatttctttctcctgcctgattgccctggccagaacttccaacactatattgaataggagtggtgagagagggcatccctgtcttgtgtcagttttcaaagggaatgcttccagtttttgcccattcagtatgatattggctgtgggtttgtcgtagatagctcttattattttgagatacgtcccatcaatacctaatttattgagagtttttagcatgaagtgttgttgaattttgtcaaaggccttttctgcatctattgcgataatcatgtggtttttgtctttggttctgtttatatgctggccacttctcaaaagaagacatttatgcagccaaaaaacacatgaaaaaatgctcaccatcactggccatcagagaaatgcaaatcaaagccacaatgagataccatctcacaccagttagaatggcgatcattaaaaagtcaggaaacaacaggtgctggacaggatgtggagaaataggaacacttttacactgttggtgggactgtaaactagttcaaccattgtggaagtcagtgtggcgattcctcagggatctagaactaaaaataccatttgacccagccatcccattactgggtatatacccaaacgactataaatcatgctgctgtaaagacacatgcacatgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggcgagggatagcattgggagatatatctaatgctagatgacgagttagtgggtgcagcgcaccagcatggcacatgtatacatatgtaactaacctgcacattgtgcacatgtaccctaaaacttaaagtataataataataaattaaaaaaaaaaaagaaaagaaaatgtctctagacagcttggttcctgagctgggaatcaaccgtcttttctctccctttcaacccagagtgtggcaggcgcgccccctacaggcagctaaaagagctgactgagatgccgtctccatagggagggatttgggctgagaatttgggctgaggattttcccatgccctccctggcaggctggtcccaggacactcagaagacttactgttacaggtccagagcatttctcgtcttccttttctctctccttgccaagtgaccttggaattgttcctccccatctcagccccttcccttttgtgttaagtgcagtttgcagattttgtgttcctaggtcctgtatctgtagaattttagggaaagcagtgctggtcacccacatggaattcaagacagcgagcccaggaccagaaacacagacagcagtgggggtccccacagagcagcatggtgggcaccaggtggaggtaagaaaccaggaaccactcccctgagtgtcttcagccccaggtgaactagggaggggtcagtgggctgggctcaacccaccggggactctcctgtcactgccccagcagcaccatcctggaagcccctatatgtgctaagcagctgccaaagaacttgattaattacctgtaaatttcccttcaccacacctgaccacacatgactcctgcccccaaattactaatttattaaaatggcacaattagccgaaatggcctgaatccaggacccctttcaggtttgccgctgacctctcaggtcctcacacatgccagactctttccacaggggcctgactccactgtttccaacacaaatcccaggactcatttttctctgtcagtcctgacagcagttccagagacacttccccattaagatgtccccaggctcttataatacaacctgtctgttattttctgcctaaatctttttaattatccccatagcatttacaactgtaggaatctttgcctattgttaattttattaattgattggtgttaaatatttacttaattggtcatggatgcttttttaccacagaatcacacataaaaaacagacacaaacagctaagggtgtatttctcgctgcaataatacccaccactttcacgaagacaccagggtctttctcactttttgtcccaccatccctatgatattggctttattttcatccctgctgatgtgtgacctcagggtggctgctgcagctccagctatcactcccatattcaaggagaaaagggcctcatgaatctagtgctctttcacaagagcaaagctttcctaagaagaatttcacccactgatctcacaccccactgatcaggcctgagtcacatggtcaatcccagctgagcaggacctgggaatcacaggcaccagtcttttcggtgaatatagaagacagtgctcaggtggaaggtgacagggactgtctgctgggtctgcaaacccagttttcccgcacagccaaaccagcacgatgaacaactcacttcaagaaggctgtgtcttgttcctgctgaattcaccgcatggaacgtgtcccagaccacagtgggtctggattaacatttgatgggtggatgttcttctgtctctgactttggtgcaggagtcaccactgtacgctggtcctgcatccacagcggggaccagtaagagccagtccctgagtcctgtgatccccgccctgcatgccaagccctggtattacccccatgaccacccaccgcccagacacatgtgcaggcagcctcagatggaccttcctcctcctcttccaaatattcatgttcatattgtcatgagtaatctgcacccctcgcacctggtattgaggcaggcatgagtcacaaagagaagagaaaaatttcctccattggcaccagcagtctgcagaccagggaatcagggacctgaacagaagattttaattatacacccggacccaggaggcccttgagcctccagcagccagtatggagcagccaccaggggacagaacagagtcacctggcaaagtcacttggagatagggtagacctgggtgacaaggagatgctgacatgcagggagggtcagtgaccacaacctgagatctagaaaggtgtcgtttttctacagcatcatccttaacatcgagtacaaattctccaggctttgtgtttctcagctttgtctctggccaatgttgcatatttgacacaggtgcagacactttgcttccccctacacactggcccactcttctgtgctaaaacgctgtcattgccacaaacgccatcctcccctgtgggcacatgtgtttcatcaccctcctgtttgctctgagagccccctcattctgctacacagcaaagttttctttcagcatctaagctgtacctgaccatgaccacatactgggggtacataggcacagcacctgtgccctaccctaggagctcacagccaaggccaggaacttacagcatctcctgagtctttcaacactccgtgtgcacatgacaagggtgaagtttgattgtggaaagcaccactcagaagcaatggcaggtccctgcatgtgtgccagccttacggtgtcacctgtagagtggggtcatgagggtcactgcactgggttgaaaagtgccctccagagggggagctagaaccacacctaacttctggattttgccacaaaatatttagggacaggacacccctggagtcctcaattacccaagttattctgagccagtattcaacagaggaagtaccttagatctcagaataatccctcagtcgccattgtaagtcagtccctggccatctccacgcaggacaaggaatggccacatgggcaggacatcatactacctggaaaacgcacaaagaattcctctcagagttctgcatggccagatcagctcaggagtgaggccataacacaacctacagtgacgatgtcaacccagatgatgggaccagaaggagaatgagaattctgtgtgctgagggtgggtctttaggggccccctctctctctgtcccttggggctgagcccttctctggaaaccacacagctcctcctgcagcagcccctgactgctgatttgcatcacgggccgctctttccagcaaggggataagagaggcctggaagaacctgcccagcctgggcctcaggaagcagcatcggaggtgcctcagccatggcatggatccctctcttcctcggcgtccttgcttactgcacaggtgctgcccctagggtcctagccactggtccagtcccagggctctgggtccagcctggccctgactctgagctcagcagggcccccgcctgtggtgggcaggatgctcatgaccctgctgcaggtggatgggctcggcggggctgaaatccccccacacagtgctcatgtgctcacactgccttagggctctttcatccctggatctgtgtccaggccaggcacgtgggaagatttacttggagttcagctcctcagtttcaagccttttctctcccgttttctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcacacagtgacacaggcagatgcggaagtgagacagaaaccagccacctcggcctggctcacaagacccttccctctctcctgccctgtcacactgagcaggagggagccttccatgtggaatggaagtttccagtcctatccctgcccttatgttcctgagagacgggagcaagttcctgcccacctctaggctcagcttatcccagaataaactgagctagtcattttgatgatcaaatgccagctcccaaaagaccccagaaaccctgatatctaagtagcaccgactctattagtatcaagggagactagccctagggtggaatcattttagtgtctcagaaggcacagggcaatggaaagtgtttatgaggtttcaggatatgcacgtgagcagttaaaggcaggtcttacaaggaaggaacctactagaattggggcccatctgtgacatcatagcacagcctggtggacacagagaagggaaggtcctgaatcaagtcttgatcagtaaatatttattggataagtgagcaatttacataggtgagaactgtgtgctctcttgagcagaacacttacctggataattggttttcaggaattccctgaagcaatgagtgacattctttattgttttcaccctcatccacctgggaaagagtatcctggaaccagcagttaacattgacacagctggtctcggtcctcagcacaaacattcattgcaggctgaaaagtgacaacggaagagaaaggagtttattaaatccctagacacaaacaaatccataagcagagatgagagatgcgggctcagctggcccagtcccacaggggtcattcctcttgtgatggaaatgaccacatgagggtcccccaagcggtgttggggggcagtcatggggaactggcctcccagggctacctgctgcttgggctgggcagaggttagagggatggaagtctggtccagtccttcccagcagcatctccaggctcctcctccctctactggggcttcccctccactccccagaaccatcattgcttcctcatctcctgtctcctccctgccccaaggccctccctgtgctcaccctggctcctccccctgctccatgcccagcctctgcagagcagcccaggcccagagacttgggcagaagcttccgtcccaccagctgcagaaccttccctacagaaccaggccagtccctgtgtctcatatttgtagagatcccaatcaccctcagagatgacgggtgggaaaccagcccacagtgacctaggctgttgggcatatggccttcaagctggccttcaagcccacttggctgcatctccttggccaactccaacatccaggctgggagtctggaatcctagttcccctggcccattcactcccactagggttgcttctaaactccctgggcctcagcttcctagtctgcccactggaagcagcgacaggcattttccagggctgcggtaagggccctggaacaccctctctcaccctctctctccctttctctctctctctctctctctctctctctccccctccccctccccctccctctccctctctctctctgcctctgtttcctcctcagtagtgggaagaccccctgtcaggtgggccagtccatgacatctacagagggagcaggaacctctcctatttcctggaggagagctggggtggaggctgcaacccaggatcatcagaggagctggggtcttcaaggttcctagggaccccttaagcgggggtcagagtggcttcagcggtcttattgctcggtccagacagaagatgtttccagttgtgaaaaacgacttcagggacaacaaaaacagagattcgcctctccagacaccagtggttggtgtgcctggagtactcctcgtaccaggcaggggagagagtcctagacagaggaggttctaagtgtcacctagatttcaggcctcggggcctgtattgggtaggtgatgtcacagtgagttgatgctctgtagccccttccctaggaggtggcagagggaagagctggtggtcctctgaggtgtgagtgagtccaaccctgagggtcttcccaagctggaggtccctgggtgtagacggaagaggttctggtcaaagaggcctggtgttgaatcctggtccatttattcatttggtcaagaaatattcatggaggacccaatatgtgccaggtgccaagccaggtgactggggacacagtgttgagtgggacagttggctccttcactgctagaggtattatattctcaagccgagactcggctctacgattgtatgtcagatatatagcctctatgtgcatgtctccagagactggtttcctggagttccaagtgacagccatcactcacctcgaatgcaaaaattaaaggagcatccaaaaacctagtgacccagataaataatacttaatgcaatattttcaaaaatcaaaattaatgcccaacaaacccacaatgaacaaaatttcaggatctgactcactcacctcagtggttttgttcttggtcctacccacagtcccacaggtgagtgagtacccacagggatgcaaaaccagagtcaggcccctgcaccgccttctgcccggccaccagagccctcccctgggtcttggcctttctcttctgaagagctccagccagttcctcctcaggcttcctctactgctggtctcttctgccccctactggattctccccttacagctgcactccaggcagctggtggaggttaaagaacagaaacctcccaaaactccaccctccagttccaggctggctccacctcatgtccaaaaaggctggtcctccaggtctttgattgctattagtaagtcccaagacacagtctttacaccaagtcgctgtgtgccttgggcaagaaactctccctctctgagactgtgtttccacactggtagaagtagctagaagacctccctgccaggttggcaagtccactctgtgacatctacaaagggagcagggatctcttccatttcctggaggagagctggggtggaggctgcaacccaggatcaccagaggagctggggtctttggggttcctgaggactcctcagagggggatcaggagctgcagagccagcttctaactctggggactcagagatccagaacctttgtcatatccccagccaatactttgtcatcctgtgcctcagactcccccagatcccaagagtgagaagctcaagacgagacaagaaagaccagccagcttgaatttagggatggtggggagtggggagctggggacccctggacctgggggagaggagtctgcagtgcctgcaggtggagtttctgggacctgggggatggagactgggcaggggactgaccagcagaaggccaaggtgggggataccctcagacatggagcagggcagaagcaactggatggggtacatccctctgctttgggagagaagggccagggcgggacccagagagctctgcagaggcaccacagaccctcagcagggggtctgccaaacaggacagctggacttggctgcttctgcccaggcctggatccagcccttgcacatctcagggcaggggataggcctgggtggccagagctgcagctgcacctgctggggaggcctagtccagtcctccagggtccccagacagactcggatttccgactgcagccaccatggaaggatgtggtctgcggtgacgatgtctatccagaggccatggcaggtgcaagggtgggggtaggggcagcagctggggatgctacatttagggacagcccctttttatccccaagacctgggactgtccctgaaaggaaccacagcttctgggtcctgagcagtgggtgagtgtcatacccacagaggggctggaagggagcagcttcagcctagactcccagggcagaccctgccccagccccgaatatccaaggagcccaagatcagaggcaggaataggccaagctccccagtggagaagctgtgctggaccaggggtttcccagggccctcccttgtgccctgaatgatgtctgttagggcacctacaccctgttactgctcagtgccttgcctattttgaaggacagggatgtgtggtgattatttgtataatccagcccccagcacctggtcctcaaaagttacccaagcaatgtgtataaagatccagcctggagatctttgaaaaccgattcgatgagtcgaaccattaagtcatgatcaccatcctcaacttcatctctttcttcctcctcctcctcattatcatcaccttcaagaactgttaagagtctgagacttcatcctatttgcagactaaaaagtaagcctgccacagtgccatggatgctggcagaagatacaagactcctgggtcagagacaacgaataatctgtttttcacagcaatagcagttgccaaggtatcagcattgtcttgcaccagttccacaaggtgatgcaaagagggccaggtgacatctgcatgccagagctcagggatcccaaatatttcatacttgacagtaagcatatatctgtgttttgctccaaagagaggcattctctgtaccttccgaggttgttcactccacaaacactcttgaaaagataatccacaatcagtgcctttgcccgagagacatgcagaaatgcagagatccatagtagaccactgtctcccaacaaccatcaactttatcaatgaaatgaagtctcaggctatttgtctgttaccatagcccacaaaaatgtctggcttgattgtcaccaaatgtatcaaggaagttaaggagtatctgacacaaaatgtgaaccaagcaattctcaaaggagcctcccaggaaattcactttaggaagtcctaggaggctcctctgagagttgctaaaacaaaacattgagagtcctagagggctgcagatctgaacttgagcagatatttttaaagattttgtggcagaaaaagaaactggaaagcaagagggcagaccctcattgcagttctgtaatgtaagggggcagagcaggggcctttctcaccagagtatggggtcctgaagatctcctcaaacatttttatactaggctctcagggcaacagaaaagatgggagcgatgaatggggcgtaaaggagtgcaaatgacacaaggggtcacatgaagcaaaagaggtttattcaaccagatttagtccatgtttaattgagccactcctttgtgccaagctctgggttttcccatgcaccaagcagtgtgttaccacctagacccagagagccatgtcatcatcagcaaagcacgccctagtgtcatgcaaggaccaggcctcagattccgactccagacctactgcctcttggccctgtgacattaaaagagtagggaatcagcctgagcagcatttcctcatcttcaaatgtggaggacagtagatgatcttagctcccaggattagtgcttgtaaagcaataataatgtaatgcattattattgtattatgcatcatattcccatattatagtcaaaaaggaccccaacttaaagcacctgccagccctctcctcctccaccactgccgaatggagccaggcacgagtattccaggtggacagacgaatagaaatacaggggacgagccccttcctagatcctagcgcagcttgctccctacttaaggaatgatattggaccctgcattcatcttctctggatggtaattttctcacctgtaaaacagagacactggccccaaggacaccccacaagtagttgtgaatcccaaagtaagagaagaacaaaaaaagaaccagaatttattcaacacccactgagtgcttagcaaacacatggtttctttaactctcataagcttcatgctgcagaggaactctccccattttacagataaggaaactgaggcccagaggtaacctaggtctagatagactccacatttatgacttcaccactcttccttgcctgaaggatatagaatcactccctgcagggctcttgcctgactcaggaaagggccacaggatagccagccaggcttaaccaacccagccaagaaagggctggtcccaactggctggagtgcagtgtacaggcacccagcctggaagactgatcagaaaagaagccacagctccagccccagccccaaccccctgagctcaagcccttggggactcctgctgggcagctctctaggccctagggagatgctccacagacccaggctgccctttgggaagtggggaagacaagtgggtcaggtgtgcaccacccaggggcggggccaggcagccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtaaggggcaagagattccaggggatgtgggggtcctgcagcagagctgggaaagggtgaccaaggggagacaagccagaggagtgaggaggaaggttaacccctaagaggggcctgggctgacactggctttagtaatgggttgatattttgtccatcacagatttgtttgaattactgtttttaatatcatattacgatattatttttcttgatttctgagttttctggcgccacttaaattttcaccagggtcagtgcctcaatcacctagtcctagtcctctgggtagggaaggaacagaggcagggacaggacatccacagggggtggtggccactgtccccacagggtgcccaggcctgttcctccccctcctcctctctgcccatgtgcctcctgcccagtgagggcaggggccactccctggagaaggcagcaagggcttggtttggtctcccccaaggctgtctgttcaccaacttgcacataaatgcttactggggccaggctcaaggacacagggagggtgggatgaaccgaggggagctgtccagtcattggaacaggcccacggcccatgtttggagcaataaagggagaggggatctccctctgggatgatgcccaggctggtctcacagatcgaggggcactggctggtgatgggtgcccccaaaagacagagcagcgtcagaggagaggagagcacaggatgaggctgggagctcctgggtgactgggaaggggaggcaagaagaccatagggtccgtgcaccattcccagtccaggacgagtccttggatggatttaggtagattgattatcagagtcagatttgtgtttttggaaaaatcagcaccggattggaggctgatgcgacgcccgattagaggagggaggagagggggtgatggccaagtccagggtaggtggggatcctggaggaagccgtgccttggggatggggaggacactcagattcagagcacccaggggcccagtttcctatgaaatgggagcatgaagttgaagtgagggctgagcagaggggagcagacacgctcggggactgtctatgggcattaaaaatgtataaccattttagcaacaggcggcgagtcaaaaaacaaagtgtgtttatctaaactgggcaattccacttctaggaatttatcctaagggttggttgggggaataatcaaagctgtaaccaaatctttataacaagggtggttagctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtacagtggcgtggccacagctcactgcagcctcaacctccagggctcaaaagatcctccagcctcagcctcctgagtagctaggactacagatgcaggccactacacctggctaattttgattaggattattattagtttagagacagagcctcgctatattgctcaggcctgtctcaaattcctaagctcaagcaatctttctgcctcagtttcccacgtgctggaattacaggcgtgagccactgcacctgacccaactgtgtttttaaagtatatatgcattttcaaaaacctgtcagaaaatatagaaaaatgtcaatggtgtgtctggctggctgatgggatttcacctaattttaatgtggctttataattttctggttttgtgaagttgttcacaaaaagagacatttcttctaatataatttttaatacaacagtaatgtactcatgtgcattactctttttgtaatgagtatattacaaaatgtaatgacttttgtacattactcttttttcttgccaaaaaaaaaaaagattaagcagagaagtatataaagtaaaagcaagtgcttctgcttaccatctctcacctcttcccagagatagccactgtcaggttggtcaatatacttccagaacttttcctgtgtgtgtgtgtgtccctgaaaacacacacacacacacacacacacacacacacagttggtgctgggattttattttgcaaaagtaagagccatattctgcatattaccaacttttaatctattattgacactttctgtatcagtccatatggattaaccacattcattgcttataaactttgttttataagcaaagtttagatgagccagaatttatttccactaaaaaatctaaatgacaaatgatgctgcagtggaaatttgtgtgtgtgtgtgtgtgtgtgtgtgtgtgtgtgtgtgtgtgtgtgtatgtgtacaaagtgcacttatatatctccccaggatagatgcctaaaagtggaattgctggatcagagagaatgtacttttgaaatcttataggtagtgtttccaaaagtctgtgtccactcactccggtgaatggtagtgccttcgctcctacattcttaccaataatgcaaaattgttgatctttttatattctgcccatctgatgagcaaaaaattgaatgtgtttatggttttattgtgtattttattactggtgaaattattttttatatttttatttattggttttatttcgtctgtgaattaactggtcatcatgttgcccgcctttccattcagttgctttcatctttttatatatcaataacatattgggatatatttgggattttaaccacttgtttagtgtatgtattgtaaatatttttccctggtctgttttacgggtcttttgtttatggggtctcccaccataaaactgtggtaaatttttatgtgtcgaactggtttaatcttttctttatggtttctgtgacctccaccatgtgtaggaagttgtctttatttcaatattataaactcatttttctgttttattctggtacttttggtgtattggtgttttatttttttttctttacttcccctggagtttatttttgtggatgtaggaataagaccttattttccaaataggaaagccaatcatcacacatttgttgaatataaatgcaacttttctcaattactacattactgatttattacattctttctgtggttctcttggtttattgagctattcctgcgcccaccctgttttgattattttagctttatggtatgttcggtaactggtagggaaagaacccgtcattgttactttttctcaaaatagtcatgtctattatctgtcattcttagagttggactgcagaattggttctctaattttcaaaaatcattcttgtgttatgtggtaatatcacagaatatgggattaatttgagaactgctatctttataatgctcagtgtttttgttcagagacatgatgtactctccattcactcagataagtggtttaatattttattcatgcaaatcttgcacactttgttttttattcataaagggtttgtaaatataattttattgaagttataaattttttcacaattttatatcgtaaatgattactgtttctatagcaaggaaccctattaacttttctatgttgctcttgtatccagacactttaactcttgtattaattccagcagttcttcagctgattctccgtgtgtgtgtgtgtgtttgtgtgtttagttaactatcacaccatttgccaagaacaattttctctctttttctgtaatatttatacctccttctctcccccttttatgtcatttcattggctggaatctatacaatatgctgaataataaaagtgagactagacaaccttgccttgtttctgattctttaaatgttttgcctttaaatatgaaggttgctgtaaatttggggagatattcttcactgagttaagaaaattttcttcagtaacttaataaaaggctaaatgtttgctttctttatatgagaaacaagtgttgaatttatattactattatattaaattctgtttcaaaaatcttctgcacatgtcttaaatacaaatgtattaaatacaagctgctgctaagatgaaagttgctggccccatcacaatgggtatcttccaatgtgaataaattgccttggggaataaaatcagatttggaaaaacctgaggatggttgccatcataaactcttagagtgtgacctgggtgtttttctttttctctgtaggatgttaatagtatcttgtgtcatgctaggatgtctaggacagagggcaatacaatgaggggaaggcattctgcgatgtccccaggcctctggcttgaagagtaacttgctgaagtgaggactctgtggaggagcaagttatacagaaagaagtttagttgtgatctgttgagttggaggtgtctacagggcatccaagcagacataggttgaggaggcagaatatatgtgaatctggagccaagaagagaggtaagggctggaaatagggatctaagacccctggacagttgtgagtgtgcacaatgagggtcagatgcagagaaaattaggagactacagagagcagaacccagggtggggatctgggagtcagcagttgggcatgggcctggtagaaagggaagccaaggaggaggagagggggcagtctcagacaccaaggaggggagagtgactagaaagaaaaccttcttgcagagacataggggatggggaagaactgcagactgaactggggcaaaggactgttggccttaaccagagagatttgagggagagatgaggctgagagccaggggatcctgccatgtcccagcataaaaacagtacctgacacagatgggtgcttgggagctgttgtcggatgaatgagtggacagatgcatggatggacggatggatggaaggatgatagattgatggacaaacagatgaacagatgaatagctggatggacaactggatggatgggtagacagaatgatctcagagatcagaaaaagcttcatgcactaagtgggactgaaccgcgtctccatgggtagaaagcagaggaatctccacttgagtcaggaatgacccagtgctctcaatccagggagaaagccagcctggcttcactggggacacttgtgtgggggactcagaggccctttaaatgaggccagacgaggttggacaggtccaagccaactcagcactcctctgccacactgcacaggaggggatgtgtcactcagggagttgctgggacctatgggtcccagtgttgtcatcagcaccgacagcctcagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtaagtggctctcaacctttcccagcctgtctcaccctctgctgtccctggaaaatctgttttctctctctggggcttcctcccctctgtcctcccagccttaagcactgacccttacctttctccatggggcctggaggaggtgcattagtctccgggtaaccggcaggaagggcctccacagtgggagcagccggatgcagcctggtcccggggcctgagctgggattgggcagggtcagggctcctcctctcttccagggcagatgtctgagtgagggacagaggctggttctgatgaggggccctgcagtgtccttagggacattgcccagtgactcctggggtcaaggacagaggctgctggggtgggcctgggagctgctgagtctcatagtctaggggagcagccccaagaacagctgagggtctaggctgaggactggatgccaatccagcctgggagggccacacggcctggtgacacagaggtcaccccaaggggagaccaatggagggcacagagagggctctgggtctaggctgcagctctgtggcctgtgctgggtcatgaggacatggggacacagagggacgggtgagactgggtgaggtgccagaatccaaccctcccaggacagtcaccagaaaggagacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtatatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaaatcttgttttatctcattttttttctcacataaattgctagcctccccggggttctcagtgtggggtacagggaattctgcacccagtgtgaaaatcacccaagggaggaggctcacagcctccctgagtcatctccccagagggtccttcctctcccagtcaccccttctccaactctccactgtacccctgagctaccagtctggcatcagttcagaccagtcccacaccctcctaaattttacttctcaataaatacctgatcatgtaaaacgcagcatttctaatgtgcagtctctgtctggtcatgtgtctgggctgaagggtcactgctcagggacagggggcagttccaggtgagatcccatgtctccgtcatcccacaccccacccaacctgccagggaaccgggtgagctccctgtgccagtgggaactgcaatccaaggcacaaaattgtcctgcagtccttgcccacctgggaagggacaggggcccagtgagaggtttgctggcgccctgtggggagattcaggagaaatgaagggggtccccggagaccagatgagggctagaggcagaaataatggaaaaaggacacccttgactcaaggccacggtctcagcaggaacagaaggtgaaattccccattgcatacgaggaaccagtcaggagagtgtttactgggtgagggataaataactgtgctgccactgggaacttgtaaaaacattgggaaaggaaacatgcaagtgtctttctaagacttgtacaatggacattggctaagtaaacatactgacaagtcctgcactagggaaccagtttaatatgatgagccacagcatatccaaaagcatgttgatctccttcttcacctttagaagacccaaaacactctgaaagataccagcgtttcctggaactagtttgtggaatatggggtgaggttgatgcacatgatgttacgggtatatgatcacatggctgtgggttggggatcaggctcaaagttaacactagcgtggggctggatgtcaagcatgaagggtgtggaccactaagtcaggcccaggtagagttaatttctgattggtttgtggctggagcttgatgatggtcagtctgcaggagcaggaggatgtggggaaattgggaaaatgagaaaagtcacaaatccaagctcaaactctgcatctattgattgcctgggggaggctaatcagagttgaattcaggatgagcttcagggctgggtcagactgaataagagctgagtgaatgtgggctgatggctccaggcaagtcctggcctccactaggagtcagatcccacaaaccctcctgcccgcagagcaccctctccctccgtagctcatggtggcgcagcctccccaccccatcccatgtacacctgctgcctcatctcagagacactcattccagtgtctctgacagcagatgatgtcagcctcctgggtgtggagaccccagctgtcttggagagtcctcagtgcctgggtactctcagaccccctgtctctgcctccagcacatcagagacatagcagctgcctccaccagagctgctgggtgatcccaacaggccagggacagagcctgcaaagacaggaatctctgcagtcacaatgaggcaaagaaagagccccttagagcttgatcacagccacccctgatccaaatcccagcctctcattagaaggaggcttgagggttctgttgccacagcacctgtctgagcccatttcatggaggggaaaactgagatgaccaagggccagatccatagtcctgctgggcacaaggccatccccagcagctgcctaatctttgactgtgttataagtttccattatggaaaactttgaacacatacataaggagacagagaaataataatgcccccaagttcccatcacccagcccccccaataagcaattcacagacattactgacccacccatagcagaataacccctccattacacaataccagacatcacatcttttcagctgtaaatatcccatttctatgctggaaagatatgggcttaaaagtaactgcaatattattaccaaacctaaatagaaattatcactaattccctaatatcaagaaataatcatgggctcctcaaatccctcacaaatgccagaagcgtattgacttagttaagtgttggtgctgtggttattttggggttttgggtggtttatttcagaattcaatatggcatcaaatggtgatgggcgcatgtgctgtcaggccagttgtcactggtgaatatttcctcaattgctctagtgctgcctggcaaggcaggagctgcaggagttgagagctgtccggggaccttcccacggttggaatacagccacacctcccaaaacaagaacccagggctatcatctacttctttttttttccccctgcaaaatggttctagcatggagggacttaactggattcagactagacattgcaaaatagcttccaaggacagggagctgctaacagcgagatcacccatgtcagattctcactcttgtagtaatgttagctgcataggatggtcaatagctacatccctcagaagggaaggaaggcagagggatgaggcttcagttcacctccttctcatgagtgctgcagagcatctgtgaattcagaggtctgcagctgggctctgttcacccaggagtgtgcttcatgctctaggaaggagccactttgcacacagatgatccggggcccagccatccttccagggtgaataattaatgtcttctctcatggtgaactctaggattcaagccatctaatgtttttgaagccactgtcattatatttaattgatgatgacaggtggccaccaatgatgaatattttcccagggggagtctccctaagtggctttagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtggtatttggagaccacattctggaggctcccttatgtcccccatttgaaaaagacaacggcagccaccaccccagctgtcccacccaacatgaggccagattcggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggggcaccctctgcaccaccccatggtgttaccaaaagttgaaccatgggttggttcaactttgcagagaagagaccacctaacccatctgtggaaattcactccttagcgatactgatgctccctaagaaattcaatcctgggcctgagtgatggttggtgcaaaaaacaaattcaagatcccagtgtcctccagaagcctggatttccagggatcctgctgtgagtcacaggacgtcaccggtccccttctctttgtgggttgagtgtgggggccatgtggactccctcatgagcagatgccaccagggccactggccccagcttcctccttcacagctgcagtgggggctggggctggggcatcccagggagggtttttgtatgagcctgtgtcacagtgtgtggtattcggcggagggaccaagctgaccgtcctaggtgagtctcttctcccctctccttccccgctcttgggacaatttctgctgtttttgtttgtttctgtatcttgtctcaacttgtggtcagcctttctccctgcatcccaggcctgagcaaggacctctgccctccctgttcagacccttgcttgcctcagcaggtcactacaaccacttcacctctgaccacaggggcaggggactagatagaatgacctactgagcctcgtctgtctgtctgtctgtctgtctctctgtttgtctctctgtctctctgtttgtctctctgactgtctgacaggcgcaggctgggtctctaagccttgttctgttctggcctcctcagtctgggttcttgtcggaacagctttgtccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagtatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcagggcatagtggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagcctttcctgggttctcaatttgtggtggaaagaaccctgaacccagtgggaaagttgcctatgtgaaggggttctcagttccctgggcatctctgcaggtaaggccttcctcacccagacaccccttcctcagctctccactgtacccctgagccaccagcctcgcctggctgggaccaggggggtgtcacactctcctagattctgcctttcaacagaaacctaaccacgcatcacacggcacttctcgcatgccttctgtgtctgctccagtctctgggctaaagagttgctggtccgggacaggggataggtccgctcttggtcagatgccaggtccctgccatggcatccctgaccctatgcaacaagccagtgactctggtgagctctctgtgtcaggagaatccatgatccagagtttcatattgtcctgcaagcatctggtgggctgtagctcttgccaaactgggaaataccatggcccagcatcaggatgcaggacagtccggagagggaaatcaggagaagtgaaggggtctctggggagcccagatgtgggctagaggcagaagtaagggtgaagagcacctatgagtcaatgtcatggtctcagcaggaacacagttgaaaatccccattccacacaagaccgtttagcaggaaaggagtccatacttgtgctgccaccaggatgtcctgagaagccttggagaatgaaacatacaggtgcatttcctagacttgacaatgcacgttagccaagtaaaggcaatgaaaagttctctactagggaaataatttcctgtggtaaagcttagcttatgtaaagtcacatttatccatctggcacctctaaaagccccataatattctgcaagatactagtatgtcatggaagtagtttatgaaacataaagtgagatttaagaacaaagatgttacgggtgtatgataagatggctacaggctcagggtcaggctcgaggagtgaaggaggccgtgtcaaattcatgacaagagttggagctgggccaggctgggtcagggctgtgtgaatgcagacagagggctacaggcaaggtcaggcatccatgaacactcagctcccccagaccctcctgcccactgggaccttcgccctcccttggtcacagtggtggagccttcctacccaaacctctatggaggccctggatgactgtgcgttcttagtgcccacgcaaacttagactccctgtctctgcctccagcacatcaggaatgtggcagctgagttcaccagagctgctgggtggtcccgacaggccagggacagagcccgcaaagacaggaagctctgcagtcacaatgaggcagagaaatggccccttggtgcttgatcacagccacccctgatccaaatcccagcctctgaattagaagaaggctaaaaggttctagtggccacagtccctgtctaagcccatttcacaaatgagaaaactaagaccacccaaggagggccagttacgtaggcctgctgggtacaaggccaaggtctacttcacacccagcagctgtccaaagactgagctgtgtcataagtttatattatgaagaactctgaacatataaataaggagacagaaaaataacagtgtcccatgttctcatcacccagcactcaaaataagcaattcacagatgatgccgacccacccacagcaaaataaattctcccttacacaacatttagaaagaaatacaagacatcagatctgttcagctgtaagtactccattactgtcctggaatgacatggaccttaaaataactataatatcactaccaaacctaaatagaaattatcactaattccctaatatcgagaaataagcagggtctcctcaaatgcatcagaaacaccagaagtgctttggcttagttacatgttggtgctgttggtatttgggggtttaagtttatatgaggagcaatatgacatcaaatggtgatgggtgcatgtgccatcaggctggttgtcactggtgaatatttcctcaattgctctagagcctcccggcaaggcaggagctgcaggagctgagagctgtctggagaacttcccctggctgctatacagccacgcctcctggagcaggaacctagggcttccctcagcttttattttcctggaaaatgattctagcatgaaggggattaacttgattcagattggacattgcaaaatagcttgcaaggacagggagctgctaccagcagagtcacccatgtcagactgccactcttgtagtaatgttagctgcataggatggtcaatagctacatccctcagaagggaaggaaggcagagggttgaggcttcagttcacctccttctcatgagtgctgcagagtgtctgtgatgtcagaggtctgcagctgggctctgttcacccaggagtgtgcttcatgctctaggaaggagccactttgcacacagaagatccggggcccagccatccttccagggtgaacaattcatgtcttctctcatggtgaactctaggattcaagccatctaatgcttttgaagccactgtcattatatttaattgatgatgacaggtggccaccaatgatgaatattttcccagggggagtctccccaagtggcttcagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtgatatttggagaccacattctggaggctccctcatgtcccccatttgaaaaagacaacggcagcctccaccctagctgtcccacccaacatgaggccagattcaggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggagcaccctctgcaccaccccatggtgttaccaaaagttgaaccatgggttggttcaactttgcagagaagagaccacctatcccatctgtgga

SEQ ID NO: 348 - DNA, 175559 bp, Homo sapiens
agactgttaattactgaccttagaccttatacctaatgatctcattggtcatgtctgtgggcacagcatacaggtaggaatggaaaaaaaaaattgttactggagattaagtaggatcaagcatgtgaaggaattcatgagttacctacagatgttagattaataatgagaatggcttcctagtgtcttcaatcctcattcctgctattacactctctggttttacttcccattgatggctgcccccttcttctcaccaagccattctcactgttagcctgatctgcagggtgatgtagtagtacccttaagctgagccccagctggaaagagcctcagactgattatggggccttgtgagtttctggatttagataatccctatacagtctagttcatggagccaagatttggcctagtactttaatttcttgtaggagtggagttctgcagtcattttattcgtccctcttcttagggactagagctctgaatctgagcacaggtttttgggtagtgctgtgtctctggccagacctcttagcttactaaaacataaattccccatgcctggtctgacccgtatgttgatcctgccatcacatcatctaaactggccggcacagtggctcacacctgtaatcccagcacttggaggccgaggtgggaagatcacttgaggtcaggagtttgagaccagcctggcccacatggtgaaatcccgtctctactaaaaatacaaaaattagctgggcctggtggcggccgcctgtaatcccagttactcaggagggtgaggcggaagaatcgcttgaacccgggagatggaggttgcagtgagctgagattgcaccagcctgagcgacagagtgagactccgtctcaattaaaaaaaaaaaatcatctaaactgctttgacttttctcaccaactttgggctcggagattatttctcttttgcttttcaacactactgggcatgtttagatctggatcctggcccccttcccaatggccctgtcctcctttatttaaatagacaaaattcagctccattttgaaagtaggattcttttcacaacaattgggaaaaatgattttttttgttttgttttttgtgagatggaattttgctctgtcgccaggctggagtgcagtggcacgatcttggctcactgcaacctctgcctcccgcattcaagtgattctcctgcctcagatggccaagtagctgggactacaggcgcgcactacatgcccaactaatttttttgtatttttagtagagacagggttttaccctgttggctgggatggtatcgatctcttgaccttgtgatctgcctgccttggcctcccaaaatgctgggattgcaggcgtgagccaccgcgcccagcctaatgttattgtttttacaaaatatttgaggagctgattgagaggaccttatgcagaaacttaataaacttaaaatcatataatgtgagattgaaatgcttagattattctgtaatatggaaatagcaggtctaatgtaacagacaactccagtaacagaggaaatgtctacctattctttttttttttttgagatggggtcttgctctgtcacccaggcagaagtacaatggctcgatctcggctcattgcaacctctgcctcccgggttcaagcgattctcctgcctcagcctcctgagtagctgggattacaggcatcgcgccaccacgcctggctagtttttgtatttttagtagagacggggtttcaccatggtggtcaggctggtctcgaactcctgaccttgtgatccacccgcctcggcctctcaaagtgctgggattacagacatgagccaccactccccttccatctacctgttcttaaaataaaaaaaacccataaaggtggagaggtaataataacaaaggcctcagatatctatataccaatggagtttgtgggtagtcagtaatgtattctaaccccagatggcatgtaacagcatatgttttttcttttgttttgtacacatattatatatgataatattaaaatagaaaaatactttgttcaatagttatgtaacttgtcgtttaaaaatccttgtacttcaacactgttatcttttatttgtgtttttttgtttgtttgttttgagacaggctctagctctgttgcctaggctggagcagagtggcatgatcttggcttactgcagcctcagtcttctgggctcacatgatcctcccacttcagcttcccaagtagctgggactacaggcgtgtgccacaatgcctggctaatttttgtatttttttttggtagagataagtttcactatgttgcccaggctggtctcgaattcctggcctcaggtgatctgcctgccttggcctcccaaagcgctgagattacaggcatgagcaaccgtgcccagccaacactgctagctttttaaaacagaaagtgagttttatttaggccggccgcggtggctgatgcttgtaattccagcattttgggagactgaggtgagtggatcacttgaggtcaggagttcaagaccagcctggccaacatggtgaaacaccatctctactaaaaattcaaaaattagctgggtatggtggcgtgtgcgtggtggcgtgtgcctgtaatcccagttactagggaggctgtggcaggagaattgcttgaacccagcaggcagaggttgcagttagcagagatcgtgccactgcactccagcctgggcaacagagcgagactctgtctcaagaaaagaaaaaaagaaagtgagttttatttagacaaagatgaaggtttggaaattaaccatatttgtgcttgcaaaaggggcacggatttttaagccctagtctcacaggctctctctgcagcatctgatactgttgcttgattattcctgctttaaactctgtcccttggattccaaggcatcaggtagctgctcttcttttttcttttctgttttttctttctccgacttcttagggatttcttctttcttaactattatgtttttgcaggattctgtcattgatccccttttctttctagctgataccctttcattctcatctactttcatgctatcagttataagctctgtgctgacaacccctaaaaacatgtttctaggccgggcgcagtggctcatgcctgtaatcccagcactttgggaggcagaggagggtggatcacctgagatcagaagtttgagaccagtctggccaacatggtgaaaccccgtctatactaaaaatacaaaacaattaaacagcatggtggtgggtgctgtaatcccagctacttgggaggctgaggcaggggaattgcttgaaccagggaggtggaggttgcagtgagccgagatcgtgccacagcactccagcctgggcaacagagtgagacaccatcttaaaaaacaacaacaagaacaaaaaaaacacatttctagcgcaaatgtatcgtttgagctagagacccacatccgtcatcaccctctataggcactttaagtatactgacttctctcccaaacttgaaccttctcttataggccaggcgcggtggctcacacctgtaattttaccactttgggagactgaggttggtggattgctggagctcaggagttggagaccagcctgggcaatgtagcaaaaccccttctctactgaaaatacaaaaattggctgggtgtggtgaagcacatctgtggacccggttactctggtggctgaggcacaagaacccttgagcctggaaggtgggggttgcagtgagccgagattgcgccactgcactccagcctgggcgacagagcaagactgtgcctcaaaaaaaaaaaaaaaaattcctttaaaggaattgtattaagttcttatcagtgttgtatttttcttcctagatctcatattttggattctggatatattataatgagtgacactttgacagcggatgtcattggtcgaagagttgaagttaatggagaacatgcaacagtacgttttgctggtgttgtccctcccgtggcaggtaagcaattattgtgtgtgtgtgtgtgtgtgtgtgtgtgtgtgtgtgtgtgtgtgtgtgtgtgtattttgcagctgtttctgtgtaagcttctcagtagcactttataccacaaattttgacgaaattaacaactaatttataggtgcctcctgtatccagttttatctgagtgacagtatcctgtggtatctatgattttgtttaattatatgccatttaattatttagtgttgctatcttatataaaatcaaccttaaaatatcttctgaggaaactataaacagctaaaagtcttgaaacctcataaacctcaactcaagtaatttttttgaaatttcttttgtcattaatccacgtgtgtaggtatctaatatagtttaaactgatacacattacaatttttgttaccttttttttaaacttattttttggtataaatttacctatgtttctacagcattattttgcaatatttcttctttttttgattttgcgtatttcttaattattacatttagtataatatatagtttgtttaattgttccccatttttggatgttaatttctagtttttagagtaaataataatgtagtagacttactcataagtcttagtcaacaaaaatttgactgttttctgtgtattttgagacagagtttcgctcttgttattcaggctggagtgtagtggtgcgatgttggctcaccgcaacctctgcctcctgggttcaagcgattctcctgcctcagtctctcgagtagctgggatttcaggcatgtgccaccacacccgactaattttgaatttttaggggagacagggtttctccatgttggtcaggctggtctcgaactcctgaggtgttctgcctgcctcggcctcccaaagtgctgggattacaggtgtgagccaccgtgcctggccaataaggaggctttctatgaactgggcaactgctggaaccaagctgatatgggtttactagctgattgcaatgtgcccagaattagaatatttatccatatttttacattacccatccctcttgtttcttctgagctgcagccagagatcaccagttggttcacaggaataagcagggttagcctaaattgaagaaacaaacttaaaaacaactaatgagactagaatctaatgacaaatgccccatagttcttgaaacataatttttctctctagtttccaagttttactaaagacaagtcatggtaagactgatttgcttgggccgggcacggtggctcacacctgtattcccagcactttgagaggccaaggcgggcggatcacaaggtcatgagattgagaccatcctggctaacacggtgaaaccccatctccagtaaaaatccaaaaaattagccggatgtggtggcgggcacctgtagttccagctactaagggagactgaggcaggagaatggcatgaacctgggaggtggaggttgcagtgagccgagaccacgccactgcaccccagcctgggcgacagagcgagactccttctccaaaaaaaaaaaaaaaaaaaaaaaaaaagactgatttgctttattgtaattggcctgattatttgtataaagtgcagcaagaataattatttttcttttttttctttttttaattttttaattgtatttttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtcctcagagtgtgatgttcaccttcctgtgtccatgtgttctcattgttcagttcccacctatgagtgagaacatgcagtgtttggttttttgtccttgtgatagtttactgagaatgatgatttccaatttcatccatgtccctataaaggacatgaactcatcattttttatggctgcatagtattccatggtgtatatgtgccacattttcttaatccagtctatcattgttggacatttgggttggttccaagtctttgctattgtgaatagtgtcacaataaacatacgtgtgcatgtgtctttatagcagcatgatttgtagtcctttgggtatatacccagtaatgggatggctgggtcaaatggtatttctagttctagatccccaaggaatcgccacactgacttccacaatggttgaactagttgacagtcccaccaacagtgtaaaagtgttcctatttctccacatcctctccagcacctgttgtttcctgactttttaatgattgccattctaactgatgtgagatggtatctcattgaggttttgatttgcatttctctgatggccagtgatggtgagcattttttcatgtgttttttggctgcataaatgtcttcttttgagaagtgtctgttcatgtccttcgcccactttttgatggggctgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtcctggcccatgcctatgtcctgaatggtattgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacatggcgatgcgggctcttttttggttctatatgaactttaaagtagttttttccaattctgtgaagaaagtcattggtagcttgatggggatggcattgaatctgtaaattaccttaggcagtatggccattttcacgatattaattcttcctacccatgagcatggaatgttcttccatttgtttgtatcctcttttatttcattgagcagtggtttgtagttctccttgaagaggtccttcatgtcccttgtaagttggattcctaggtattttattctctttgaagcaattgtgaatgggatttcactcatgatttggctctctgtttgtctgttattggtgtataagaatgcttgtgatttttgtacattgattttgtaacctgagactttgctgaagttgcttatcagcttaaggagattttgggctgagacagtggggttttctagatatacaatcatgtcatctgcaaatagggataatttgacttcctcttttcctaattgaataccctttgtttccttctcctgcctaattgccctggccagaacttccaacactatgttgaataggagtggtgagagagggcatccctgtcttgtgccagttttcaaagggaatgcttccagtttttgtccattcagtatgatattggctgtgggtttatcatagatagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtacctgttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttctttttattagtcttgctagcggtctatcaattttgttgatcctttcaaaaaaccagctcctggattcattagatttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgttgtcccagagattctggtatgttgtgtctttgttctcgttggtttcaaagaacatctttatttctgtcttcatttcattatgtacccagtagtcattcaggagcaggttgttcagtttccatgtagttgagcggttttgagtgagtttcttaatcctgaattctagtttgattgcactgtggtctgagagacagtttgttataatgtctgatcttttacatttgctgaggagagctttacttccaactatgtggtcaattttggaataggtgtggtgtggtgctgaaaaaaatgtatattctgttgatttggggtggagagttctgtagatgtctattacgtccgcttggtgcagagctgagttcaattcctggctatccttgttaactttctgtctcgttgatctgtctaatgttgacagtggggtgttaaagtctcccattatcattgtgtgggagtctaagtctctttgtaggtcactgaggacttgctttatgaatctgggtgctcctgtattgggtgcatatatatttaggatagttagctcttcttgttgaattgatccctttatcattatgtaatggccttctttgtgtcttttgatctttgttggtttaaagtctgttttatcagagactaggattgcaacccctgcctttttttgttttccatttgcttggtagatcttcctctatctttttattttgggcctgtgtgtgtctctgcctgtgagatgggtttcctgaatacagcacactgatgggtcttgactctttatccaatttgccagtctgtgtcttttaattggagcatttagtccatttacatttaaagttaatattgttatgtgtgaatttcatcctgtcattatgatgttagctgtttattttgctcgttagttgatgcagtttcttccagccttgatggtctttacaatttggcatgattttgcagtggctggtaccagttgttcctttccatgtttagtgcttccttcaggagctcttttagggcaggcctggtggtgacaaaatctctcagtatttgcttgtctgtaaagtattttatttctccttcacttatgaagcttagtttggctggatatgaaattctgggttgaaaattcttttctttaagaatgttgaatattggctcccactctcttctggcttgtagagtttctgccaagagatccgctgttagtctgatgggcttccctttgtctctggctgcccttaacattttttccttcatttcaactttggtgaatctgacaattatgtgtcttggagttgctcttctcgaggagtatctttgtggcattctctgtattttctgaatctgattgttggcttgccttgctagattggggaagttctcctggataatatcctgcagagtgttttccaacttggttccattctccccgtcactttcaggtacaccaatcagacgtagatttggttttttcacatagtcccatatttcttggaggctttgttcatttctttttattcttttttctctaaacttcccttctcgcttcatttcattcatttcatcttccatcactgataccctttcttccagttgattgcatcagctcctgaggcttctgcattcttcacgtagttcttgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaatttgtcaaagtcattctctgtccagctttgttccgttgctggtgaggagctgtgttcctttggaggaggagaggcgctctgctttttagagtttccagtttttctgctctgttttttccccatctttgtggttttatctacttttggtctttgatgatggtgatgtacagatgggtttttggtgtggatgtccttcctgtttgttagttttccttctaacagacaggaccctcagctgcaggtctgttggagtttgctagaggtccactccagaccgtttgcctgggtatcagcagcagtggctgcagaacagcggattttcgtgaaccgcgaatgctgctgtctgatcgttcctctggaagttttgtctcagaggagtacccggccgtgtgaggtgtcagtctgcccctgctgggggtgcctcccagttaggctgctcaggggtcaggggtcagggacccacttgaggaggcagtctgcctgttctcagatctccagctgcatgctgggagaaccactgctctcttcaaagctgtcagacggggacatttaagtctgcagaggttactgctgcctttttgtttgtctgtgccctgcccccagaggtggagcctacagaggcaggcaggcctccttgagatgtggtgggctccacccagttcgagcttcccggctgctttgtttacctaagcaagcctgggcaatggtgggcacccctcccccagccgcgctgctgccttgcagtttgatctcagactgctgtgctagcaatcagtgagactccgtaggtgtaggaccctccgagccaggtgcgggatataatctcctggtgtgccgttttttaagctcatcagaaaagtgcagtattagggtgggagtgacccgattttccaggtgccatctgtcacccctttctttgactagcaaagggaactccctgaccccttgcgcttcccaaatgagggaaagatgttacaggaaatggtctcaatccagaccccaaaagagggttcttggatctcgtgcaagaaagaattcagggccagtctgtaaagtgaaaacaagtttattaggaaagtaaaggaataaaagaatggctactccatagacagagcagcccctccaggggattctgatgcacaataaggtttggtgaaagccattgaacaagatacatgtggactctgccttcatggaggctgtggaagtctttaacatatacctaatctgtcaagggtttttactttcctggtattatttgtaaatgggaagagaaagtaatgtttaatgaataattactgtgtaccagacacttgaaagcatgctctcaactttgaatattccaataacaaccttaaaatatagatgttactattcctatgtttatagacaagaagaccaagtctcaggtcttaaaacttttatatagcagagctgggatttgaatctatccttcattgcccatgccctttcttctctgttacttcttttttttttttttttttttttgagatggagtctcacttttgttgcccaggctggagtgcaatggcatgatcttggctcactgcaacctccgcctcccaggttcaagtgattctcctgcctcagcctcccgagtagctgggattacggggacccaccaccacacccagctaatttttgtatttttagtagaggcagggtttcaccatgttggccaggctggtctcgaactcctgaccttaggtgatctgcctgcccaagcctcccaaagtgctgggattacgggcatgagccactgcacctggctctactctgttacttctaaggaatgtgaatattctcaggttcttgacatatgttgccaaattgttgtctgcaagtcagtcaatgtccggtacttggaaatttccaatattcacattctctgggaagcagacttagctagagatttacacttagaaagtttagtgttcagaaagttttttagggagtactttgggaccagtactcatggaagaggaaagagagtaagcaaggttgggcagagggctaagctgggctatggtacagcctcaacaaatatttcagctgtctcctttgggtgctctgaagatagagtggcctttcagagtctttcctagtggagatgaggggctgggtcattatacattagtgatgatctgtcactaggttctgttgaccctaggaagggggtgtgcccttgggcaagatgctttctacagtagacagttccataagagggcagacagttgagggctatttaccaaaagccagtcctcccagctattgggagataagtcccaattcttgaagacagggtggcatatcactagtacagtaatatagataaaagttttttaatgatagtttagcaaacgtgaagtttttaatttatttaaattttatttattaaattgcctgtgaatgtgacactttcttcatgcatgttttatcaggtaagtgcttctttctcccttgaaaattgtaattctgcagagagggagctactgtaaatttaagctttttgtttgtttgtttgtttgaggttgagtttcgttcttgttgcctaggctggagtgcaatggcacaatctcggctcattgtaacctctgcctcctgggttcaagtgattctcctgcctcagcctcccgagtagctgggactacaggcacctgccaccacacacagctaatttttgcatggtttttttggtagaaacggggtttcaccatgttggccaggctggtctcaaacacctgacctcataatctgcccatctctacctcccaaagtgctgggattacaggtgtgagccaccacgcctggcctgcatttagtttagaggtcatcttttggaattggtactaagatgcacagaaattgaacacagatttagtaataatttctgcggttacttcactggatgttgtagagctgttatgacaactaaatcagttagatgtttaaagcacttagaccagttaatcgtgcatattgttgtaaataaacattttaaaacttactttaaaaagaaatgcagactgggcgtggtggctcatgcctgtaatcccagcacttcaggaagccaaggctgtagatcacttgaagtcaggagtttgagaccagcctgaccaacatgttgaaaccctgtctctactaaaaatacaaaaaaaattagctgggttttgtggtgcgctcctgtagccccagctacttgggaggctgagacagcagaatcgcttgaacacgggaggaagaggttgcagtgagacgaaatggcatcactccattccagcctgggtgacagagtaagactgtctcaaaaaaaaaaagaaaaagaaaaagaaatgcaattgtactaatgttctgcaaatggcttcttgtaattggagatattatttcctgtgatagcatcatacaaagatttaaaaagtattacatcttaaactgttcagatggaataaagatgatatactgtggtgggcaggataatagcctcccaaagatgtccccagaacctctgattttgctaggttacatggcaaaggggaattagaattatagatggaattaaggttgctaatcagctgattttaagattgggagagtatccggtttatccagttgggctcagtgtaatcacaagaatcattagaagtagaagctaggctagacgcagtggctcacacctgtagtcccagcactttgggaggccaagtcggatggatcacctgaggtcaggagttcaagaccagcctgaccaacatggtgaaaccctgtctctactaaaaatacaaaaaatacaaaaattagtcagatgtggtggtgcatgccaataatccgagctacttgggaggctgaggcaggagaatcgcttgaacctgggagacggaggttgcagtgagctgagatcgtgccattgcactccagcctgggtgacaagagcgaaacgtctcaaaaaaaaaaaaaaaaaaaagtagaagctagaggcagaagaggcagtgtcagtgtgacgtgagaatgtttcagctggccattgtttattctgaagatggaagagggtcatgagctaaggagtgtgcagcctctaagcctctagaagctggaaaaactttcctcatatgataaggaagctatcatgtaaaggttcatcttacatttcttgctgttttctttctttcttttgctggcaaatatcattcaggggccacagtatgggctgcagcggtgttcattgctactgggttggtcttcgtttctgggcctttttaaaggacagagctgcctctgttggattaattcctacaagtagaatagatttaaggaagatatgagtagtttttatattattattagaaaatacaaaaaagaaaaggtttcaaaaatatagaaagtagagagaataagccaggcgtggtggctcacgcctgtaatcccaacactttgggaggcaggtggatcacttggtcaagagttcgagaccagcctgggcaacatggcgaaaccctgtctctactaacagtacaaaaaaaattagctgggtgtggtagtgggtgcctgtaatcccagctacttgtgaggctgaggcaagataattgcttaaacctgggacgtggaggttgcagtgagccgagattgcaccactgcaccccagcctgggccacaaagactccatctcaaaaaaaaaaaagcgtagacaaagaaagtagagagaatagtataatggacacctgtatatgcttgtcatgtcagtttaacaattgttaacatgttaccataccatatttgcttcatttccttttttttttttttttttttttttgagatggagtcttactctgtcacccaggctggagtgcagtggtacgatctctgctcactgcaaccactgcttcccaggttcaagcggttctcctccctcagcctcccaagtagctgggattacagacttgcaccactatgcccagctaatttttatatttttagtagagatggggttttcccgtgttggccaggctggtcttgaacacctgacctgaggtgatcaacccacctcaccctctcaaagcgctgggattacagatgtgagccactgcactcggcccatctcttattttttgcttaagcattttaaattatatacggagtagcatttcattcctaaatactttacattgtaattctaaaaaaaaaatacgttttcttacaaaactgtacagtttaaattgtgattcataggttgggtatggtggctcatgcctgtaattgcagcactttgggaggctgaagagggaggattgcttgagctcaggagtttgagaccagcctaggtaacgtaacaagatccctgtctctagcaaaaataaataaataaataaataagtacataaataaaaaataaaatcagccaggcatggtggcatgtgcctgtagccccagctacttgggaagctgaaatgggaggattgcttgagcccaggaagttgagcctgcagtgaaccgtgatcgtgccactgcactccaggctgggtgacagagcaagtctctgtttcagaaaaaagaaagttgtgattcatattgtcaaattgctgaacagaattttttttttttttttttttttttttttagacagagtctcgctcttgttgcccaggctggagtgcagtggtgggatcttggctcactgcaacctccgcctcctggattcaagcaattctcctgccttagcctgccgagtagctaggattacaggcacccccctccatgcccagctaatttttgtattattggtagagatggggtttcactgtgttggccaggctgatctcgaactgctgacctcaggtgatccgcccacctcagcctcccaaagtgctgggattacatgcctgagccaccacgcctggcccagaattgttttaaatcagtaaatccagattattgaaaaacttgattctatttcacatcttggtttaattctttagtccaaagtggtgtccattctttaagattttaagatggggtagtcacatgctcttttaatctgctgtcttttaacaaaattatttgccaggcatggtgactcaggcctgtagtcccagctactgggaggctgaggtgggaggattgcttgagcccataagttcatggctgcaatgagctataatccagcctgggcaacagagtgagatgctgtctctaaaaaaattaataaaaaaaaattctgctttagcttttttcttgattaattttagacatgagtttcttagcttcccatatagagaaaaatctaatttttatcccaccatttcctgtggttacactttgtttttcaccaaaatgaaatgtttgtttataaagacttctgtagcatttatttacctactattggcttttcacattatttatatactgagttataatgctagagatattttaaaaaatagtatttaatggtcgggcgtggtggctcacgcctgtaatcccagcactttgggaggccgaggtgggtggatcacaaggtcaggagatcgagaccttcctggctaacacggtgaaaccctgtctctactaaaaatacaaacaattagcctggtgtggtggcacgtgcctgtaatcccagctacttgggaggctgaggcaggagaatcgcttgaacccaggaggtggaggttgcggtgagccgagatggcgccactgcactccagcctgggtgacagagtgagactgtctaaaaaaaatagtatttattgattatatcttattattgttgttttattgctgttcttgttccagagttttaaatgtttttttttcatttactgtattgaaatatattgaaataataatacctggagaatagagttgacacaggtagtctggtagcaaatctcttcataaagtatgtacagcagtgatgttcttttagcagttgtatacacctttcagaagaatcatgcttttatcctcctacagagcaaatagatatatatgtattttaatatggtaatgacatgatatgttttcatgttctgggagtggatgaaggaaacagctaagcttactgactgttgcctaggggaacatctaaagattgtatcaaaccaaagttcctgcctttgacagacacaccgtggtatttaggtgaaaattgtagtgtaattaagtaggtaattaagttatttatttcatttagtgatttcagggtgcatattgtagtttacttattactaggatgcagccctacttaaaatttgtaacaaattttattttatttttatttatttttttgagacggagtctcgctctgtcgctcaggctggagtgcagtggtgcaatctcagctcattgcaagctctgcccgctgggttcacgccattctcctgcctcagcctcccgagtagctggaaatacaggcgcccaccactacgcccagctacttttttgtatatttagtagagacggggtttcaccgtgttagccaggatagtctcgatctcctgacctcgtgatccacctgcctcggcctcccaaaatgctgggattacaggcgtgagccaccatgcctggcctgtaatgaattttattatagacatttgataatttttgataatttctttttttttttttttttttttttttgagacaggttgtcactctgttgcccaggctggagttcagtagtgctatcatagctcactgtaactatagcttctgcacctgggctgaagtgattctctcaccttagcctcccaagttgctgggactacagatgtgcaccaccatgcccagctaattttttgtattttttagagagcgggttttgccaggctggtgtttagcacctgggctcaagcaatctgcctgcctaggcctcccaaagtgctgggattacaggtgtgaaccaccacacctagcccttattttttgagacagagtcttgctctgtagcccagggtggagtgcagtggcatgatcatagctcactgaagcctcaacctctggggcccaagtgatcgtcccacctcagtctcctgagtagttgggattacaggcactagccaccataccttgctaattttttgttgagacaaggtcttcctatggcgcccagactggacttgaactcctgggctcaagcgatcctcctgccttggcctccgaaagtgctgggatcacaggcatgagccacagttccaggccagcttatatatttgtaatgctgattactattccattgtctggatgtaccacggtttattcttcacctactaaaggatattttgttttctggtttggggaattatgagtaaagttgctttaaacatttgtgtgcaggtttttgtgtggacataaattttcaacttatttgggtaaataccaaggaggatgatttctggattgttggattaattcttttaatttttgtgggtacatagtaggtgtatatatttatagggtacaagagagattttgatacaggcatataatacataataatcacatctaggtaaatgaggtatccatcaccatttattctctgtttgttacaaacagcccaattatacccttttagttatataaagatgcacaataaattattgttgatggtagtcaccctgtcatgctatcaaacactagatcttatttatgctatctgtatttttgtgcccattaaccattcccactctctccccctgcccagccccccagcctttagtaaccatcattctacttcttcttcttcttttttttttttttaaggtggagtctcgctctgtcgcccaggctggagtgcagtggtgccatcttggcccacagcaacctccgcctcctgggttcaagcaattcttctgcctcagcctcccaagtagctgggattacaggtgtgcaccaccacacctggctaaattttgtatttttaatggagacggggatttgccatgttggccaggctgctctcgaactcctgacctcaggtgatccacctgccttagcctcccaaagtgctgagattacagacatgagccaccgtgcccagccccgttctacttgctatctccatgagttcaattattttcatttttttagctcctgcaagtaagtgagaacatgtgaggtttgtctttctgtgcttgacttatttcatttaacataatgacctccagttccacccatgttgttgcaaatgacaggatctcattattttttaaggctggatagtattttattgtgtatgtgtttattttctttttctttttctttttttttcttttgagacagagtctcgctttgccgcccaggctggagtgcagtggagcgatctcggctcactgcaagctccgcctcctgggttcacgccattctcctgcctcagcctccgagtagctgggactacgggtgcccaccaccacgcccggctaattttttgtatttttagtagagatgggatttcaccatgttagccaggatggtctcgatctcctgacctcatgatctgcccgcctctgcctcccaaagtgctgggattacaggcgtgagccaccgtgcccggcccttatgtgtttattttctttatccattcatctgttgatggacacttaggttgattccaaaccttggctattttgaatagtgctgcagtaaacataggagtgcagatgtctcttctatatactggttttctttctttttggtatataactagcagtgggattgctggaacatatggcagttctatttttagttttttgaggaatctccaaactgttctccatagtggttgtactaatttacattcccactaacagtgtgtgagggttcccttttctctagcatttattatatcctctcttttggataaaagtccttttaactggagtgatgtgatatctcattgtagttttgatttgcatttctctgatgatcagtgatgttgagcaccttttcatgtacctgcttgccatttgtatgccttcctttgagaaatgtctattcagatcttttgcccatttcttaatcggattaatagatgtttttcccattgaattgtttgagctccttattatattctggttattaatcccttattagatgagtagtttgtaaatattttctcccattctgtgagttgtctcttcactttgttgattgtttatttatttatttatttatttatttatttttcttttgagacaagagtctcgctctgtctccaagctggagtgcagtagcgccatcttggctcactgcaacctccaccgccctggctcaagcgattcttttgccttagccttccgagtagctgggactacaggggtgcgccaccacgcccagctaatttttgtatttttagtagagacggggtttcaccacgttggccaggatggtctcaatctctttttttttttttttttttgagacggagtcttgctctgtcgcccaggctggagtgcagtggcgcgatctgggctcactgcaagctccgcctcctgggttcacgccattctcctgcttcagcctcccgagcagctgggactacgggcgcccgccaggatgcgcggctaattttttgtattttttagtagagacagggtttcaccgtggtgctagccaggatggtctcgatctcctgacctcgtgaccttgtgatccacccgctttggcctcccaaagtgctgggattacaggcgtaagccaccgcgtccggcactttgttgattgtttctttcgctatgcagaacttttgtgatggattaattatttttaattcttgtgatgtcagtgaagttgggcctgattatgattggcttttcatgtggcttgagtccatggagaataggaaacaaattaggttgaccagagtaatcaggtttgtgtgacagctttattaatcattgtgaattaataaacctgtgtgctagtgtctggttcagtcttctgtgcatttggaattttcaaattgaggctatcagggtttgttcgccctggatgtagaaagcaaaaatctggatcttacacattcctgggatctgactggtgaggtatacccttataccatgtctgtccactctcttactcatactggtttctgtagttgctcctctatcattaatgtactggccccaggggaaaagcttgctaaaccatagatattcttcgtcagacttacagctaatcacagttgaatgctggccttgctccttctgtctgctttggcttgaaaaatgacttgtgctttgcagtgtgagagaatggccttattttgtgcattcttctttgtagcatccatcaattcaacccattctgatagtttctatgatgataacatttacttctttctttttttttttttttcttttgagatggagttttgttcttgtcgcccaggttggagtacaatggtgcgatcttggctcactgcaacctacacctcctgggttccagcaattctcccaactcagcctcccaactagctgggattacaggcacccgccaccacgcccggctaatttttctatttttagtagagatggggttttgccatgttggtcaggctggtctcaaattcctgacctcaggtgatccacctgacttggcctccataagtgctgggaccataggtgtgagccaccgtgcccgggtattggaaaatgttttcttttaatgagagcatttataccatttatgttttacttaattattgataatttgggtttatatctctcatcttactacttgctttttgtttgttttgctgacattctgttcctttttttctcccttcattggatgacgatgatgattatttgtggtgttttcttttttttttttttgagacaaggtcttactccattgctcaggctggagtgcagtagcactatctgcaaattctgcctcctgggttgaagcagtcctcccacctcagccttccgagtagctgggactacagctactgtagtcccagctactcggaaggctaaggcaaaagaatcgcttgagccgggcttatttttgtagtttttgtagagatgtggtttcactatgttacctaggctgatctcaaattccagagctcaagcaatcagccagtcttggcctcccaaagtgctgggatcatgggcgtgagctcccgtgcccagccactatttcttttctttttttcttttttgagacagagtctccctctgtcactcaggctggagtgcagtggctcaaccttggctcactgcaacctccatacctcaggctcaagcgatcctcccacctcagccttctgggtagctgggatcacaggcatgcaccaccatgcccaactatttttttgtatttttagtagagacggggttttgccatgttgcctaggctggtctcgaactcctgagctcaagcaatccacccgccttcacctcccaaagtgctgggattacaggcgtgagccaccaagcctagagatgattatttttaccttgtgtttcttctccattagtttggagttgtggtggtatgatatatattggtttttgttcatggttcctggttctcaactcccatacctcttgttacagtcttttgttataatattggtgtgtcaggcctcaggaaacaggatctctctcctgccctccattctcctgccccaaggcagaactctaatcttcttccaccattctgactgtgggtcataagaccctcccggagaggctcccacccctctacactagaggcaggaatgctaatgtctttgaacttctagatagctgaatctgtgaaggttcttgcatccatggagggcttggaagctccacagcccttcccctgtacctcgccttagcacacctcttcatctagattctttgcaatattttttataataaacctgtaaatgtaagtaagtgttttcctgagttctgtgagccgctccagcaaattaatcaaatacaaagagggggctgttggaaccccagctgtttgaagctggtcggtcagaagttccagacgcccaggctagtggctggtggtctgacactatgtccagtcagatagtgtcagaattgaattggcggacacccagatggcatcccctgcttggtgtgtggggaaaacccccacacattcggtcacagaagtcatctgtgctgatcgttgtagtgtgaggaatagtgtagcagaggaaagacatggtttggagagttttaacttatgcagtagttattcattttttatttttccttacacagcagttaattttttattatttagaggtaagtctagagattaaaatatgcatctctggtttacagaaatctagtctaataattatacctccttttggacccatgaaagaccttagaacatgccatttatcaccttcctaactcatatgtgtgacattttaaccgatgtttattttaaacccgaagaactgatattattactttacattgtctgtattactttaacttcacccatatatttacccttttcttgccttttatctccccactccttgtatctttaggcttctatctggtataattttctttttccttgaagactacctttattgggtttttgctgaaattgaaggaaaaaattatttttcctcttttttttttgagatggagtctcgccctgtcgcctaggctggggtgcagtggcgtgatctcggctcactgcaacctccgccttccgggttcacgccgttctcctgtctcagcctccggagtagctggggctataggcgctcgccaccgtgcctggctaattttttgtatttttagtagagacggcgtttcactgtgttagccaggatggtctcgaactcctgacctcgtgatccgcctgcctctgcctctcaaagtgctggggttacaggcgtgagccactgtgcccagccttttttttttttgagacggaattttgctcttgttgcccaggctggagtgcagtggcatgatctcggctcactgcaacctccgcctcccgggttcaagtgattctcctgcctcagcctcccgagtagctgggattactgtcatgtgtcaccacacctggctaattttgtatttttagtagagatggggtttcttcacgttggtcaggccagtctcgaccagtctcgaattcctgacctcaggtgatccgcccactttggccttgcaaagtgctgggactacaggcgtaagccactgtgcctgggctttttttttttttttaatttttattgtagccacatacataacataaagtttgccattttaaccacttttcaatttaacattttaaattgtggtgaaatatacgtaacataaaatttaccatctgaaccagttttgaatgtacagtttagtagtaactaccctaagtatctcatataagtggaatatggtatttgtccttttatggtggcttatttctcttagtgtaatgtcctcaagggtcagttttgtttagtgtgctcaataaattttagccattcttgttttctggagtggtggtttttgttggctttttcacccagacatgctatggcatttgctgattgaagtcctgagtataaggctaacttgtccattccctcctccccaagtggtatctgtgtgatatggtttccgctgcaaattggtatttgcttgcagaaaactggagcattgcctgtatcatcatctgttactcatttggtttttcttgttctgctaggaccctggttaggagtagaatgggacaatcccgagagaggaaagcatgatgggagccacgaagggactgtgtattttaaatgcaggtaacttttcattatgaatcagcacggtcatttagtcaagattatatttaatacttgaataaggagggatggagaggaagaaatgtttggctcatggagtagttatattatggaatttgttgtattccaaaaaggcagttattttatttgtggcttaattgctgctgtttgtagcatttttcccttttttaaaaaaattctgactcttgaccttatgcatggcgttgctttcttcgtcctttttttttttttttttttttttaacagtcctttaaattggatgaatgtaaacctttctggctcattaccaatttacaatccagtaagtaaataatagaaaagagaaacagcctagatttccagtaagaaggaattgattacacaaaatacagaacatctgaatagtggaatgttgagccaccattaaataaatttcttatcataggaagagttacatgtcacattgcatttctttgtctttttttttttttttttgagacggagtctcactctgtcgcccagctggagtgcagtggcacaatctcagctcactgcaacctccacctcctaggttcaagcaattctcctgcctcagcctcctgagtagctgggattacaggtgcccacgaccacgcctggctaatttctgtacttttagtggagacgaggtttcaccatattggccaggctggtcccgaactcctgaccttgtgatccgcccgcctcagcctcccaaaatgctgggattacaggtgtgagccaccacgcccggcctgtcacattgcatttctattattatttttgatcgcctgatgtcagaaaaactgcatgaagccctgaaaagggtgctggggagccttcaggcagagcctgtcttctaaatttttgttgttgttgttgatttttattagttttcaatttctgaaaacgatctttccctagtaagctgtttttccttaagtatggtacagtgaacacaatactgccctggaaatcagggggcctctagcctgtttttaacagtcttttttgtttgtttggttggtttatttgtttattttttgagacattgtctcgcctagactggaatgcagtggcatgatcatgactcactgtcaccctgaactcctgggctcaagtgatcttcgcgcctcagtctcctgagtagctgggactacaggcgtgcaccagcacacccagctaatttaaaaaaataaaaataaaaaagagatgaagtttttctatgctgcccaggctggtctcaaactcctggcctcaagcgatcctcccacctcggcttctcaaagtgctgggattacagatgtgagccactgcaccagccccacttttaacagtctttatggtcctgaacaagacaagtttactaacctttaaaatgaaggtcagaattaggtaaccacacagcatatctcctggtccactatttcataattttagaaagtcagggtgttcttaaaaggccaactctacttgtagacttgccatctctgaatttgttcagagctgttcaggttatatggttagggagaaatattttagccaggcccacagattccttaggtacctggaccatgaccttacaaaccctccagtgaaaggacttttttcttttttttgagatgtagtctcactctgtggccaaggctggagtgcagtggcgtgatcttggctcactgcaacctccacctccctggttcaagcaattcccctgcctcagcctcctgagtagctgggatcacaggcgaacgctaccacgtctggccaatttttttgtatttttagtagagacggggatttcaccaggttggccagactgttctcgaactcctgacctcaggcagtccactggcctcggcctcccaaagtgctgggattacaggtgtgagccaccaccccctgtgaaaggactttttatttggaacttaccccagcctacttccttcttgtaaaagcttgcccaaattgtccatacttttatggtctttaatggtctctggatacagtgatattttcaaagtcttggttgctctgagcagaaaaatcaagaattgcttcaagtcctgggtgatgcagggtttgtcctgaaatgctaatgggaagccttggttcagggacattgagtcagtatagtcatgcattgcttaatgaaggggatgtgttctgagaaatgcctgttaggtggtttcatcattgtgtgaacatcatagtatacttaacaaacctgcgtggtgtagcctactgcacacctaggctactgtatggcatagcctattgcttttaggctataaacctgtacagcatgttactgtgctgaatactgtaggcaattgtaacacaatggtaagtatttatctaaacatagaaaaggtacagtaaaaataaaaaattggccgggtgcgttggctcacgcctgtaatcccagcactttgggaggccaaggcaggcggatcacgaggtcaggagttcaagaccagcctggacaatatgatgaaaccctatctctactaaaaatataaaaattagccaggcgtggtggcgggcgcctgtagtcccagctactcaggaggctgaggcaggagaattgcttgaacctgggaggtggaggttgcagtgagctgaggtcgtgccactgcactccagcctgcgtgacagagcaagactccggctcaagaaaaaaaaaaaattaagcagtgtggggtggtacgggtggtatgtgcctgttagtaccagctacttgggtggctgagtcattaggattgtttaagcccaggagtttcaagaccagcctaggcaacacaatgagatctcatcataaaaaaaaaaaagatagaaaatggtatgcctgcatagggcacttagcgtgaatggaccttgtaggactggaagttgctctgggtaagtgagtgagtggtgagtgaatgtgaaggctgggacattcttgtaccctactgtagactttggaaacactgtagccttaggctacactaaacttagaagttttttctttctttaataataaattaactttagcttcctgtaacttttttatgttataaactttaaattttttttttttttgggatggattcttgctctgtcacccaggctggtgtgcagtggcatgatctcagctcactgcactgcctgggttccaacgattctcttgccttagcctcctgagtagctgagattacaggcatgcgccaccacacctgggtaatttttgtatttttagtagagatgggatttcaccatgttggccaggctggtgtcgaacccctgacctcgtgatcaaccctcctcagcctcccaaagtgctgggattataggcgtgagccaccatgcccggtactttttttttttttttttttggagacagagtcttgctccgtcacccacgctggagtgcagtggcacaacctcggctcactgcaacctctgcctcccaggttcaagtgattctcctgcctcagtcttccgagtagctgggactacaggcgcatgtcaccatgcccagctaatttttgtatttttagtggagacggggtttcgccatgttggccattctggtctcgacctcctgatctcaggtgatctgcctgccttggcttcccaaattgctgagattataggcatgagccactgcactggacctgagccttcttccagaatacctcctgaaggacctgcctgagggtagtttacaattaactttttttttttttttttttaataagtaggagtttgctgggcacagcagctcatgcctgtaatcccagcactttgggaggctgaggcaggaggatcacctgaagtcaagagttcgggaccaccctggccaacatggttaaaccccgtctctactaaaaacagaaaaattagctgggcatggtggcatgcacctgtaatcctagctactgggaaggttgaggcatgagaatcacttgaacctgggaggtggaggttgcagtgagccaagatcacaccattgcactccagcttggtcagcagagtgaaactgtgtctcaaaaaaaaaagaaaaaatagaaggagtacactctaacataatgataaaaagtatagtatagtgaacacttaaactagtaacatagccatttattatcattatcaaatattatgtactatacataattgtatgtgctatacttttatgtgactggcagtgtagtaggcttgtttacaccagcatcaccacaaacacgagtattatgttgtactacagcattaagacagctacagcttcactaggagataggattttttcagctccagtgtgattatgggaccactgtagcatatgcggtccattgttgatctacacgtcattatgtggtgcatgactgtatttggattcttagccttggaataactgcttacttcattatatcgtctagtgttgtgttgtcatgcctaaacatttacataattgaagtacatattatcttattataaataactttttaaaatttaaataggcactttgttgacattaaaaaattatatgagtaggtaatgttatctgtgaattccatttcaggatatttatggggcaatacaaaagagatcattgggtctgaagtggtggagaaccactggtctggactacaggaatttaactggtcctttagagtttgatgatttcatgtcatgttttagtttctctgatctcttttgtaacctaaggtaaatatagtaatctcctgagctattattacccataattaatatttgtaacattagcaattaatagtggtttacagtgtcaaaataaaaataaaatgtgcagatgaatgtctaagtgtaacattttatttgggaagcaagaattgcagttcagggcatccgcacagactagatcgtctttggtatatccaaagaacaaagaacaaagagaaacgtggattttttcttttagtttttgagacggagtctcactcagtcgcccaggctggagtgcagttgcaccatctcggctcactgcaacctccgcctcccgggtccaagcgattctcctgcctcagcctcctgagtagctgggactacaggcgcctgccactacacctggctaatttttgtatttttagtagagatggggtttcaccatattggccagactggtctcgaactcctgaacttttgatctgcccacctcggcctcccaaagtgctgggattacaggcataagccactgctcctgggcttttttttttttttttttttttgagacggagtttcgctcttgttgcccaggctggagtgcaatggcgtgatctcgcctcactgcaccctccttctcccaggttcaagggattctcctgtctcagccttttgagtagctggtattataggaaagtgccaccacgcctggctaattttgtatttttagacaggatttctccatgttggtcaggctggtctcgaactcccgacctcaggtgttctgcctgccttggcctcccaaagtgctgggattataggcgtgaaccactgcacctggcccccgccttttttttttttttttggacgcagggtcttgctctgtcacccaggtagtagtacagtggcacaatcatggctcgttgcagcctcaacctcctatgctcaagcagttctcccacctcattttttgatttttttgtagagatggagactccctattttgccctggctggtctcaaactcctgggcttgagtgatcctcttacctcggcctcccaaagtgctgggattacaggtgttacccgccgtgtcctgtctagtacattttataaaaaggagaaatgttacatattgttctgaaagaaagttcattggcactagtcaagttttggagagctggctagcaagctctgattggtgagtgacagtggtgggtaagattagtcttagagtcacggcagattgttttagtagctattaaataaaactggcttcaggttacaacaggcagtctcagcagctgggcttgtaataaactgaattcttggagcaggtgttgtgtgccccgagcactttttccccttggtcccttgactctgatttagttgggtatgacaagaatgacccagtttctgtaatcaactttcccaagatttatccaagatttatggccgtgcgccagtcacccgtgtccttcctaggtactcctgctctctacttcttgttgaaggggtagttgaggggttcaaatatggtaagtaaccttgaagtcctctttaccttgtccgtagacagcagagtggttttcagttttttttttctttcaacctaaaccccagagtatgctctgaacagagctgtgtgtgtcagtattctgcccactcaccttttatttcagtgcttctgtttccaagcaatggtagaagttctcttttctggtgagaaataaatcttaaaatctgacttttcttcaacactagggagcagaatctaactttaatacttagcatcagagaggtcgtgctgttccagcctgtgtctgtggtaatggacatcttaggaaatggatggttgacaatttaagaaacaaagccctagcaataaaggataagtgtttgaaagaaaggataaatgtttgaagtgatagataccccattcaccctgatgtgattgttacacgtgtgcctgtatcaaaatattgtatgtacccacaaaaattaaaaattaaactaaaaaaagaaagcccttgatttattcatcttttgtgtgtcataagccagttgtaaagtgttttgaggatcttggctgagcattaatggattggtataaaatattctcttggtgtggtgtaaagtgttggaagatttttttttttttttaatcaggaaatgtaatgatagtatgtgggcaaggcgcatctctgttcaaaaaggtggtagctctgcttcatttttggaaggttttcttgaatcagagcaaaatcataattgtgtcaacgcaaaagcagttgagatgaatattaaattcagctgattagagaagcaaacaaaaagagcagtctacagcaaggtgcttatctactgtactgctttactcacaggaaaacaacctctctgggtcagctctttagatgttacagcgctgaacactgcacgaaagctgagttctcctctcctgatgaacagctagttatgcaaccttgctgaacactaaacattcctgaaacaaacagggtatcaagatcaacagtatttattagaaactccccagagacctggccttttccagtagcttgtatccaaagctccaacaagaaagaagcttactgtggaagtctgggagtctgttggggaccctttacctttgtgtagtgttgccagattcagcaaacaaaaataccaaatgcatagtgaactttggatttcagataaacagccaatcttttttttttttttttttagtataagtatgagacatgcatgggggcatacttacttaaaaatgatttgctgtttatctgaaatacaagcttaactgagcatcttcgattctatgtggcagtcctgatggggacataggacagaatgaatcttgataactgggttttatgagcacatgctgtttccacaagggccatgggtcaggatgatgattttaccagcagcatgtgtaattggtaggcagaaggaggaaggaacctgaacaggccaaatgcttccaagagaaacgtttttggacacccctccctgtattctcctcctcaccaacatttttctctttagacatggtttggaatttcagtgtttggatacagtttcttaatatattaatgtagaatctcagtggagtctatgtaaattattacagtttacctcttggagatttgttgttattgatgggcacccattcagctagggtttttcactatttgttgaggctgttttgttttctgagaaacctgctggaaatgttccagaaaatattgatctttagtgttagtctttgatctgtaaagggcatagcatccgttttgcaactacctaacaacattcctaactctcctttcatctgcctgcaactaaactcaacagtaataaagatctgttcatgacttcttgtttttttaccatggttttaaaacttgtttattaccactgttttaaaaagtgtagatttagggcctggcgccgtggctcatgcctgtaatcccagcactttgggaagccgaggtgggcggatcacttgaggtcaggagttcgagaccatcctatctaacacagtgaaaccccgtctctactaaaaatacaaaaaattagccaggcgtggtggcgggtgcttgtagttccagctacttgggaggctgaggcaggagaatggcgtgaacccgggagttggagattgcagtgaaccgagatcgtgccactgcactccagcctgcgtgacagagtgagactctgtctcaaacaaaaacaaaaacaaaaaaaacagaaacaaaaattagccgggcgtggtgttgcacgcctgtaatcccagctactcaggaggctgaggcaggagaattgcttcaacccgggaggctgaggcaggagaattgcttcaaccagggaggctgaggttgcagtgagccaagatcaccccactgcactccagcctgggcaacagagggagactctatctccaaaaaaaattataataaaggaataacgaatggctactccataggcagaacagtcccgaggactgctgggtgcccatttttatggttatttcttgagtatatgctaaacaaggggtggattattcatgcctccccttttaagaccatgtagggtaatttcctgacgttgccatggcatttgtaaactgtcatggtgctggtgggagtgtagcagtgaggatgaccagaggtcactctcatctccatcttggttttggtgggttttagccagcttctttactgcatgctgtttcatcagcaaggtctttaatgacctgtatcttgtaccgacctcctagttcatcctgagacttagaatgcctaacagtctggaatgcagcctggtaggtctcagccttattttacccagctcctattcaagatggagttgctctggttcaaacgtctctgacatatttcccccctcccttttacgagagaacccttaatcctaagggctgcagagggatgaagatccactttctgtaacttctttatgctgaacaggggtgatgatattcctgcctaactgttgggtctcttgcattcagggtagaggagctcagttcgaaagcgttggtatggcgaaggccattcataactcttgagttccgacaaaaggtatatctggaagattaataagtgttcagtttaagaaaacatttagtaagcttatcctgcattcctacacaaagagtataatcacagcaatatattccacaacagtaaaataaaaaaaataaaattatcccaagtaaactgaattagaaagttttccatgaactgggcaattgtttaaatcaagctaataaggagtcactagccaattccaatatgtgcccagaattagaataacattacccatcactcttgtttcttctgagcagcagccagagatcactggttggttcacaggaataagtgggatcattctcttgtcttccataggtctgtgggacacaggtcaggaactgtgtagacaaggagtgaggccagttttcccaagcggcttttattggctctataagtcaagtttgattccataaaggaacacacaccattccagttgaagccttggtaaaataagcagtttctccacttgtgtcccaaggtcacccagtcagtgctgcagactatttcctttgggttggggggcgggtcccctcagtgtcctcctttctgtggttcgccagaaagatgttaccagaaaggggtcctgatccaggccccaagagagggttctaggatcttgcaaaggaaagaatttgaggggaatccatagagtaaagtgaaagcaagtttattaagaaagtaaaggaataataaagaatggctactccataggcagagcagccagtaaactaggcttgtaacttaagagacatgtttaacttacagaaacaaatcactgatgtgtgtgtataagccatgagagagatatgggacttaattttgctacaaaagaggatttaatttcctgcataatcagcttccccctattccactgaattaatttcatcaacatacaaggtggatattttctcctgtcttaagcaatctccctcctttgacccctgtgccccttcaggacaagggtaggctgtgctcacttgcctcccagtctttggaactcaccctcgctgggctttgccctattgccccacccagactgctcgtaggaaaggttatgttcatgttgctggattcagtggcaaggcctcagctgttaccttacctgacctggttttagcattggacatggttgttgactttcttcattggcttccaggacaccacactctccaagtttcccttcccatccctttcccttcccatccctttcccttctcctccccttcccctcccctcccctccccttcccccctcccctcccctccccctcccctccccctcccctcccctccccctcccctcccctccccctccccttccctcctttcccctcccctcgtttccatctgtcgcccaggctagagtgcaatgatgtgatctcagctcattgcaagcttcacctcctgggctcaagcaattctcttgcctcatacttccaagtagcgaaactccaggtaccagcaaccatgcctggctaatttttgtatttttaatagaggcagggtttcaccatgttgaccaggctggtctcaaactcctgactttaggtgatctgcccacctcagcctcccaaaatgctaggatcataggggtgagctaccgcacctgatctcaaactcctgactttaggtgatctgcccgcctcagcctcccaaaatgctaggattataggggtgagctaccgcacccagcccacactctctaagtttctaactccctcctggccacttcttcccaggttggggattggttttaactttttgggatcacaagttccttttagagtctgatcatcactgtgaacccacatcttagagaaaactgtacgtatgtttatgttaacaaaatttatcacaaatattagttttcatccttttcaattattattattattatttttttgagatggagttttgctcttgttgcccaggctggagtgcaatggcatgatcttggctcaccgcaacctctgcctcccgggttcaagtgattctcctgcctcagcctccccagtagctgggattataggcatgtgccaccacacctggctaattttgtatttttagtagagatggggtttcttcatgttggtcaggctgatctcgaactcctgaccttaggtgatccgcccttttcagcctcccaaagtgctgggattataggcatgagctactgtgcctggccagaattatggtgacttctaaaaaggtctgatttctttctttaagagttaatggttgttgcctgggcaacgtagtgagatgttgtctcttaaaaaaagtacgaaaagtgttagctggacatggttgcttgtacctgtagtcctagctacgtgggaggctgaagagggagcattgcctgagccctgggaattggaggctgcagttagttatggttgtgtcactgcactctcaccgaggtgacagagtgagaccccctttctttaaaaaaaaaaaaaaaaaattaggcgtggtggctcacgcctgtaatcccagcactttgggaggtcaaggcgggaggatcacttaaggtcagaagttcaagaccagcctggccaacatggtgaaaccctgtctctcctaaaaatagaaaaattagcctgggtgtagtggcacatgcctgtagtcccagctaattgggaggctgaggcaggagaactgcttgaacccaggaggtggaggttgcagtgagtcaagattgcgccactgcactccagtctgggcaatagagtgagattctgtctcaaaaaaaaaaaagaaaaaaagtaatgatcgtaagctgaaatagtgtttataatacaattttgatcaatttatagagttcactgtttcttctttttttttaagtgacaaggtctctctctgttaccaaaataaaaaataaataagtaaataaataaataaatgattttgtatataatccacctacgatttttttttttttttttttttttttagatggagtcttgctctgtcacccaggctggagtgcagtggcatgatcttggctcactgcaacctccacttcccgagttcaaacaattctcccgccttagcctccctagtagctgggactacaggtgtgcaccaccacgctggactaatttttgtatttttagtagagatgggggtttcgccatgttggccaggctggtcttgaactcctgacctcaggtggtcctcctgccttggcctcccaaagtgctgggattacagtcatgagccaccgtgcctggccacccccatggatttaatacttctgttttttctaatgtgaattgtcagtttcatattacttgttagtttatttaaagggatttaacatgcttgcataagatcataaccctttatggtcaatcatactgattatatattattttagtatgtgatattctcttttatgctaattttgattttttagcatgtagaaatttttgaagaccttcagaaaattgtatttatggcctttcttggtgggtaatattttctgtgtttcatttgctcttctttaccaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaaggtaagtggagtttataacggcagagctgacttttatggttttattaaggttcagaattgaaatacccatgactgtatatggatgctcatgactttgctcctaaactggtttatggttccacagaaacggaatcaaaatctgaggaatccaagaattatttagggaaattaaaattcttatgttagcacaggattggtagatttatccagtttgcaattgaaatatttattggcccattattactattcacatcatattatctcgtgttgactaagtaaccaaggctgacgtttgggttcttttctatttcatggtgatgatggtaagttgggaatggaaacagcagtctgaattgttccctatgccgtggagcgtgctggtgccgtctgttaatagtagggagtagttctcacctcgggctgcacatcttcatcacctggggagctgtggaacatgcggcatccttggtcccatcccagatctgctcaatcacaattttgggatatgggctctaatgcattttattgtattgtattgtattgtatttttatttttatacagacaggatcttgctatgttgcccaggctggtcttgaactcttgggctcaagtgatccttggcttcccaaagcactggggattacagggattaagcacccggccttaaaataatgccctttaaaactgctgcacaagaacattctcttttctctgaaactgtatattgtgactttgtacaaggaggctttctagtcattccagtgaactgcttgaatcaaagagagagaaagatagtatttacacaaaaccagtcatggctgcacaagaactggccaggccttgcagcttcctactgtggtgagtgacttggacgaggcatctgggtaaggacccctggtggccactgtgaggataaatttgtggccacttggaggcctgcaatatattttctttcagtctctaaaagaattaagctatagttctgtccaaagtaaatttctttactatcttttgttattgttgttattaataaaagtgcacatggggacaatgtggaaaataaatacatttcttggtacatctactctttagcatacatggcccccattaaaaaaaactcagaataaatcaagagttttagaaaaaggaacaaatggactgttctttataaaacaagatacctttattgttgagaatttagaaattacagattgaacaaaaaagtatcatgattaatgccaccacttagatataagtatcgtaaacgggctgggtgcggtggcttatgcttgtcatcttagcacttttggaggccgaggcagttggatcacttaaggccaggaatttgagactagcctggccaacatggtgaaaccctgtctctactaaaaatacaaacaattagctgggtgtggtggtacgcacctgtagtcccagctgcttgggaggctgaggcaagagaatcgcttgaacctgggaggtggacgttgcagtgagccgagatcatgccgctgcactccagcctgggtgacagaatgagactctgtctcaaaaaaaaaaaaaaaaaagaaaaaaaagacgtaactatcatgaacagtttttactgtttaccctactgatttacttggatttaaagaactacatgcttcatagggttagagttctttgctttattttttcccatttaaaatacaaatagcctgggcaacatggcaaaaccctgtctctacaaaaaaaataaataaataaatgcaaaaattagctgggtgtagtggtgcgtgcctatagtcccaactatttgggaagctgaggtgggaagatcacctgaacccagaaggtcaaggctgcagtgagacatgattgcaccactgcactccagcctaggtgacatagtgagaccttgtctcaaatgacacacaaaccaaaaaaaaaaaaccccaaatatttacatatctcttacccaaaggaagcatttttttaattggttaatctctttctgagaatattaacaaattgcaaatggattttcgtcccctagtttatgaacagctatgtaactcatgaatttttctgtaaatgaccctactacttgagtatcattgcatttaatcattagctagtgtctttcttgattgaaaaggtaaaattttagagattctggagtaatctcatatgttggctggagattagtcaattcagaaattatgagacagcttggtggaatgcagccagtgttggagttaggctgggttcagccgccagctaaggcacttttggctctgacagaagttagagatagctgcttattgtttctaagcctcagtttcctcagttacaacataaaacctaagatataagtgctgttgtgaataacaaatgagatcctacaattaatgatagctgtcagttaggagttgaaacctctactttaagccattgtcttatctcatcaataaaatccagctgaccagctttgagatcgtaccactaagaagagacttactcaataaaggaatcaaaaacaaattaaaaaatccattatgtatggtttctcttggagatggctttggctctggagtgatgcttggactgagatctgagtcctcatgcttagtgccaagttgacctggcaaagaaggctattttaaattttagggggaaggagcgacatctgtcggacacagtgcaaactacagtttgaagtagttgcctgtttcatgagattcctgtagttcttttcaatgatgtcataagcctacaaagctggcttttgggcaattgccgcgataaaacacaagtatttatgtacatctatcatgcatcaatagaaatatttgttttataaaaaagcaagtatctcttaaatcagtgtggaactggaaatggaattggtggcgtccagtctgattccagggtttgggaagttgggcagtgcccagcagacactgagttgacaggacataagtaatgattaagttgtttggccctaactacgtacttaattggaactgtgaggtatttattttggcctaagtaccatgaaaaaaattactgaaaccctaaggaccgtgtggcctgagaaagtttgggaccctctaaccttgaattctgctgctgccttttgtaccctggtttttctttcttttttttgttgttgtttcttgttttttgttttgagacagagtttcactcttgttacccaggctggagcgcaatggtgtgatctcggctcactgcaacctccaccctcccgggttcaagcgattcccctgtctcagcctcctgagtagtcgggattacaggtgccccccactatgccaggctaatttttgttattttttttagtagagacagggtttcaccatgttggccaggctggtctcgaactcctgaccccaggtgatccgcccaccttggcctcccaaagtgctgggattacaggcataagccactgcccccggccatgtatttgttcttctgtgactggcttatttcacctagcataatacactcaaggttcatccacattgcggcatatgtcagaatttccttccttttttttaagttcgcacaatattgcattgtatatgtgtgccacgttttgtttatcctttcatttgttgatggacacttgggttgcttccacctcttgactaccaggaataatgctgctgtgaacttgtgcatataccgtggccttttagagatgtgaagtctgaggcacagaggtgctaattcacttctccaaagccaaaggagatggtggaattgggatttgaacccaggtggtctggttccagattctgtgttcttagacattatgtatgcggattcttttcatgaatagaaagcacaagattctctacacttaacaaatggctgccggaagtatctggtcatgctgaagctgggtgcgctctctaggaagtaccttagggaggcttttacatgtgagtgcgagaagcactccatagcatgtacttctgcgtggttgggaacaatctaaatgtcagcagaagagtatgtacattccttgtggtctgttcatataacaaacgctgtaaggtgtgaagatgaatgtcctggagctccatgtgtcaccgtagtgaaatctcaccactgaacaatagactgttgaggaaaaagtcaggtgcagaaggctctgcggagtagaataccatttatatcaagtttcagaatattaaaaaatgctgtaattgtttagggatatggaaatatatggtaaaaatattaagaaatgcttaagattaaataaacaccaaatgtagtataaggccctggggagggccgggcgtggtggctcacgcctgtaatcccagcactttgggaggcggaggtgggtggatcacttgaggtcaggagttcgagaccagtctggccaacatggtgaaaccccgtctctactaaaaacacaaaaattagccaggtgtggtagcaagcgcctgtaatcccagctactggggaggctgaggcaggagaatcacctgaacctgggagggagaggttgcagtgagtctagattgtgccactgcactccagcctgggcaacacaacgagactctggctaaaaagcaaaaagaaaagtttacctctgggagtagagggagaattgtgtttggagagggccccagaggacttcagttgcatttgtaatatttgtagtgctctttttcttttttgtaatgctttatttcttaatttgggtggtggttactggtatttgtatattatttttggtacccttttatatgtctgaaatgtgtttaattttttaaagggccagtggatagcatacgtgcttatgtatccatgtgaactctgtttttcatgcagtcagctgagcaagttgcaagaagtttctctgaggaactgtgcagtaagttgtgctggtgaaaaaggaggagttgctgaagcatgtcctagtatccttttcaccgagagcttgttattggaatctgactatggattttatacctgtgccagagactgctaattgcctacccattgtccagtcttgacaacttccttcctaatgcagttcagttttgcttggtgtagttggggcccagataaattatttaccttcccagacccctttgcttgcaagtttgccagcatgttcaggtggaagtttctacaccgggctccttgaaagggggcacacttggccaggcgcagtggctcacgcctgtaatcctagcattttgggaggctgaggcaggtggatcacgaggttaggagatcgagaacatcctggccaacatggtgaaacctgtctctactaaaaatacaaaaattagccgggtgtggtggcgtgtgcctgtagtcccagccactcaggaggctgaggcaggagaattgcttgaacccgctaggcggaggttgcagtgagctgagatcgcgccagtgcactcagcctggagacagaacaagacttcatctcaaaaaaaaagaaagggggcacacttgtttggcctctgccttttgcctgttgcttttacccttcccctgccttgagcggatggaaagcccagggctttggcagctgtcttacaagtgtgaagaaagccatccagtacagattgggagagcagaggagagggaacctgggctgctgactgtgtactgggaacctaagatgaatctgcttcagccctggtctgttttctcatgcagttcttttttttttttttgagatggagtcttgctctgttgcctaggctggagtgctgtggcgtgatctcagctcactgtaacttccgcctcccaggttcaagtgattcttctgccctagcctcccaagtagctgggattacaggtgcccgccaccatgtctggctaattttttttttttttttttttgagacggagtctcgctctgttgccaggctgcagtgcagtggcgtgatctcagctcactgcaacctccgcctcccgggttcaagcaattctcctgcctcagcctcccaagtagctggggctacaggcgcccgccaccacgcccagctaatttttgtatttttggtagagacggggtttcaccatgttggccaggatggtcttgatctcttgacctggtcatccgcccaccttggcctcccagagtgctggaattacaggcgtgagccaccacgcctggcctcgtctggctaatttttgtatttttagtagagatggggtttcgccacattggcgaggctggtcacgaactcctgacctcaggtgattcccctgcctcggcctcccaaagtgctgagattataggtgtgagccacatacctggcctcatgcagttattttttagtgggaaagactctggttctgtttcatgcagctgaatgcagtttgttataataccccaacagaggctctttatgaagtttggaatctcttttctctacctgctcttattagtgttatttttgtcatatatttcttttttgcctgtaagcaaaaatgttggaggtaggttaaaagaaaattttaaggatgggcatggtggctcatgctggtaatctcagcatggtaatctcagcattgggaggctgagactggaggactgtttgagaccagccttggcaacattgccagaccttgtctctataaaaaattaaacaaagcaaaacaaaactgggtgtggtggcatgtgcctgtcatctcagctactcgggaggctgaggtgggaggactgcttgagcccaggagtttgaggctgtgatgagccatgatcatgccactgtacttcagcctgggagaccccgtttctattaagaaatttcccatggaggctgggcgcagtggctcatgcctgtaatcccagtactttgggaggccgaggtgggcggatcatctgaggtcaggagtttgagaccaacctggccaacctggtgaaactccatctctactaaaaatacaaaaattagccaggcatggtggtgcatgcctgtaatcccagctacttgggaggctgaggcagggagaattgcttgaacccgggaggcggaggttgcagtgagtgaggtcatgccattgcactccagcctgggtaacagagtgagactctgtttcaaaaaaaaagaaagaaatttcccatggaaaccaaatagactttctttaactttaaaaggtctttccccaattcattaagtctgtctgatctgtacataataacttttgcaaaaaatagcagttttgatcagtttttttctgagtgaagagatgccaggtgaagtagctctctttggcaaaatgccccgacagtgcagtgaaggaaattagatcagacatctctccatctgtgtgtctgagggttcacttcccttgggggaaacagtctgggggtctgttgggacctgtggtagctgcacaggtctctgcctgtctctgccagtctctgcccctgagcagcctcctccgttgaccccagcgtgctgcaaatatgaggtcattttcaaaagtaggcagctggagtgaggggaattgaagtggatgcagaaaagagtttgctgaggagccagtgccacagcagtgtcagagcattctgcattctgcctggcctattcctaaactatttcagaagattggtaatcgggctgtgtacagtggctcatgcctgtaatcccagcactctgggaggccaaggcgggtggatcacctgaggtcaggagttcaagaccagcctggccaacatggtgaaaccttgtctgtactaaaaatacaaaaaattaactgggtatggttacggacgcctctaatcccagctactcaggaggaggctgaggcaggataatcacttgaacccgggaggcagagattgcagtgagccgagatcacaccactgtgctctagcctgggtgacagagcaggactccatctcaaaaaaaaaaaccaaaaaacaaaaaacgggggggccaggtgtggtggctcacgcctgtaattccagcactttgggaggctgaggcaggtggatcacctaaggtcaggagttcgagaccagcctggccaacgcggtgaaaccccatctctactaaagtacaaaaattagccaggcatggtggtgggcgcctgtagtcccagctacttgggaagctgaggcaggagaatcgcttgaacctgggaggcagaggttgcagtgagccgagatcgcgccattgcactccagcctgggcgacaagagcgagactccgtctcaaaaaaaaggacagatgtggcggtaaatgggtttgggagtgctggctgttgggttgctcagagctgtcagcagtgtcctgaagaatcagcatgttgtttgtttatactgcacttttctggagaaaaatgtcccccaggacacgaagaaatgaggtttcacgaagataatcaagtcatgattggtatttgcagatacagtgataaatgtcttgcagctcccgattgaattctcgccagaagttgaagtattgctttgggtgcttaatccagtcatccttttttgggttggtctgtctttgaggttatttactctaccagaactcgaggcagtgggagagctgcagacccgggtgtgtcaaatctgagggtacttccaggggaggggatgagcttcctcctccctcatgacctgcggaggagagtctgtgcccaggtgcttggcctgtgctttcacgggggctccttgaacggtgtgtgtgggaggggcgaccacatattgacagctgttgttcgtggttgatttcaggatgtaggtggtctgtgtgctctgtacagaccttagaaacaataactctaggctacataatgggaagcagcagtgagggaagcgtgattggacttaaacccttcctcagcagcctaacagccgatttagcggggttaatggaaacacagggtggccaaagtgtcacccagaggccgggaaagcacccctcgcatgagcctgtgttaggcggtgtcaggaagctagggcagccgagaggaggctgaggaggaggggcagaggagcagtttacagaagccatcatgcaggtgtgggcccaagggcagaggaggagcgcgaggggacctggagggtgtttgcccggtctggaattttcggcagcctgcaccgactcttttcccttccatttgatgcgacggccacggcaaaattgaggctattctgcaggtactcatattaccgattgaaatgcaactgtttacgagggtagaccccattgttagctcttgggctgtaatagtccaggcagctggcaggattcgggcatgggtagctggcgaccgggtatggagtcatccctttcttcgcatcttctctgccgtccttcccttgttcctgaccttcttgcagagcttcctaattggttcctgcctaaaattatttcctttctaaccaatgctttggagtgatgccactgtttttgtaaagaaactttctccacgttttatgtatgtttgatgactccctgttgcattatggggtgcaatgatatggattttggatcgaggatgacttgggtgtaacttcccacttgttcatttgcacacaatgacacagctctgtgactgctgtgccaccgtttgttctgctatgagaaagcaaaacaacccagcaatcagcatagtgcctgggtctggttagcagtggcagcagcagtgcgggtggtggctgtcactgctgctgttgttattactggatcttagagctcttttttttttttttttttttggagatggagtcttgctctttcactgggctggagtgcagtggcgcgatcttggctcaccgcaaccttctggcacccaggttcaaggattcttctgcctcagccccctgagtagctgggaccacagatacgtgccaccacgcttggctgattttgtttttgttttttttttttctttttttgagatagagtttcgttcttgttgcccaggctggagtgcaatggcatgatcttggctcactgttacctccgcctcccaggttcaagcgattctcctgcctcagcttcccgagtagctgggattacagacatgtgccaccatgcctggctaattttgtatttttagtagggatggggtttctccatgttggtcaggctggtctcgaacccccgacctcaggtgatccgcccgcctcggccacccaacgtgctgggattataggtatgagccacagttcccggtccaatttttgtatctttagtagagacagggtttcaccgtgttggccaggctggtctcgaactcctgacctcaggtgatccgcccactttggcctctcaaagtgctgggattacaggcgtgagccgccgcgcctggcctggatcttggagctcttcttctgtcgctggccactcctcagtcgcttctgtgggacctttctctggttgcagactgttgggtgtaccccaaggctcagacttgggagccctgggcttcttgagagaccttctggggtgtggctggcactcctccacggcctgccctcttccacatctgtctctccagctgcagctttgatacctctgtctggatgtctcatagccatcatagatttagcatgtccaaaactaagacccacgcctgctcatcctgtagtcttttccctcttaataaatgacagttccatttgcacaggccacagatcttggagttgtccttgacactccctttctcccatgccccacacctaaatccattggcaaatcctgtgagccccacttccagagtcagacgccccctctgacatgttctgccctctcatgctgctggtttgctccggcctcctggagactcccggccctcctttatttccctgcaattgtgctcaactcagaagcacagtgacttttactggatttttttgttgttgttgttttgttttttgacataatatagatcaaagtcaaagcagagtgatttttaaaggacccaggtcacctgtcgctgtttcaaagcctccaatatctcccgtttcaagcaaactttgaaaagtccgtttcaaacagactttgaagtggcctgcaaggccctttgtgatgtggcctggccccttattccttgtgaccttgtttctagtacccccaagcccctctgctcgagtcacacaggcgctggcggtcccggtcataggctgagctcgttcccaccccagggccttttgctcttgtcactcctccgccatgtgctcctctcccagatggcgttcccccatttccctcagctctctgctcagatgccctcttagaggaggtggtcttccctgggcactgcatatagaacagccacacacctttcctgcatgccctgctctgtccctgagcacagacaggcctgcctgtgacacactgttgaggcccctgtgtcgtgatcgtctctccccgatgacactctgctttgctcactgcgatgctcctggccctaaataattacttgcagaatagacgagtgcattgaataatttccacacatacacatattagatgagagtgtagctcctccagtagctggcccggtcctgctgcaagctcctctgtctttctctgcggggacctggctaagctgtgccccttcctgatggtgctgcacctgcacctagcccctcacctccacttgtgttgtctgtcggctttgcttttccagccccactgtgttatcctctctgaatccctgtatcaggggcagttggagtgatactgttacaactgcttccaggctaccggacaccctctcaattcctaagtcatgcgcttttgcacatgtgtcccaagttgacccctcttctctgccctgtagatgctatttatctggagattcctatggtaatggtgccccatagaaggtcatgtgctggggtgaggcttgtgtgtataccttaggtgcttcagaaatcaaagttaccctcactgcttttcccctctccttttgttggatagtgctaggatggtttagcgttatgacatttggttctttgtcatttgattgtagatgtttgtctcaagttttgagtatataacaatgaacttttaatttatttttagttttttgagacagtctcactctgtcacccaggctggagtgcagtggcgcagtctccactcactgcaacctccgcctcccgggctctagagtttctcttgccttaacctcctgagtagctggaattacgagcgcgtgccaccacacctggttaatttctgtatttttagtagaatggggttttgccatgtgggccaggctggtcttgaactcctgacctcaagtgattcccccgaccttggcatcccaaagtgccgggattacaggcgtgagccaccgcgcctggcctcacaatgaactttttcgtttctcagtgaagttttggataacttaaaaatattatgtactcctgaaaaaatttgaagctgactagagggtataaaatgaaaagttaaaacgctcatgctctggaattaagagtaactccttttatgtcttttgtgaatcttttgaaattactgtttcttaacatgtgcttttagatatcagaaaggtagatttgtcaaaaaacctgttgtcatcatgggatgaagtgatacacattgctgatcagctcagacacctggaagtccttaatgtcaggtatgaactcttggttgctgaatcttcattaacaataaagctcatctctccttgcttcctcacagcatctctgtggaaagaggtagggagccggaagggttaaggctgccacctgatgatacaggagttaagaaggaattactcaggctgatagtgagggtatggaagtcctcagtaaggttttccttttaatgaaaagcagccccaaattattttcctttctaacacaagcagcctgtaaaatcgagctgcagacatagatgcagacagttgagccaatcaggttcaagatggcagctccatcttcccttctcttttccagccacgtgtacagtaaggagcagacaagatggtgccagccaaagggaaatttcatttacatagtaagattagggtggggtggccagcctttcctggctgtgtaaatgtcatgcctgattgaaccaatctgtgagcattaagtaaatcagacactgcctcctcaagtcaaactaaaatctgtgcatctgggccgggtgcagtggctcactcctgtaatcccagcattttgggagtctgaggcaggcggatcacctgaggtaaggagtttgagaccagcctgaccaacatggagaaaccccgtctctactaaaaatacaaaattagctgggcgtggtggcatgcaactgtagtcccagctactcaggaggctgagacaagataattgcttgaacccgggaggcagaggttgcagtgagctgagatcgtgccattgcactccagcctgggtgatagagcaagactccgtcaaaaaaacaaacaagggccaggcgcagtggctcacgcctggaatcccaacactttgggaggctgaggcgggcggatcatgaggtcaggagatcgagaccatcatagctaacaaagtgaaaccccatctctactaaaaatacaaaaaattagccgggcgtggtggtgggcacctgtagtcccagctcctcgggaggctgaggcaggagaatggcatgaacctgggaggcggagcttgcagtgagccgagattgtgccactgcactccagcctgggcgacagagcgagactccatctcagaaaacaaacaaacaaacaaaaaatctgcatctgctgccagcttgcctttttcttcttggaagtcccctctctcttactagagagagagctgttttccatcttctttctcttgccttttaaacctctgctcctaaactcctcatgtgtctgtgtcctaaattttcctggtgggagaagaggaataccaggtgtataccccagacaacgcagctgcttcgctagtagacatttttatacagccagattttggtttacttgaatttatctaactttaactttaaggacacatttaatctttaaggacactttatttatttatttatttatttatttatttgagacagtgtctcgccctgtcgccaggctggagtgcagtggcgtgatcttggctcactgcaacctctgcctcccgggtttgagcgattctgctgcctcagcctcctgagtagctgggactacaggcacgagccaccacgcccaactaatttttgtgtttttactagagacggggtttcactatgttggctaggatagtctcaatctcttgaccttgtgatccgcccacatcagcctcccaaagtgctgggattacagtgtgagccactgtgcccagccttatgtatgtatgtatatatgtatgtgtgtatatatatatatatattttttttttttttttttttgagacagagtctcactcttgtcgcccaggctggagtgcaatggcgcgatctcggctcactgcagcttccccttcccgggttcaagggattctcctgcctcagtctcctgagtagctgggactatgggtgcccaccaccactgccagctactttttgtatttttagtagatgcagggtttcgccatgttggccaggctgttcttgaactcctgacctcaggttttccacccacctcggcctcccaaagtgctggaattacaggtgtgagccaccatgtcccgcctctttaaggacactttaatctttaagggcacattgattattatagccttgcaaacggtcacatgaggtgattcatgaataaggaatgtgttttaacttttaccaggtggggatgagttagattttcattgaactgcaagatcttatttttagcctgaccgtaaagatggaaggttgggggaggtgatatttaattggggagtaggagaggagaggtgatattattaaaactgcttgtttatttgaaaacttctagcgtttaattgctgtaggaatgagtaatttcattgggatactgtttaattctgttttgataaggatttttcattaatctacctattttactaatgtcacacttttctaggccttcctgaatatttaatttgttttaatctcagaacctaactttccaagggcttagccaggcttcctccatttttttttttttgaggcagagtctcactctgttgcccaggctggagtacagtggtatgatcttggctcactgcaaccttcgcctcccagattcaagtgattctcctgcctcagcctcccaagtagctgggactagaggtgcctaccaccacacccggctaatttttatatttttagtagagacggggtttcatcatgttggccaggctagtcttgaactcctgacctcaggtgatccatctgccttggcctcccaaagtgctgggattacaggcgtgagctaccgtgcccagcacaggtttcccctttcattcttgaaccatttttgcatagacatgtgagtgtacagtaaagccggtagacaggcctgaatgagttgtgctcccaaatagagcaaacgggggcaattcaacccatggtgtctcatcttctggaaatacgggcttgtgttttttaatagtatcgtctttcaaagtgactgtcaggattgaatactttctgagattagggttttgagaaataatttaaggggcaataatttcatccatcctcatagccaaagggcagactctatgtttagagaagcaaaattctagcccatgattcagtgtatcagtaagactctggagaacgggactttgttttgcagtatccagagccatatcttgtgaagctggaagctcaccttgcaaatgcctgagttttgggtttaggaagcctacagccgcatacaggtgccctaatcctgtgaaagcatctttacacagctgataccaaaaagttgtatgttgtaaatgttaaaaattaggtagtcttgattcacttgaatcattaaaaaagtgatttttaaaatataattccattttaagattgaaacaaatcaaaccccttagattaaaacccagattgttgctttcaacaactatttcagttgggtttactgtatagaaataagtacattgtatcttttttttctacacagtgaaaataaactaaaatttccctccggttcagtattaactggaacgctttctgtactgaaggttttagtcctcaatcaaacaggaataacgtgggctgaggtaatcatatttctttgttttattacacattaataagcaattaaaaatgtttggtttaatagagaattgttagtacagtttaatagtacaactgtggcttcatttaaatcatcccagtatctattaatagataacaagattcattaaagtgccttataaaaacgagttaaaagagcatcatagttgagttttgcatctggaaatccatgtcctatctcagctcattttgacttgttctggtgcctttataaacagtggcgctccgttatggtatgaaccagtatgtgctgagcttcaaaaagccgtagtgttggctattgactagcttcctgagttttcctgttagttttttttagaacagaagccaagcagcagaaaggttctcacatacttttcttgttagaagttcggctcttggaatccactgttcattttatacagccgggctcaaaagtagacttgtgggtccttggcacagcagcatttgggacttatatctggcagtactatttcctgtctgaggtgtactgacttcacacacccagagcattccactttctttttttttttttttgagacggagttttactcttgttgcccaggctagagtgcaatggtgcaaccttggctcactgcaacctttgcctcccaggttcaagcgattctcccacctcagcctcccaagtagctgggattacaggcatgtgccatcacacccagctaattttgcatttttagtagagacatggtttctccatgttggtcaggctggtctcgaactcctgacctcaagtgatttgcccgcctcggcctcccaaagtgctgggattagaggtgtaagccaccgtgcccagcccactttcatttttatttatttatttttcttgagacagagtctcactctgttgcccaaggtggagtgcagtggcgcaatctcggctcactgcaacctccgcctcccaggttcaagtgattcttccgcgtcagcctctcaggtagctgggattacaggcatgtaccaccatgcccagctaattttgtatctttagtagagacagagtttctccatgttggtcaggctggtctcgaactcctgacttcaggtgatccacccacctcggcctgctaaagtcctgggattacaggcgtgagccaccgtgcccagcccactttcatttttatttatttatttttcttgagacagagtctcgctctgttgcccaagttggagtgcagtggcatgatctcggctcactgcaacctccgtctcctgggttcaagcaattctccagcctcagcctccaaagtagctgggattacaggcgcttgccaccatgcccagcttatttttgtatttttagtagggacagggtttcaccatgttggccaggatggtcttgaactcctgacctcaaatgatctgcctgtctcagcctcccaaaatgctgggattacaggcgtgagccactgtgcccagcttgggcattccactttcaaaccaagggtgtagaaatacattcccagccatgttcacccaggaagtgccacagaggccactcagtgagagacaggtgggccccttgtgcccttaatatgcccgtggccatggagcctctttcctagggcccctcctctgtgaggcgcttactccctctcaaggtgtagatgtagctggaagacaagaaggggccagacactggcactggggctcacacctgcaatcccagcgctttgggaggctgaggtgggaggatcacttgagcccaggagtttgaggctgcagtgagctaggattgcacctttgcactccagcctgggtgacagagcaagacgcatctcaccctccaaataaactaggaagggcacacagaaattgaagtggtggagatggcagtaaagttccagtgagaaaatttagaaatagttggtgaggctggtcatggtggctctcgcctataattccagccagcactttgagaggcccaggcaggagaatcacttgaggccaggagttcaagacccacctaggcaacatagagagatcctgtagatgctatatatatattatatattattatacataattatataatatataataattttttgtaatttttttttttgtaaaaaaaaaaaattaggctcatgcgcagtgtggtggcagcaggcacggtctcgacatgcagaaagacgccagcaagttcgtggatctgtgcgtgctgcagaaatgctccaccagcaactgcatcatcagtgccaaggaccacacatccatgcggatgaacgtggccaaggccagtgaggtcacgggcaggtttaacagccagtttaaaacctgtgctatctgcaggactgtttgcaggatgggtgagtcagatgattccattctctaattggccatggccaagggcgtcatctcaactatttggtttttgagatggagtcttgctctgttgcctaggctggagtgcagtggtgtgatattggctcactgcaacctctgcctcctgggccaaaatgattctcctgcgtcagcctcccaagtagctgggattacagacgtgcactaccacgcctggctaattttttgtatttttagtagagatgggttttcaccacgttggccaggctgttctcaaactcccgacctcaagcattctgtctgcctcagcctcccaaagtgctgggattacaggcgtgtgcaaccatacccggccatttttgtatttttagtggtaatgggtttcatcatgttggccaggctggtctccaactcctgacctcaagtgatccacctgccttggcctcccaaagtgctgggattacaggcatgaactcactgtgcccgatctcaaagaacttttgattggagagaatcatggatgtagaatatttgtcataaatatataatgaaaactttaaaaaatgtataattaaaaaaataatgaaagaagaaataattgttgagaaatttatgaaaggatatgaaaaattagcatatcctttacaaacccagattggcatttagaattgaggaaaggtgtgtaacatcaatttacttattttggttaagcaaattctatcaaataataatatgtgcagttagtatctcctgttccacctcgtagctgctttacctaaaccatgcattgacacgtacctccaaggcctcaaagtgcccacagtgtgtgctcccacagcattaaaatgcacccccttaacattttatttatcaccccccaccactattccaggcctgaaacagtcttatgaactgtccgtgaggcacttgtttgctgaaacagtaactgagctgaattcttgtggtggttcctatgaacacccgggaagaaacagccagcagaggccgcctgagcctgaaccgagtttctcttccaggtgctgcggtgtgtcgcggggtgcccaggcctggaggaactctaccttgagtctaacaacattttcatttccgaaaggtaactagcacttacttaaatgcatctatccccatttaatcatcattctgagtaaataaatggtctcaattatatctaaccttaatttttagaaggatttgcaaacaagaattaggaaaaatgcttattattcattgccttcacaaattagaatttcactaattggttctaatcaaaggaaactcatcagaattaaatatttgtgaagacatgagttatattagttttgcatcagtgtattaacttgctgtttcttttttttctttttctttttttgagacagagtctcactctgtcgcccaggctggagtgcagtggcgatcttggctcactgtaacctccgcctcctgagttcaagcgattcttctgcctcagcctcccgagtagctgggattataggtgcctgccaccatgcccggctaattttctttatttttagtagagacggggtttcaccatcttttacggggtttcaccatcttggccaggctggtctcgaactcctgaccttgtgagccactgtgcctggccaacttgctgtttctaaatggaagttctgtaggatatgctataaggattaaataatgtatttttcattagcatcatctgtttaaggtcattgtaccaaagtacatgtaaaactttgttctctgaaatatattgttgcctcatctcctttttaaattaataatattaaattactatgtaaaattaacctaactgtgggaaaatttacaacagattctgaattaaaggattcagaatcttaaagattttcgtttacagaagggtttcattatgtaggcaaatgcaggttttttgttttgttttttttttgagatagagtttcattcttgtcacccaggctagagtgcaatggcaccatctcggctcactgcaacctccacctccctggttcaagtgattctcctgcctcagcctcccatgtagctgggactacaggcacgtgccaccatgcctggctaatttttgtatttttagtagagacggggtttcaccatgttggcccggctggtcttgaactcctgacctcagatgatccacccgcctcggcctcccgaagtgctgggattacaggtgtgagccaccgtgcctggcctgcaggttttttaaattaaatttttttattttgagataatcatatattcacatgaagttttataagaaatgatacacagagatcacttgtacccatgacccaggttcccccattggtaacaagttgcaaaactatgatataggatcacaggctaggtgtgacactgataccggcaggaatatgtgcatcaccacagggaccactcaggttgcccctttacagtcatatttacttgcttcttatccccagccctccatcgcaccaaatgcagggattttaaggctgtatctttgaaaacaattaagagataaattcacggtgaaaaaattttattttccatacaggccaacagatgttctccagacagtcaagttattagatctttcctctaatcaattaattgatgaaaatcagctgtatctgatagcccacctgcccaggtaatttgcccctaaatgcctgatacaatagtgttcagtcaattcttagtgaagcagttttcatatgctatgtatgctttctcaatagaaacgtggtaacaatgatggaatttctaaattgagtaattccctttgggaaattttcatttgaattcatttagaaaatttacttgtgaaccctgtataatgtggactatgtctgtaccagataatttgaagaatgaataatttgaccctggtgataatgcggaaagtcttcattcattaaactccgggcagtagaccgtgtctctttcctctgagacgcatttagcacctgacatagcagtaggtactcaagaaccattaggtgactatggagtcattagaatacaggataaagagttcactttgcatgtcctaagttggactttatggtttctaagtattttacatgggattaaaaacccagggtgtaggaaaaaaatttacaaaccgagtctggttgataccccatagcattttacattgttctgtgtaatcaaattgtacattttgaatttcaggttagaacaattaatcctctctgacactggaatttcttctctacattttccggatgctggaattggtatataagattagtaaagttccccactgcccccccacactatacttcagctactttcacttctactgtgtaacttcattcctctttttatagggtgcaaaacgtccatgttcccatccttgaagtacctggtagtaaacgacaatcagatatcacaagtaagagctgctcggagtatgcccagcacactgttgcctctttccactctcatggcagagtttggaggttccttctaccaaaaaagtaaaaagaaatttaaatcgaaagagaaatacctcctcagagtgaaactcctcataagaagccaaaaatattaagaaagaaattagttcacttcacacttaagtggacttcacacttaaatggcacattaatagagtaaaaggggccgggtgtggtggctcaagcctgtaatcccagcactttgggaggtcgaggcgggcggatcacctgaggtcgggagttcgagaccagcctgaccaacatggtgaaaccccatctctactaaaaaaaaaaaaaaatcgcaaaattaaccgggcgtggtggcgcatgcctgtaatcccagctactcgggaggctgaggcaggagaatcgcctgaactcaggaggcggaggttgtgatgagccgagatcgcgccgttgctctccagcctgggaaacgagcgaaactccatctcaaaaaacaaaacaaaacaaaacaaaaaacaacagtaaaagtatgtggtctttctagaggggattgcttagtgcatgatgaaattccctgcctcagattagaactagggacatgctttcctgttgctggttcaaacttctgcaaaagtggcatgaacgtaccgcttttcatttatttccttttgctgtgtttcagtggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgaggtgagcactggcgtcatgactagatattttttagactagaaaataaatgattttaggccaggcgccgtggctcacacctgtaatcccagcactttgggaggctggggcaggctgatcgctgcagtccaggagtttgagaccagcctgggcaatcttgtgaaaccccatctctacaaaaaatacaaaaattagctgcatggtggcacgcgcctgtaagtgcttgtagtcccagctactcaggaggctgaagtgggagaatcacctgagcccgggaggccaaggctgcagtgagccatgaacatgccactgcactccagcctgggcaatggagtgagaccctgtcttaatttaaaaaaaaaaaaaaaagtaaaaaaattatttttgaatattgtaaagggggtgagatgtagctttccttggaatggtaaagattagccttgtgcagtttcataatagtggttcttttccagctcctcaggagagagtcctccacttagatcagtgcagtatcatttgaggcacaccaggcaccgtctccatgttttcagggaatgtaggcagaaagaacacagaccacagagctgctttctcctccccttctcagccactcttccccataaaagtgggaagtccatgccttgtccttgccagcacttttgtgcattcactgggagtcagtcagctccaccagagcaggcgcctccaggcagacctgggggaggcgacccagggtacctggtgtagtcctgaaactggcctatgcgcaagtactcgcatgaattaaaagtgtaggccaggcacggtggctgacacctgtaatcccagcactttgggaggccgaggttggcagatcatgaggtcaggagatcgagaccatcctggctaacacggcgaaaccccgtctctactaaaaatacaaaaaaattagccaggcattgtggcatgcacctgtaatcccagctattccagaggctgaggcaggagaatcacttgaatctgggaggtggaggttgcagtgagctgagatcatgccactgcactctagcctgggcgacacagcgagactccatctcaaattaaaaaaaaaaagagtgtaaaactgaaattcttttttcttttctaataaacccctgagttctgtcaatgttaaaaagaagggtgaaaactagatcttgtccctctcaatttgattattttctgcatgtgctatggaggaaggacaaggtgcaaaacgcaaaggacatgttagaaaaaagctttgtaataggcttgtttttatgtcacatgaacatagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgagtacgtgcgtatacactggtggccttcaggtggtggatttccagctggaacaaagttttttcttgggtatcaaaagaggttctcagtgttgcttttgcccttcttcctttcctgggcttcttgtattcatctgaatggactataggcactttcctggggcgagggcggcagggcaagagcagtatctttcagcaggaggaacctgggagactgtttatgttcttgaaatggagaggtttgcatttggggaagggaaagcaattcttttatttttaagagatggagttggccgggcgcggtggctcaggcctgtaatcccagcattttgggaggctgaggcgggtggatcacgaggtcaggagatcgagaccatcctagctaacacggtgaaaccccgtccctactaaaaatacaaaaaaaaaaatgagccgggcgtggtggcgggcacctgtagtcccagctactcaggaggctgaggcaggagaatggtgtgaacccggggggcggagcttgcagtgagccgagatcacaccactgtactccagcctgggcgacagaacgagactccgtctcaaaacaaaaaaagagagatggagtcttgctctgtcgcccaggcccaggctggagtgatctcagctcactgtaacccctgcctcccgggttcaatttattctcctgccttagcctcctgagtagctgggattagaggcgcccgccaccacgcccgactaatttttgtatttttagtagagacggggtttcaccatattggccaggctggtcttgaactcctgacctcaagtgatccacccgcctcggcctgtcaaagtgctgagattataggtgtgagccaccgtgcgtagcaggaaagcatttctttttctttttttttcttttgagacagagtcttgctctgtcacccaggctggagtgcagtggcacaatctcagctcattgcaacctccacctcctgggttcaagtgattctcctccctcagcttccagagtagctgggactacaggcgcacaccaccatgcctggctaatttttgtatatttattttttgagacggagcctcgctctgtcgcccaggctggagtgcagtgccgcgatctccgctcactgcaagctccgcctcccgggttcacgccattctcctgcctcagcctcccgagtggctgggactacaggcgcccaccaccacacccggctaattttttgtatttttagtagggacggggtttcaccgtgttagccaggatggtctcgatctcctgaccttgtgatccacccaccttggcctcccagagtgctgggattacaggcgtgagccaccgcgcccagccagggaaagcacttcttaaatgtaggttcttctcttgcatatgtccaccaggtttcaggtggcgcaccatgctccactgtaggaagggtaggaagcactccagtttatgtctgaggcatccgtatatatatatatttttttgagatggtgtttcgctcttgttgcccagactggagtccaatggcgcgatctcggctcactgcaacctctacctcctgggttcaagtgattctcctgcttcagcctcctgagaagctgggattacaggcgtctgccaccatgcccggctaattttttgtatttttagtagagatggggtttcaccaggttggccaggctggtctcaaactcctgaactcaggtgattcgcccgcctcagcctcccaaagtgctgggattacaggcgagagccaccgcgcccagccggcatctgtatttttttaaagccccccaggtaattctagtgaataggaaagttcgtatgagtgtagttctgcagtaagctctcgtcccgagggctcgctaccaaggctggcacttggcatgcacggtggttccttaaatcctccagcctggttcttcaggctttgaagctaagaattcatgagtctttgtccctgatgtactttccattttgttttgatgacattattactccacatttcgcttttatgttatttccttttttatatttcttaatgcaagaagctcgctgcataaacgcttcaggcttgaacagtatgtttaaggaagaaaagcagcctagaggaatcactttcaaatgactccattagccagcccaatctcctggccacgctcggtgaattctaaatcactcgggggtgggcaagggaagatgtgaagcagccgggcaggtattgttgagtatttcactgctaagaatgttagaagacaaaagcacagatagatggggggatttagagaaatgttgtcactgtttggcctagagcaggaaaaaagtactgctttcctcctctcctgtggaggctgtggtccaggcctaggaactggtttgcagtatggtactgagcacccagcctggcactgcacggtctggtggaaacgtgagaagtgtcctgtggatcgtgtctcaggtggcaccaggtttctgtcagcgcagaaagagaactgttaccaaaggtgacactcggggaaaacatttgaagtatttgaaggcagtcttctcttgctagttttgagtcaggacacctaaggaacaatgatgtaatacacatgtaaacatgttgcttttcatttgttgtcttttgttgagtttcactggtcattaacaatgagctagataagctacagagtctgcagctctgggtagatagaagattctgcccttggaagtggtcgttgtccatcactcctaaaaatcacactgaataaaggcagctccatgtgtcctgggaaaggcacaggctctctggacgcttacctatcctttgtttgtttgtttgttttgtttttacttatagtggcctttggtttatcattcatctcttttgctttcttaaacagaatatggtgcacctgaagattgggaactcaaaacacagcaaccacttatgctgaaaaaccagctactaagtaagaatctcagattcaaatagtttatttgtatttgagtgcttaggtgctgaaacagttagtgtgtttctcttaagtgtgtacctcttaagtacctaagtaaatgccttgagttttaaatgaaaatttttttttttttttttgagacagagtctccctctgtctcccaggctggagtgcagtggtgtgatctcagctcattgcaacctccgcctcccaggttctaagcgattctcctgcctcagcctctggagtagctgggactacaggcatacacaaccatgcccggctaattttttttaatcgagacggagttttgctcttgttgcccagactggagtgcagtggcacgatcttggctcaccgcaacctccgcctcccgggttcaagcgattttcgtgccttagcctcccgagtagctgggattacaggcatgcgccaccacacccagttaattttgtatttttagtagagatggggtttcaccatgttggccaggctggtctcaaactcctgacctcaggagatccacccgcctcggcctcccaaagtgctaggattagcggcatgagctaccgcgccctgtcaaagaaatgaattctttaaaacatgtttaaattcttatacatttttgtaactcctatgttttaaactcatttaatagtgttataaatgtgggaggtattggagttgtgaaccaaattgtgatttgtgaatttatgacttgaaaacctagccaagctgtaaggaaagaagtactaagtggggaaaagggaaagtattgtccagctatttctgttgttgttagcaatccatggaaggattaatagaaagaattttaaacattgattagacctgccaatttgcactgaatacctctatcatttggccatctgttgatgtgtgtggataatttaaatccatataatagtagatatcaattagtctttttctttgtttctcttaaagcactgaagataaaataccctcatcaacttgatcagaaagtcctggagaaacaactgccgggtaagaagaaccagcctgtcttttccttaaactctgaatcatcggcctaggtatgagtcagctaaaattaaaacctttaactcatgtctcaaagtgtggacctcagaacttacaggttttcattagtcttttatattctaaaatacaatcaatcatgctaatatcactcccccatgcccccaaaagttcaggtctcccctaactttatcagctgaaagcagttctgttaaaattggaagcccctgcatataattacacacacacacacacacacatatatatatacacacacacacacaattttttttgagacagggcctcactctgtcacccaggttggaatgcagtggcaccaactcagctcacggcagcctctgcttcctgggcccaagcaattctccagcctcagcctccacgtagctgggactacacgtgcgagccaccaacgcccagctaatttttgtattttttgtagagatgggttttcgccatgttgcccaggctggtctcgaattcctgagctcaaagccatcctcctgcctcagcctcccagtgttggaattaattacaggcatgagccactgcagttggcctaagttgtatttttaaccaaaaaacctgagaccttgaatggcatagccttttggaagcattccccaagcctgctgctgtttccagggagactgtgacactgggtttggggtctgcttctcatcccttcataagagaggagctgtgtcctggtgaaccaaattcttacgggaggtttgtgactttgcttacattctacttctcctgactgattaggagtccctgcaaaaacaattcgcagatgctcttttaatggacaccctgaaatggttttctttgagaaagctaccttagaacttaaaaaaattgtggtactggaactgaattacttttatttggaaaataaatatgcttgtgtcaataaagtagatcaacataacttaccttaaactttcactcaaaagaaaaatgaaattatagtctatttttgagtatgccatgatactgtgaattctcaagattaaacttgattcatagctaaatgctaaaatataaataatttagagcagtgaggatttaaataaatgaaatacacatcagcttaatgactctagtacactgggtttctttgcccatcagtgcagtaaattcacattgatttttaaattagtttctatcagataaagcaagcttatcatggtattgcttatagaaggccttagttgtgttcaaagaagtacctttctgattgataaccatccatttaatttaccacaacgtctccatttttatttattcacaatccagtttctactcctgtaatatgtaatttggctactgctatataatgggttagaattagtgatttcccccttcattattctgttttcaaacttagacagacagtaaaggccctggtggagacagactagtcaaagagggccaggactgttttatttttgatatatttttttcagatggggtctggctgtcactcacgctggagtgcagtggtgccatctcagctcactgcaggctccatcaccttgatcccgggctcaagtgatcctcctacctcagcctcctgagtagctgggactataggcacgaaccaccacaccccgctaatttttttgatttttagtagagatgaagcctcgctatgttgctaaggctggcctcaaactcctgagctcaagcagttctcctgtcatcacctcccaaagtgctggggttataggtgtgagccaccatgcctggcaggccaggactttctgtgaatgtttttggccttcgatgtctttgcgtgtttccttttgcctttgcagatacatcaaatcaattcatgggaatgttaccactatagagtatttgctcaagaatattgtcattagacctgtttcgttaagctttccttttcagtctttctctggaaggcactgaggtagacctgccaaggcctgccgtctgggcatatgcctgaatgcagcccttggctgggggtgacagtgccgccttacccttctctacttccacactgtacacctgactggtatcccaggtcttctgagattcagttagccattttgggaacacccactgcattcatgctgtttttattaatctttgggtagctagcagagattcgactatccatagaaattatatgtaagaattactactttaaactattcagaatctgagtcctatattctataaattcagcagtaagccagcagattacaagggttcctttttttccccttttttatttgcttttctgtttctcaaatgtgcactcactcactcactcatacaaaggttcttaatactaattcttatgccacatgctgtgaatatttaaccactaacataggtaaatgtcttctaaacagaaaagtaatagccaggcatggtggctcacacctgtaatcctagcactttgggaggccaaggtgggcaaattgcttgagcccaggagttcgagaccagcctgagcaacatggtgaaaccccgtctctacaaaaataaataaatacaaaaattagctgggtgtggtggtgcatgcctgtagtcccagctgcttgggcggctgaggtgggaggatcacttgagcctgggaagttgaggctgcagtgagctgtgattgagccactgcaatctggcctgggtgacagagtgaggccctgtctaaaattaaaacaaaacaaaacaaaactgcaatatctttttttttatccattagattagcaaaattaaaataatactggctggcatgaaaaagcagtatacccttttttaaagtcatgtgggaactactataaaaagttaaaaatacacatatgctctgaccaagcattgtatcttgcagcatttgtaatggtaaagatagtaagaatctaagtacttgccagcggaggaatggtgaataagctctggtggaaccacacagcacacaaggcactgtcgtgtgtcaccgaggagagtgaagcagtctagagctgcgctgtccagtgtggctgcaataaccacatgtggctatttaaattcattaaaataaaataaattgagttcttcagtcatactcgccgctttccaggtgctcagtaccacatgtggctgccatactgggcagtgtatggctagaggacatggcatggaattggcatgaaaagctataccatcatgtcataaagaaatacaaatgtagtacgtcaatatattataaaacctatacatccttttttttttgagacggagtctcattctgtcacccaggctagagtgcagtggcatgatctcggctcactgcaaactctgccttccgggttcaagcaactctcccggcctcagcttcccaagtagctgggataacaggtgcccgccaccatgcctggctaatttttgtatttttagtagagacggggtttctccatgttggccaggctggtctcaaactcctgacctcagatgatccgcccgcctcggcctcccaaagtgttgggattacaggcgtgagccactgcgcctggcttaaaacctatacatccttatatgaacacagaaaaaaaaaggcctagaggtatacctctcaaatttttaacactggtcataggcaggtaaaaagaaataatcagctatttccatattttctgaatgttaagacagtcatgttactatattaaaaatggtaatgctatttattacatagagattgctactttcttctatagaaccggtatgagtaggcaggttttttttttttttttgagacaggttctcactttgttacccaggctggatggagtacagtggcgcgatcatggctcactgtagccttgacctcctgggctcaagtgatcctcccaagtagctgggactagaggcgtacatcgctatgcttggctaattttttattttttgtagagatggggtatcctcatgttgcccaggctggtctcaaattcctgggctctgatccctctgcctcccaaagtgctggggttacaggtgtgagcaggccaggcagatttcttattagaactgttttatgaccaaactttttgtttctggcatgtgttaggagtatgtcactccccactggtgtgcagcaggtaaccccttctctcaccagccttcaaacaatgaaagccagtccgtctcaatcttttgaaaggactagactatcacatattcacacatgaaagagcaaattgttaattaaaattataaattctattaactgtattcaatacatacaaaaaggccagtttttattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccagggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaatgattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaagagtacttaaattaatcacatgcttttccctacaattatacctaagctgagtatatcttcttctgtgataaccagctttgattgaaatgtactcatattaggtaaacattaggcaatgataggaggaaagcaaaactaattctttcaaaatgtcaacaaaatttagaaatatccttcccgatggcactaaaaccctgagaggtatttgcttttattcatactcacacaactttagcatttaaaaactatgagtactaaactgtgaccttcaggatttatgttagatggcagaaagaaaatttgggtattagtctaccatataaatgaacttctttaaaaccaaggttcagaactgagaatcatattggttcctcttcaagttagttcaagttgcccacttcagagatccacaaaatctgacattatttccagaaaccccaaactttggtataagtgaccactgctcaaatatgtgatcacatgatcacacagcattcctgtgagttcctttttgtctgataattatcctaattagctctacagagctatcctgcaatccaggttgaaattcaaactctcagttactactacagatttctgaactaggccaagttttaaccaaaaactataggtaatggtgaattactaattagccacaatgcatcaggatttagaaatattttttcttttataaaataacttggtatttttctgataatcttccaatagataaataaaaacttttcttatgctacagtacaagttgatttttaaggaaatttgtgcaaacattaagaaacaccgcattggttctgggtgaaagtgccagtctggaactctcttgaaagaccatacagtctactgctaaaccctgggactcctcagacttgcactcagattatcgtttgcctgccctgattttagactctgctaattcaagtccctgttatcttgcttgacatcgacaaggatcaccgcaccgttccttcagtttccacagttccgtcagttcccacggagaatactgaggagaagacagcattcctgtctcacaggtcttctcacacagccacagactgtcctgttgagaaacaaccaaagccgatctgagagtggtgaaactgttttaagagcatcagaaagtatgcacgtagacagcttttatgtattctaatgatgctgaaattatttcaaggataactccgtgtgtggaacaactggtgaggtttgggggtggcacctcctgatttgggaaagcaccaggtcccacagtcctgtggctgtggaatacagaaacaaggcggtgtgtggatgaagagttagtcaacaaatgccattccgtaatgaacgattttagaaaccacaagtgagtttcatgtttgctagtaaaggtgtgtctatggcagtattagtaacagctattattctgatggaatgcttacaatattgcagggactgtaccaagtgctttgtaaatatctcacttaaatctcacagtaatgctgtgaggtaggaactatttccctcttaacaattgaggaacaaacgaagagttaaaaaacttgttccaggtcacagggctggtaaatgaagaggagggattaaagactcccaagctcaagttcttaaccactagactatttcctagctacgtgaattggtttctatttccagcaatgtagcagaacacagagagaaactcattcaatgttttgacaacacaaaaatgttggataaaattaaaaacctttataaagcatggctcaactccgtgatcaaagaagaaacagggtaggagaaagcgctgagtcagcctgtgccttgaaggcagctgctgatccttgggtttggaaggccaagcccagggtcaggagactaatgggagactgacacagagctaggatctctgaggggccacagcctcaggggtgataaaacaaaacacactcagcttgtctgtctcagtcttgcccctcagtgggatggaaaggagtctctctcccctcagtgcctacccacagcttgcacttaggtaggtctggggctggtagtcagtctgtgtaagcccaacagttccaagccaaaaatctgaagtattcatagatggtagtattcctagatgcatggcagaaaaaaatgtaaatatgtaaatcctctctgtaggaatgcattttaaatagaggactcagtttccaaagacatgagatggtcacaaaaaaaaaaaaaaaaaaagaccgcatcagaaaacaagcgccatgaacaacagttgtagaaacaacaaactgcaaaatcagacccagcaaagactacagatcccagaattaccagatacaaaaaagaattatattcaaagatgagacaaagtacagcaaaggaatcagactatcaaagtggaccatgtagatgtgggttgatttcttgtcctggactgagagctgctctgggaccccagctctatgcagggcttctaactgacagacactgcatgtgccttctgtcccctgcaccttcgatggccaaagtggaagctgcaagaatccagaacagaaatctctgaagctaaagccagctttgtgcttgatttcttcccagggctctagtttccattttggtctctgcagattcatttttttttctggttcagcaatactgtgttttaaatgatgtcttatatttcatgcagtgtcttatttttatcggtcagaagggttgaaggatccttagactgccacactcaatcagtggattctgtcgttcagttttttttttgagacggagtctcgctctgtcgcccaggctggagtacagtggtgtgatcttggctcactgcaagctctgccccccgggttcatgccattctcctgcctcagccttctgagtagctgggaccacaggcgcccgccactatgcctggctaattttttttgtatttttagtagagatggggtttcaccgtgttagccaggatggtctccatctcctgacctcatgatctgcccgcctcggccttctgttgttaagttttaaagctgcaaataatttctgatcaaatctatggaaactgagtttttttgtaggcaggggaacgttgatttataaccttttgctttaaactcagaaaaatactgtatgagaaataacctagtggattattgtgaattaaagcaacagcataactattatggtagaagatcctcattctttctgcccatggtgtgataaacattacaggttgagcattccaaatctgaaaatttgaaatccaaaatgctccaaaatccaaaacttttttttttttttgagacagggtctctctcactctgttgcccaggtgggagtgcagtggtgcattcacagctccctgcaccctcgacctcccaggctcaagttgatcctcctaccttagcctcctgagtagctgggaccacaggcaggcgctgccatgcccagctaatttttttgtagtttttgtagagacggggggtttcaccatgttgcccaggctggtcttgaactcctgggctcaagtgatacacccaccttggcctcccaaagtgttgggattacaggcatgtgccactatgcccagcccaaaactttttgagagccaacatgacactcaaaggaaatgctcactgaagcatttcagattttcagatttggaatgtgcaacttctaagtataatgcaattattctaaaatccaaaaaaatctgaaatcctaaatacttctggtcccaggcattttggataaagaacactcaacctgtatatagaaatccacctcctcaactcttaagaaccctgaggccatccccaaagacttacctggtatcttttaggtcctatggcagccatccagatgcccatgcttacatcttcaccctatacatggcccataaagtttaaatgtaaaaattttaatgctattttatttgtaaagacaaaaccatagccactcccatcataaaccacctttctacttttttgctctgttattattctaatatgaaatagcaaaaatgggttcacatgaagtcaaagctagtggtctttaatatgaagcacccctgccacaaggtaataagatgaaaccgcgagcagacgacccatccttctcatgtaccttaagcttccaggaagcacttagggcttcctccttaggaataaaaatctttctattcctccagggactatactttttttttttttgagacagagtgtccctctgtcgcccaggctggcatgcagtggcgcaatctcagctcactgcaaactccgcctccgggttcacatgattctcctcctcagcctcccaagtagttgggaatataggtgtgcgcccagctaattttttgtatttttagtagagatagggttctgccatgttggccaggctggttttgaactcctaacctcacgtgatctgcctgccttggcgtccgaaagtgctacaattacaggcatgagccacagtgcccagcctccagggatgacacctgtaaatactagctgaaaacataataagtaggctcaaaaaagatttaggaatagaatttaaaggcaagatttgagggatgtaggggtgcatccttaacctttgagaggtgattcctatacagagaataacgtgcttttccccaaggtaagtgggttctgctttccatgatgggatgccgagtgagatgaaacttggtgtgatgagtgtatacgtaggtgggaaatccttaattttttgtttttattttattttttattatagagatggggtcttgctatgttacccaggctggtcttgaattcctgggctcaagtgatctacccgccttagcctcccaaagtgttgtgattactggcaagagccaccacgccaagctaagaaattcttaattacctgataggtctttaacctccccgagttgcttgccagccacttgacgatgtccttggagatcacatatcctgacccacatgcaaaggcagggtaagcggggctcgggtactccaactcctgccactttccggttcggtcaactgcccaattcagtctgaaactgagatgaaaaataatgtggcctcttgtgttagtctgacacatatcctgccactattaaaacttgactcctttatcatcactacaaaggaataagcttgtagaagtgaggaaagaaaataagaaaatttctttttttttgagatggagttttgctcttgttgctcaggctggagtgtagtggtgccatctcggctcactgcaacctctgcctcctgggttcaagcaattctcctgcctcagcctcccgagtagctgggattacaggcgcacaccatcatgaccagctaattttttatatttttagtagagacagggttttgccatgttgtccaggctggtcttgaactcctgactttgggtgatccaccctcctcagcctcccaaagtgctgggattacaggcgtgagccactgcccttccagaaaaaaattttcttaatctaaggaaaggaattatcatttatccagtgttgttttagataaaagattggttatgttaaattttctcaaagttgcatttgtagagtttctgaatgaaaagcactagaagatcaccctgtgttttagtatatatgaaaacaaaaaaccaaatcactaatccatattgtattcctgaggaagcacagaaaatggtttcagagacgtgtcacaaacgtactctaacaaaatatacagtagcttctaatgtgaataccatttatttctttggcataagaataaaagccatattgttttccctcctttactacattagcctgaggcttttcatttaaaaaataatttcctccaattgtacagtaatataaaatttattattattattaagacagggtctccctctgttgcccaggctggagtgcagttgcaaaatcatagctcactgcagcctccaactcctgggctcaagcagtctccctgcctcagcctctcaagtagctaagggctacaggctcacatcacctttttaattttttgtagggacagggtcttgcaacgttgcccaggctagttttgaactcttggcctcaaaggatcctcccacctcagccttcccaaaactctgggatgacagatgtgagccagcatgactgacctagagtaatgaaatatatataaacccaggagtctagtacgaaattgtatatctcaaccacattttcaaaaaaaaaagatattttatgctttattaattacatttgatcaggtacacgaatgccaatgggctaagaatggttaacttactttccccaccaaaaattaggcccatccagattcttttggacaatcctattaaatacagcttcgaggtctatgtaacagtcatcatctgtcttcagcaacaaattgaagctcgttgtttccacagtcctgttgacacaaaagggataagaaagtcagtgcgaccaaacaaacaaacaccaatgcagtggcgtcactaacactttcattcaaaactgtacctgtcattatctaaatttcttattcctcaaatgttgagaacatttgctctaacaaaattttgctgctatcaactaaggccatcacttggtctttactaaatggcataacacagagaagtactaacctgattttaaaaggcaaagaaagagcatattgaaggaaaatatctggcttaaatggaacatatgttcaaacaaatgcttcttaggcatcattcaactcctgctgccaaatctattaaacgcctgaaccttgccccgtgtgttcttaataacaaaggcccagcataatgaattaggtgttacatctgggcctctcacacagaacgctattgtacaagatgcatccgatgctatttatattacactcaaaatattttatggcttaaaaaaacctgacttattacattgaaacatattttcccttggaaacaacttctagcaattaaaccattataaatgaccttctggaaggcaaaggatagtgacttcattatctagacgtaaaatatataatcatgactaaagacaaaattgactccttcatttcacattgacagtccctgtacatctgtttaaaaatgcagttttgctagggtgccagtcatatgtcagaaatctcaataaaataaatttagaatttcattaggtccaagaatggtgaatttaacaataatgggtccacaccaaatagcatcaccccatgtttctaaagtttatttccaattaacagcagaaggcatacataatatttgctaattagaaatttcatgataaagaatatttaggtcactgataactgaaataatgaggaagaaataatgaaactcatttgtagtgtggagatgggtgatgccagctatggggacgcaggtcccagatcagagtcctgttgaaggttactgcagcgatccagggagagaaggtggcagccaacaatagcggcagcggagactaagggagaggctaagatacttccacgcctaggaaatatcttgctctaaagagtatccggggctgactcttagccctgacttcccacccttgggacttccatgcccattcctcatctcagcctcacctacaattgcaactctcatttgcggccccaaattaaaaggaggttctttttcttactacagctgcctaaacttaacctagtattcgacacacccagatttccaaccctcatttacctctgctctctactcacaggatgagtcccaaattatattaatttgccccagcaggccaggtgtggtggctcacgcctataatcccagcactttgggaggccaaggcaggaagactgcttgagacctcatttctattaaaaaataaataaataaataaataaataatttgccccagctaagaaacattaccttccataaaccaattagaccatctacccctcaggaccagggaactgtatccgtaaagtactgttcttggtaacttcccactctgcctagggcaacagagaagaaaagaaagagacagaccctgggcctcacaccaaggaacagaagaaggtttttaaaaataaaagtgaaaaaaataaaaagtgaataccctttataggtttggcctaatcagagataggtttgaaagttttggctccatggtcaggacagacagtaccaggaaactcaacataaaattttgagatcctagagtaactaataattctaataactatacgttaagattatatagatatataatatgtatgttactattattatatattgttgctgttattcttgttataaaagtaggaattaaaagtaagttccaagaaacactggagggtctgggaaattataaatatgatagattctgggagttgtggaattttagtaagccagccacgtaagagttttagaatcagggaggtagtttttaaacggatggagtagagactggaagtataaagtggatattcagtagaagagaatgcctatcagtaacctaaatgtgagtgactataactggggaatctgggtaggtgggtataaatacaactaaaaatggaccattcccaaactcactgatttttatctaatgctggcttgagacaaccgaggcaagcagaaatgactcaaaatgaatcaactttttttttttttttctttttttttgagacggagtctcactctgctgcccaggctggagtgcagtggtgtgatcttggctcactgcaacctccgccttctgggttcaagtgattttcatgcctcagcccccctgagtggctggcattataggcgctcgccaccacacttggctaatttttgtatttttagtagaaacagggtttcaccatgttggccaggctggtctcagactccagatctcaagtgatctgcctgccttggcttcccaaagtgctgccggcaggcataagccaccagccaatttttgccgtgtttttgataggttaatatcacattgtggatctttatcaaaataaagtggcagcatcttagaagctcagttttcgcaaggaactgggatacaataggtcatatcccaggtgctcagtgtccttaggtttgtttttatttgctgaaatctcagtggtttgaagttgataaattgtctcgatagcaaaagaacaataaggcacagtgtcatgtgcctgtaatcttacctactcaggaggctaaggcaggaggtttgcctgcactcaggagttcaagaccagcctaggaaacccctagtaaggggtttccttacagcctagtaagaccccatctcaaaaaaaaaaaaactaacaataaaacaagttctagctacccaacatttttacaacctaccatctatagaagttcaataattttgcaggaacattacgataagtgtcgacaacatccacaaaaacaatatcatcatagatgctgctttcctccttcagtaaggcatcttcctcatggagattccttatatgatcaataagtctttgagggcgagaatgaaggttgtgtaagagagcatcaccttctataaaggaaaagttgagagttggagaaaaatgctgttgtaaagttaccattcagaactgatgatgtacactaaagttcttttcccaaggtaacccagcagaaacacatgcagttgtttggaactttaggtagaaaaatgggaactctcatacactgccagtaggattaagtggatgctcccactctggaaagcaatttggcaatatctatttaggctgaaaatgtgtacaccttatggttcagttgaggccacttgtagatatatccctactaacattatttcacatgaggatattaattacagcattgtttgtaattgtggaagaaaaatgggaccaacctaaatgtccactgagagaaaaaaaaaaaacagccaagttgtggtatattcacataatgaaatatagcagttaaaaaaattaccctgatcttgcatgttaaaaggattgggatgaaaaaataaagttgagtgaaaattgccaagtgataaatacaatatgacaccacagatatcaattataaaacactcaaaactatgttatttaaagacatggtcaggcgtggtggcttatgcctgtaatcccagcactccgtgaagccgagggaggagaatcgcttaagcccaggagtttgagatcactctaggttatatagggagaccccatctctaaataaaatttaaaaattagccaggcatagtggtgcatgcctctggtcccagcttcttgggaggccaaggcaggaggatccctggagcccaggagttcaaggctgcagtgagctatgattacaccactgaactccatccagcctaggcaacacagcgagaccctgtctcaaataaataaataaataaagagacgtaaatatgttcaaagtagaaaaataagaatgggaagggtacacatgaattttagggaagtggcaccccctttgaggagagggaagaggaatacatctagggagaaccacaaggaaaaggtttcaactgtacctacaatgttttcttttttttctttttttgagacagagtctcactctgttgcccaggctggagtgcaatggcatgatcttggctcactgcaacctccacctcccagattcaagtgattctcctgcctcagcctcccgagtagctgggattacaggtgttagctaccacgcccggctaatttttgtatttttagtagagacggagtttcaccatgttggccagctggtctcgaactcctgacctcaaatgatccacctgcctcagcctcccaaagtgctgggattacaggcgtgagccactgcaccaggcatataatgttttctttctttcctctctttttcttttttgtttttgagacacagtctcactctgttgcacagactggagtacaatggcacgatctcagctcactgtaatctccacctcccgggttcaagcattctcctgtctcagcctccctcatgagtagctgggattacaggcgcctgccactgtgcccagctaattgtttgtatttttacaaacaattgtaaaaattgtttgtaacaagaggcagggttttgccatgttggccaggctggtctcgaactcctaacctcaggtgatccacctgcctcagcctcccaaagtgctaagattacaggcatgagcgactgtgcctggccatgttttatttaaaaaaaaaaaaaaaaaattagaaatgaataagaaaaaatgtaaataaaaaattgttaattctgagcactgggtacctggctgtttctgtactatttctggtgtatttatgattatttcctttgtttttttttttttgagacagggtcttgttctatcacccgggctagaatgcagtggtgtaattatagcttactgcagcctcaacttcctgggctcaagtgatcctcccacctcagcttcccaagtagctggtactcccggcacctgtcaccatacccaggaaattttcaagttttttgtagagatggggtctcgctatgttgtccaggctggtctctaaatcctgggctcaagagatcctcttgcctcccaagtttctgggagcctcccaaagttctgggactacaggcgagagccactatgcctggccatgatatttcataataaaaatgattactaatgtgcttaaaagacaatttatttgccacttcacaagttaatgagtcacttgtcacgtgtgcagggactgtccccagatcctactgatttaaggcaattctttcgctgtggcaggagacgtcaggatttcctaaaaatgtctcaatcaaattaaagaaaaattttgaaaaatacaaagaaaatgagctgctgagggtggcaaaggaaatgaaatacaatttagcactgcactctttgtcactgcaaatggaaaggatgaggtgggaagctgaaggcctatatctgacttctgcctctcatgacttgtgagatactggacaagttctgttgtctctagaccacagcagtctcacctgtagaaaatggtgctggattcaatcagtgattcttgggaatgcttgctgaaatgcagattcctgggccccaagcctaaagattcagtaggtctggggtggagcccaggaatctattttttttccttctgcacctgctcccaggaatctatatttttaatggccactgctgcgaccctgatgcaggtaggcagaacacagaccagcctttgagaaacacaggggtagatgacctcctgtttttttttttttttttttttttttttttgagatggagtctcactctgtcacccaggctggagtgcagtagcgctatctcggctcactgcaacctctgcctcccaggttcaagcgattctcctacctgagcctctcgagtagctaggattacaggcgtgcgccaccatgcctagctaatttttgtatttttagtatagatggggtttcaccatgttggtctggctggtctcgaactcctgacctcgtgatccacctgccttggcctcccaaagtgctgggattacaggcattgagctactgcacctggcctgacctcctgtttagacttacaatttttggactttacgataatgtaaaaacaatatgtgttcaccagaaaccatgctttgagtacatatgcaaccattctgtttctcatgtgactacagtcttgtgagatgttcaacctttattatggaataggctttgtgttagattattttgcccaactgtgggctaatgtaagtgtcctgagcaagtttaaggtaggtgaggctaagctataacattcggcaggctaagtgtatgaaatgcattttcaacatacatttttaacttaacatgggttcaacaggatgtaacattgtaagtcaaggagcatctgtataatttaacacttgatggaaagtgaaagtgttataaaattgtaacaggaaaatggcttgtaacaacaggagtgcagaaattaaatacaagccttttagactagtaacacattttgtttcactgcatgtatctgaaaaatatgagcataaattaatatgtcaggaaaatgaaaggatgtctgcttttgccacttctattcaacatacatgttctagccaggacaatcagataagaaaaaaggcatccagattgaaaaggaagaagcaaaactctctcttcttacagatgaaatgaccttgcatgtagaaaatcataaggtctaactttaaaatgattaagtaataaatacatggatctgttcagcaatgttgcagcacacagatcaatcacaaaaacaatctgtatgtctatatactcgcaatgaacaatcttaaaattaaattagaaaaacaattccacttacaacagcatcaaaaagataacataagtatttaataatttaacaaaagaagtgcaagacttttatactgaaaaatcaaacatcattgaaggaaatttaataagacatggatgttcaaagacttaatactgttaacacggcaatactccccaggttgatccacagatagaatgcaatccctgatgggaatgtgaactagtacaaccactatggaaaacagtgtggagattccttgaagaactaaaggtagatctaccatttgatccagcgatcccattaggaaagtaagtcattatatgaaaaagatacttgcacatgcatgtttatagcagcacaatttgcaactgcaaaaatatggaaccagcccaaatgcccatcaatcaatgagtaaagaaaatgtggtatatatatatataccatggagtactactcagccataaaaagaaacaaaataatggcattcacagcacctgcgtgcagctggaggccattattctaagtaaagtaactcaggaatggaaatccaaacatcgtatgttctcactcataagtgggagctaagctatgaggatgcaaaggcataagaatgatacaatggactttggggacttggtggggacagggtgggagggggtaggaataagactacacactggttacagtgtacactgcttgggtgatgggtgcaccaaaatctcagaaatcaccgctaaagaacttattcatgtaatcaaacaccacctgctcccccaaaaccgattgaaattatatatttattcatatatatgcatatatatatatgcaatcccttaaaacattccagctaggttttcttttttttttttgcacaaattaacaagctgatcataaaattcatatggaagtgcaagagacccagaatagccaatcaagcttgaaaaagaacaaggttggaggattcacatttcctaatttcttttttttttttttttttttttgagacggagtcttgctgtcacccaggatgaaatgcagtggcaatctcagctcaatgcaacctctgcctcccaggttcaagcgattcttctgcctcagcctctggagtagctgggattacaggcgcccgacaccatgcctggctaatttttttgtatttttagtagagacagggtttcaccatgttggtcaggctggtctcgaactcctgacctcgtgatccacctgcctcgggctcccaaagtgctgggattacaggagtgagccaccgtgcccagcctcccaatttcaaatcttactaaaaagctacataatcaagacagtgtagtactggttaaagacgcagacacatagatcaatggaatagaattgagagtcctcaagtaaatccttacatctacagtcactgattttcaacaaatgggtgctgggacaactggatatccacatgcaaaagaatgaagttaaacctctatttcatgccatatatgaaaatgaacatggatccaagacctacgtataagtgctaaaactataaaactcttggaactgtaaaacaaaggcacaaatctttgtgacctcacattagacaatagttccttacatatgacagcaaaaacatgtgacaaaattggacttcatcaaaatttacaacttttgtgtgttaaagggcaccatttgcaaagcatgtatctgataagggacttgtatccagcatatataaagaactcttacaattcaacaataacaaaataattttataaatgggcaaaggatctgaatagatatttctctaaagatatacaaatgactctctctcccctcctttcctcccttcttccctccacccctccctccctcaccaccttctccctctctccaccccttcctccctcacttcctccccctcctccctccctcacttcccacatctagctcatataccataataattcaccctgttaacagtgtgcagcctcagcaatatgacaaaaccctgtctctacaaaacatttaataattagctgggcatggtggcatgcacttgtagtcccagctattcgggaggctgaaatgggaagttcacttgagcccggggaggtcaaggctacagtgagctgtgatcatgccactgcactccagcctgggcaacagagtgaggcctcgtctcagaaaaaaagaaaaacaacgaaacaaaaaaggaagatatacaaatggccaataagcacatgaagaaaatgctcaacatcattagttattatggaaatacgaataaaaatcacaatgaaataacaatttacacccactaggattggtatattttaaaagacagacaatttattaagtgttgacaagaatatggagaaactagaatcctcatatactgactatggaaatgtaaagtgggctgctgctttagaaaacaacctggcagtgcctcaagtgattaaacacacaattatatgacccaggtcttctactcctagacatttaagagaaatggaaatatatgaccacacaaaaacttgtacctacatgtttactacagaattattcatattcaaaaagtagaagcaatctaaatgtccatccattaatgaatgaataaaatagggcatatcgatgcaatagaatattatatgatcataaaaaagaagtactgatacatacaaaatggacagacctggaacacatgttacagcaaagaaactgacacacagagtacgtactgtgcatttccatttatgtgaaatgttcaaaacaggcaaatccatagagaaagaaagtgcatcagtagttgttagggggtggggggttggggaggtaagaatgaggagtaactgctaatgggtgtggggtttccttttgggaggtggagccggttgtagaactctaagaatacactaaaaccactgaaccactttaaaagggtgaattttatctgaataaagttttttaaaagacaaaaaagaaaaaatccttttctctcaagtataaagattaagtgtaagacattcagtgtacttttcaagtttcaactagcaaacttaccctgaatagtatatataaaaccacctgcaactccctccacaccttccaagaattcatgaggcaatgcaccctccccagcctgaaaggaataagaatgtactcagtgattcattactaaaaatacactgatcatattttaaaatcgatttgacaaaaatcataatatgactccacttgcagcagataaatgcatgtaagatgctggtgcactggaggcttataatatcaggatgacatacggtattctactatttttgttatctaattacaatactaaagataagatatacccaacattccataaggtgttcagaattgcaacttacatagaatcatgtttatgtacttgctactctagtagtacaaaaagcaattgattttacatcccaaccccaccacttaaaaaaatatgtattacgacctttgattttttggaaactaaaaattctcatgagttcaaatacatcttggcatgctttaaagttaagagaccatgcagagaaaggctcaaaattaacagtctgttccaaatattcaaattgaactctactgtatattgattaaaaaaaaatttttttttaatttttaatttttcttttttttttttttcaaataagagacagtgtttcaccatattggtcaggctggtctcgaactcctgacctcaggtgatccgcctgcctcagcctcccacagtgctgggattacaggcgtgagccaccacacccggcctaatttcattttacagacagggtttcactctgatgctcaggctgagtgcagtggtgcaatgatatctcattctagccttgaacatacaatcttcccatctcagccttacaagcagctggcactacaggtgtgcaccaccatgcccagctaatatttataaattttttgtagagaagaggtctcactgtgctgcccaggctggtcttgaactcctgggctcaagtgatcctcccgcctcggtctcccaaagtgctgggattacaggtgtgggccactgtgcccagcctgttgatgttgttgaaggtgcttaagcctattgtgccagcagccaatgacagtcctttctacttcttagaatggagaatcttttattattaaagagttatctctcttcaaaagttacccaatggccttactcagagtgaactgttttacttctgtatacagtaaaccactatggtacatctaccagagtattgtctggctgttgtgggctagatcagacagttaagagtccatactcagtgtatttacagtattttttctacaccttcatttaatcaagagagctactgcttggctattcttaaacagatcttttcagagttgtactgtacaaagcaatgttttaaggccagtagaagaagtaatctgaggtcactgtagtaacttgtcatttaatttaaaatatgtttgtaggccaggcgcagtggctcacacctgtaatcccagcactttgggaggcggaggcgggcggatcacgaggacaagacatcaagaccatcctagctaatacggtgaaaccctgtctctactaaaaatacagaaaaattagctaggcatggtggtgtgtgcctataatcccagctactctggaggctgaggcaggagtatcacttgaacctgggagaaggagattgcagtgagccaagactgtgccactgtactccagcctgggtgacagagtgagactccatctcaaaaaaataaataaaataaaataaaataaaagttcgtagccaaatgtgaaaattactaaaggggcaggctatagattccaacgttgtagttccataaaagactgtatatgctttatttgttatttacttatttactttttttttttttttttgagacgaagtcttgctcttgtcccccaggctggagtgcgatggcgtgatttcggctcactgcaacatctgcctcgggggttcaagcgattctcttgcctcagcctctcaagtagctgacagtcgcctgccagcacacctggctaatttttgtatttttagtagagacggggtttcaccatgttggccaggctggtctcgaactcctgacctcaggtgatccgcctgtctcggcctcctaaagtgctgggattacaggtgtgagccaccgcgcccggcctacttatttagttttttgagatggagtttcactcttgtcgcccaggctggagtgcaatggcgtgatcttggctcactgcaacctctgcctcccgggttcaagtgattctcctttctcagcctcttgagtagctgggattacgggcattagccatcacgcctggctaatttttatatttttagtagagacggggtttcaccatgttggtcaggctggtctcgaactcctgacttcaggtgatctgcccaactcagcctcccaaaatgctgggattacaggcgtgagccacagcacccagcctatgctttattttttattgtatatttctatattgttttggctttagaactcaatagtaatttctgtttattaacttctctctaaaaggtcacaacttggctttttgcctttaaaatttttctgacatcacttgctggcaagggaataaagcttagtgaaaactctcagctgtacgcatttgtgatgaaaatcttaatttgtacctggggtttcttagcgtaggctttaaaaagttacctggttttgtttttgtttttttaggttaactgtatgtttaagctatctttagccctctataataatttttactcccaaaggcagatcatttgagtctttacatttgaacctagttctcaactcagaaacctaccttttttttttttttttttttgcgacggagtctcgcactgtagccaggctggagtgcagtggcgcgatcttggctcactgcaacctccacctcctgggttcaagcaattctcctgcctcagccttccgagtagctgggactacaggcacccgccaccacagccagctaatttttgtatttttagtagagacggggtttcaccatgttggccaggctggtcttgatctcttgacctcgtgatcctcccacctcagcctcccgaagtgctgggattacggcgtgagccaccgcgcccggccaatttatttcttttagtgtaaccaatattatagaattttggcatatgctgggtattttaaagtttcataaatagaaaaggaggcaagataataaggaaagatataattccataaaactttctattttcagtaaaaaatttttcataagacttaaaatgaactttagtaaacaagtggtgtgtgtgtttactaaagtaaacaccatctttattgtcctccatttactttatgaaatttacctgtcataataaatcctaaatcctaaacatgaatgaaatcctaaacatggcctacaaatctaaatgtataactacatatgaatctatgggtctatttgtttaatgtctttcttcctcactggactgtaagttccacggtgggccactagtatgtctattttaccctgccattgtttctgccttaccacaggtatgcaggaaatgttttttgaatgagtaataacgtagcatatattcatttcaactcagaaattaatccatgtaaatgaggttaatattcattcactaagcttgtgaatttaaatgccaagtacattcctaatcattggacaggagatcgaggagaataaaagattgtctatgattccaccgtacagaccgtttgtttactaaagttcattttaagtcttcatatacctgctttattgacctatatttactttgagaaattcacctgtcaaactgttttaaatttaaagcaaagccgaatgagaaatatgagagtcagaaatcccagagttgcttcagcaaaataaatgaaagtactcaatcttattttctatttttttttgttttgttttgagatggagtctcgctctgttgcccaggttggagtgcagtggcatgatcctggctcactgcaacctccacctctggggttcaagcaatcctcccacctcagcctcccaagtagctaggattacaggcatgcaccaccaggcccagctaattttttttttttttggatttttagtagaaacggggtttcaccatgttggccaggctggtcttgacctcctgacctccagtggtccacccaccttagcctcccaaagtgctcggattacaggcataagccagcacaccccgccttattttccaatatttttatctatagtagttttttttgtttgtttgttttttttgagacagagtctcactctgccacccaggctggagtgcagtggtgtgatctcagctcactggaacttctgcctcctaggttcaagcaattctcatgcctcagccacctgagtagctgggattccaggcatgcgccaccatgcctggctaagtttttgtatttttagtacagatggggtcttgctatgttgcccaggctggtgttaaactcctggcctcaagtgatccacctgcctcagcctcctaaagttctgggattattggcatgagccaccgcacctggctaattatagtattttaactgaggttttattttcaaggtgagatagtaaatactctgaatactactgagcaagtattcttaaagaatgctaacttaaaaattactgagaaataggccaggtgcagtggctcatgcctgtaatacagcactttgggaagcgtaggtgggcggatcacttgagcccagaagtttgcaaccagcctaggcaacatggtgaaaccccatctctacaaaaaacacaaaaagttagctgggtgtagtggtgcgcacctgtagccccagctacatgggaggattgtttaagccaggaggtggaggctgcagtgagctgtgatcgtgctagtgcaccccagcctgtgcaacaaagtgagaccctctcaaaaaaaaaaaaaaaaaagagaaataaaatattgcattttaaaaatgcatcaatcttaaagcaaaactgtaaactcactaatgctggagttacaggatcatatttgagtttttgcctttactatgaagacaacaacatttgctactatatatgttgtaaaacacacaagaatcattgctccatgctgcctgggctctaaggtaaattttagaacaattttatatattaaaaagaagctaaaatatgcaattaaaccttaaaaaaaaacgacttactgtaatgactctgagaactccccctccatcattcactgtcactttgtggagatttcttgacacaaggccgtggaggtcttggctctcccacacgattgtaccttcaaagctcttttgtagaaagatgaatagtgagtcaatttccttattgctgtcatttaggttttaagtatgctttcaggcaagatttttagagaaaatttttcccaaaacgtatcatttaaaattttcaccccataactctgacataccactgttagcgtttggtgtgtatccttgaccgttttttccatgcacatataaaaaaccaattacaaagagtatatacacaattttgcatactgctgtttgccatttcccattgtatcaaaagcatttccttatgttgttgcagctgtcacagccattcttcctcatgtgtgtataacatcccaatgagcagatacaccctgatttactcattttcccctactattagacatttggttgctactaaatgtctactaaaatatctactaagtatctactaaaataatgtaggcatgttttggtgtacatgtttatttactcctaacaatttgttttgtacttacattcccagagtgaaattactgggacaagaaagagatatttttatggattttggtatacaccgccaactgctttttgaaagcaacttttactaatttatagggttatcagcaatgtatgagaatgacaactgcactgtattctccctggtatgggatactagtaaacaaaagtttaacctaatatactagatttttacaaaatgattccttatttagttggatttatttttcagtttttgacacagagcctcgctctgccacccaggctggagtgcaatggtgcgatcatggctcactgcaaccttcactctccaggtttaagcgattctcttgcttcagcctcccgcgtagctgggattacaggcgctcactatcacgcccggttaatttttggatatttagtagagacagggtttcgccatgttggccaggctggtctggaactcctgacctcaagtgatctgcccaccctggcctcccaaagtgctgggattacaggcatgagccacggcgccctgcctgaatttaaaaaaaaaaaaaaaagattggcttagttggatttctgattcctagtgatgtttatgaattgcatgttctcttctgaggactgccttatcatgctgctttgccatctgccctctgagttttctatttttcttgttcatctatgcaagcttttaataaagtaattatcttaatcctgtgcacattttatatgctaaaatagtttttcatttgctacttaatgctatttttgaaattcagaagtccataaatttcaccttggcaaatctgacaaacttttcctttgtgattattactattaaattctgagctgagagagctatgcccccctgtcccaaggtctgatatatattgaaatcttaatgtcttctaatttctccatgatcccatttttaattctgtgcacagctggctccttagtcctgctcaggtctcagctccactaccttctcctccgagaggctttctccagatgtcctccagaaggctccaactcccaacttctatcacatcaacctgttttatcttattaataccatttatcactctgatatttcttattttattttattattaaactaactgcctctactagaagacaaacaccttgagaacaggaaggagcttgcctgatcaaccactgcatccccagcatcgagcctggcctgacatgactgacaactcaaaatgtttgctgaataaataatgttgaactaaaaatcaaccagaattgactatagtatagaggattaaatgaaagatatacctctaatactctaaaaactttcatgttaaaatgaagggataaagtactttacaataatgtctcattttagccagcagtatagggaaaccatacaaaattcaatttgataagctaggtcagtggtttataaacatttttttccctctgcacagagtgatataaactttttctttttttttatttttatttttttgagacggagtctcactctgtagcccaggctggagtgcagtggcatgatctctgctcactgcaaaccccacctcccaggtcctggttcaagtgattctcctgcctcagcctcccaagtagctgggattacaggaatgtgccaccatgcctagctaatttttgtattttcagtagagatggggtttcaccatgttggccaggctggtcttgaactcctgacctagtgatctgcctgcctcagcctcccaaagtgctaggattacgggcgtgagccaccgcccaacctttcccttcctttctttccttttttaaaataaataatatttttttcctcctccaaaacagataaaaatattccaagagtccggattcctcaggcagtttatcgctctgtattcagctaatgtattttcttctaaaactttaatagtgatagagtttggaaggattgatagcatatatacttaggataaggaactgataggacttggtgagtacctggacatgagagtgacgataactctcatgattctggtttaggtgacttgaggaaaaggagatggttacccaagattaaaaatacaggcgatgagaacagatgggatggagacaatgttaccattagaatgcccatgggacattcaagtggagaagttcaggaggcaactcaaagcatgtctggagttcacaagagatgctggggctgtaattatagatttaacagccttcagcatacaggcagtaatgaatgaaattgcctgggaagaatgagtaaaataaaacagaaggctaggtagcaaatcctaatgattaatatttaagaggaaagcaaaaaggaaataatgaatcataccaaaagtaaaaactatagtgaccagataaaaatcctcaccttgaaactacaaatctagaaaagatgatgataaaacgagtaattctctgtactgtccattcaattgacatgacatgtgacatgctatttcacagtgggtccttcctggcacccaactccattttgtctgtgactaggctatgatacaacaaacaaattcaatgaataattgaatgtgttaccagaaaaattccctagtcctcccaaatcatcttgacttactcatggaacttaaataacccatcagctgttttgttactaagcaaggaagaagctttatcttccacctgtctcctaaacctgtttctgctccacaacacagtttaatttctattcctcacctctgctctcatacacctactttttattctgatgtaaggcaattatgaagccaggtatctcttaagatccaaaacaacttgtttatggcaattcccttactaagatcataaaaaccaaaataaaagttgggaaaaaatagcatgatacaggttggaaaaatgagatatcatatctatctctcccataacataagcaagctgtctgtaactcctttcacgcatcaactcttttccataaagcttctaatttctcatccaaacaacagagtagcttaaatatatacagtacttctgtgcctataaacattaacaacttcttgtggattggagaaatgactatatataaagaatttcaaccttcacaaaaaataaggatataggctgggcacggtggctcacacctgtaatcccagcactttgggaggccgaggtgggtggatcacctgaggtcaggagttcaaaaccagcctggccaacatggtgaaaccctgtctctattaaaaataaaaaaaattagccaggtgtggtggcaggcactcgtaatcccagctattcaggaggctgaggcaggagaatcatttgaacctgggaggtggaggttgcagtgagccaagattgagccattgcactccagcctgggcaacaggagtgaaattctgtctaaggatgtaagcgtccataatgctaacaataacgtcgctagtgacttaggtgaacaaaaatagtctgctttttactgaaattagttacaggttccaactgtaccattaaggacaacataaaattagagacatatatatatatatatatatatatatatatatatatatatatttttttttttttttttttttgagacggagtctcgctctgtctctgtcactcaggctggagtgcagtggtatgatcttggctcactacaacctctgcctcccaggttcaagtgattctcctgcctcagccttctggtagctgggactacaggcatgcgccaccacacctggctaattttttgtatttttagtagagatggggtttcaccatgttagccaggatggtctggatttcctgacctcatgatccacccgcctcggcctcccaaagtgctgggattacagatgtgagccaccacgcccagccaaaacataaatattttaagagaaacacacagtagtcttcacttgtgaagaatcacttgtgatgcccactgagatttatgcttcagtgagctacacaatgaaaaccttacaggcgacctgcttactggacaagctatactgccgacgtgtgactccaggcaatcaccaagtgtggagggaatacgatgatgaacttcctctcgcaaatggaatacactacctacttctcttctgttactctttgctgatgatatgccagcaaacaatcactatcattcttccgagcaaacaaacccaatcagccttgatgcagtaaaaaaaaggatttaaaattaaacatattttcaacacaaatagaattttgtacaacaggagagaatttttttaattgctaaaagtttattttttctttctattatataaagctaatatatgtttattatggaacatttagaagatagatatacaaaaagaagaaaattaaaatcatccataatcttagctccccaccaggtatagccactattaaataattgcttgctttttgtgtgtgtggttatttttgttgtttgaatagggactgggtttcatcaagttgcccaggctggtcgtctcaaactcatgggctcaatgatctgcccgcctcggcctcccaaagtgctgggaggataagcctgagacaccacacgtggcctgcttgttttttaaaagaaaaaatattatacaaaattaataaaggtaataaaatcaagtctatttagcctaaagcctgaagggagataaaaagcacaaggctatagtcattaaaactcttaataactagacctggtggccaggcgcagtggctcatgcctgtaatcccagcactttgggaggccaaggcaggcgggcggatcatgagatcaggagatcaagaccatcctggctaacacggtgaaaccccgtctgtactaaaaatacaaaaaattagccaggcgtgatggcacacgcctatagtaccagctactcaggaggctgaggcaggagaattgcttgaacccaagaggcagaggttgcagtgagcggagatcatgccactgcactcccgcctgggtgacagagcgagactccgtttctaaacaaacaaacaaacaaacaaactagacctggtgtggtggctcaagcctgtaatcctagacctttgggaggtgagaggattgcttgaggccagaagttcaagaccagcctgccaacatagcgacacacccatctgtacaagaaataaaaaatttaggccaggcgtggtggctcatgtctgtaatctcagcactttgggaggccaaggtaggtggatcacctggggtcaggagttcgagaccagcctggccaacatggtaaaatcttgtctctactaaaaaatacaaaaattagccggtgtggtggcatgtgcctgtaatcccagctacttgagaggctggggcaggagaatcacttgaacgtgggaggcagaggttgcagtgagccagaatcatgccagtgcactccagcctgggtgacagagcaaaatgctgtctcaaaaaaaaaaaaaagatataaaaaatttagttgggtctggtggcaggtgcctgtagtcccagctactcatgaggttgaggtaggagaatcatttgagcccatatggttgaggctgcgatgagctatgatcatgccactggactcctgcctgggcagcagagccagagcctgtctcaaaaaaaaaaaaaataagtaaataaaaattaggggaaaaaaaagtcttaataactacaaaggtaactcactattttggctgagtacttcccatcattagtacccactgccagatataccatcctgaacacaagcaaggaaggttaacccctctcccccaacccaatttttattttgaaaagcttcaaacctatagaaaagttcaaatcaccattcaaatcacctagactcaccaactgttcacattttgccacatttgcctttttgctctctctccacacacacttttctgttgttggatcacttaaaaatacagatatcatgaatttttaactttaagtatttcagcatgtatttcctaagaacaaggacattctaagcgaaaataatattttttatgaactaatcaaaatttgcaattctttctataaggctgaccaagataatggaacagactccataaaactgcgattagcttgaagcattaaagttcattttcttcctctttgctgcaccccatgtgactttcttttggaatacagtttctcaacctcagcaccaatgacattttgggccagataattatttgctggggcgggggtggggtggtgtcctgtggctgcaggatgtttagcagaatccctgtccctttacccactagatgccagtatcaccctacatccagttttaacaactgaaagtgtctctatacactgctctgtgcgcggagggcaaattgcccctggtgaagaaacactgctcttaaagaataggaccccctcaatccagatgaggagtataatgataatgacaacatctattgatctactgaatgcgtggcatatggcagcatgttctaagcagtctacgtgtgttaaatcatttagcccccagaataaccatctgaaatgggtggtgtagcaccttcatcttagaggaggaaatagacacagtgagattaagcacctcatgtgaatgaacaaaccaaagaatggcttcctgcaaaaactgagatccaacactatgtatctgaaccactattcttttttttgagatggcgtctctctgtggcccaggctggagtgcagtgttgcaatcttggctcactgcaacctgtcccccgggttcaagcgatactcctgcctcagcctcccgagtaactgggattacaggagcctaccaccgcacccagctaatttttgtatttttagtagagacggggttttgccatcttggccaggctggtcttgaactcctcaccttgtgatccacccgccttggcctcccaaagtgctgagattacaggtgtgagccactgagcccgacctgaaccaccattcctgaagtaaaaggtaactttgatggtacatactgcacttaaaaaggaaaaaagttcatatgtgaagttaataaaaggatgtaggaaaacaggcactctcatatattgctaatgattgttcacactgatacaaattgctaaactcccctccaggaaggaatcatctgacttaaaaatgtgtatacccttcgacccaacaattcatcctaagaaaataaccagttatacacataaaacagaggtgcagtgatatttactacagtcttttccataacaccgaaaaattgaaactctatcaacacccaaatacagagttaaatgacaatactttcatacaatgtaattctatatagccattacaaataatagagcacatcaaaagatgttcgtgatatgttaaagtaagtaaattataaagtagaatgaacggcataatcctagcaactataacacatagaagcaaaaatgttaaatgtgattatctccaaatatgagattctagtagtgttgttttcctttagcatatctgcattttcctttttttccacccctgttttagtttggcttttatttaaaagtcgttttgttttttttaatttattttttgactgcttttgcggagcaggctatcctataagcagtatgctgagagtagcgtattcagaagtttttaaaatggaagttcagatacaaatgaaaaggagatccctttgacactgacagaattaacatatagtttcaactacttgtactcaattccaaagacccatagtatgttacaaaaatgtgtggttcctattgctgaacacattgtgaatggcacaccacagaatgggtaggaaaaagtttcttggttagtcaccagggccggtcagttgtctagcctccacaccttaacccagctgagatgctgcgggatgaactctacaggtgatctaaagtgaatcccagagatgtctaggaaactgaccccgattgtggttccagagcactgagttcaggaatgtactcggcctagactaaaacagcctagaaaggctgaagctgatgaatgaataatttgttatgtctgatcctgattctgtcacactctgcgaccatactgtgtggcttaactccaggactaatgagggcacctggcaggcgaggcattctttagtgcatatctagttatgactggacctagagggacccagaaggtgacaggtacattttcaggctatcatccacaactgttcaccctttggagaaattttatttaacttggaaacatggcccatctctatcattaacctgtctgcactgacttttttttcttttcattctttagataagcaaattatttaatttttacccaaatggtatctctgtctggtctttccatcaatccacacccaacatcatcctttgtcattaaaacagttgtgtagttctctactccactaaataaactacggaaacatgcaatgtttttcaaaaagtggttttggaacctctgaggcctcatgaagtcctcaggaggtttgaatacagagtgctatgttttagcccatccacagttggtaccttcatctatcactctggagtgctgccctggtacaagaaaatatcaagtgcctgcccctgaaagcacacgcccactcctatgaaggactgcattggtactacagtcttttcctgccatcctgtacctctggtaagatgaattgttccacgggcttgtaccacagcttgttcacctgcacaccacagcttggaggactgaagcgagcaatgaagagggcctcctacaaattgggagaaaaagacaagaaaaaatacttcatgttatacattgcatatgcaaaaagttttcaaacaccttacttcttggtcagctaaatccacaatggccctaaccacggtcactaacatggttctactgtggttttggcatcactgggttttctagtgcagtcatggttattaaataacgatatttaaggtaatcaaagttgtcacgaaattctcaaatgctaaacataatccacataaccttaaaaaaaaaacccaccttgaaagaaaaaatattcagggaagtgagcagtgttgttaaattaagccaacacattatagtgtcaacactcccccaaagggttaaaactaaactgaaagacacagatttttactgggaacaaaagcactcaggaaactccgttcaaaaagaatcttcagaagaaaatataaacaaaacaaaaaagggaatataaaagaggactggagccaggtgcagtggctcacgcttgtaatcccaccactttgggaggctgaggcaggcagatcacttgaggtcaggagttccagaccagcctggccaacatgtgaaactccaaatttctactaaaaatacaaaaattagctgggtgtggtggcaggcacctgtagtcccagctacttaggaggctgaagcaggagaatcgcttgaacccaggaggtggaggctgcagtgagccaagactgcaccactgcactcccgcctggaccgcagagccagactctgtctcaaaaaaaaaaaaaaaaaaaaaaaaaaaaaaaaaaaaaaaaccggactgattttcactatgtctatcgttttcttgggtcctcccatttcttccaggcaacatttcctcattctcatgcctattcttatataccaacttaaccataggggaaacttctgttaagctcttaaaaccatgcaggggttcaaaattaagcacatttcaatggattatgtctatttctttcatgaacaccagttcttagcaatgcagtataagaatagtttttgcatcgtgactacccatgaacccattagcatccatcttagactagtccttccttgaggacaaagattaactcctccctggttaaaaatatggcaactagaagttatatcgacatgatcaaaatattgtatgtctgaaccaaactacttgattgataactcgcacactataaatagttttgttttttgagacagtctcactctgtcacctaggctggagtgagtggtgcaatcacggctcactgtaatgcagcctcgacctcctgggctcaagtgatcctcccacctcaacctaccaagtagctgggactgtaagcaaatgctaccatgcctgcctattttcttaattttttgtagagatggggtctcactgtattgcctaggctggtctctaactcctgggctgaagcaatccatctgccttgccctcccaaaatgctgggattacaggcgtgagccattgcgcctggctgatagttttttttttaaactatatatactaagataaacaagtgtatcaaaaaaattcaagattaattctaatttctagataacagtgatactcagagtactgctatttcaattacctatttgatcttcagtatcaatgaaactgttaactacaatcatatatggactcctatagttgagtatacaaagctcttctcactaatcattatagctggcatcatcagtagaaatcctactcttccctctgtcttatatttatgtctataaacacatcaacaaacgagacagattatttagaggaagaacagggcaaattccaaaaaagaaatttaatctcaaatttatttgtgtatttattgatgagtctctaacattatattcattgctaataatcaacattaataatacaaacacattttaaaaaactgaacagagttctgctgccagtaatatcagaccaattctcctatagatagtaactatgaactctggatgaaacataaaaaacaatgatttgaaggcactggaattcaaacaaacaggcagaaactagagaagaatcagtacttggaagaaggaaaaggctccaaatatgcatctcctccctaccccacttcttgactctttgtctgaggatacaactctagggtaactagaaatttgaatgaaaatctgtagtctttctgcttgaaaattaagaggacagagttggggcaaacacatcaattaataaaaggcattagggggaacctcccagaaaggaaaggatcacagagagagagaaccacaaattcttcatataaactctacccaaatctgtggctgactcatgaaatacacatacaaggcagaacccaagtagcccatccaaggccagagaaactgaatagagattttagctgtttctcactgcaagtgagacaatgtttagtctgtgtccagccaatttagctgcctgctaaaacaaaaaaaaaaaatcaatactctgaggaatataataggatccagagttcctacaatgaattatttacaatatctaggatacaatgcatgagtagcatgtagtcccagctactcaagaggctgagatgggcggatagcttgagcccaggagtttaaggctgcagtgaaccacgactgtgccactgcactccagctcaggtaaaagagcgagaccctgtcaaacaacaacaaaaaaaccaaaacccaaaccaaaaaaccccccaaaatactagacataaaacagaaaaatgttacccatattttagaggaaagataataatcaataaagacagacgctgagatgactcagaataagcgtacacagattttaaagctgctgttataactatggtcaaagctgtagagaaaaatattctcaaacaatgaacacataggaaattttagagaaatagaaacagtaaaaaagaactaaatggaaactgaagcactaaaaagtataatatttaaaataaatctaaaataaaaaattcattggataggcttaacttcagatttgagatgacagaagagtcactaaacttgaatacagatgaacagaagttatctacattagaaaagagaaaaaacactgaaaaaaatgaacagtcttgtgatctgcaggacaataccaaaagatctaacatacatgtaattggaatcccaggaggaatagagagagcgagcgaagtcagaaaaggttctgaagacattaatagttgaaaatcccccaaatttggtaaaatacatacatttacagattgaagaaacatgtagcacgccctgaataaaacagacaaagaaaaagcacaccaggcctggtgcggtgcctcacgcctgtaatcccagcactttgggaggctacttgggaggctgaggcagcactctgggaggccgagaagggcagatcacttgaggtcaggagtttgacaccagcctagcccacatggcaaaatcccatctttactaaaaatacaaaaattagccaggtgtggtggcatgcacctagaatcccagctacttaggagtaataaaccaaatacaggaaaacgttaattgttgtagaatgtagttagtggctatagggtttaccgaataattccttcaagttttcttcatgtttaaaactaaaaaacagatccttcaaatacatttccatgctgctacttcacatgcactctgtgaacaaatcagatttccctacatatcgggaatagagaaacctcactggttttctgttttctgtaaaagaataacttttattccctctatatccttattacaaaaaagatttgaagcagttattagccttgtattacagacttctacagttggaagtaagaggcaataatactcacttatcctaagaatcctaaactttttttatatccattaccaacttttgaaattccctaggttttagggaattttaggttggagatttctaatctagtcaactccttctcttctagatatagcacatttattcacagataatctatccccaaaccagtcttatatcacactacagtgtatttagtcaataggggaagaaaggtgaaagtctctcaaccagagagaattatatagtcttccaatctacttactgtatgtcacaaggaaaagttgatgtttttgaaaaagaaaaaagagaaaaaacctgtacagagcagggcatacctcttgttctgcctgataaagtttgacagtgatgttcctctggaaacccacatcattggcatcgtagaacactccaagactggtaataacgatggggtagagaactcggaaactcacgctgacaactcgatcctcaggcagccccgatgaagtgtcttcggacagactgaacgcttcaatttcctgattcaaaactaagtaatgagaacaggtttatataactgaacaaatgtaatcctttgttttactagtaagaagtagtgaagtgggcttaatgccaaaacctaggtaatcatttgctatataattcacaaatggcaggaatttttaaaaaatgcttgagaaaaatggctgcttctatataaacatttttgaaatttaagaatacagttttcagccacatctaagtaagttaattatcagaactgctttaatagctttttgcataaatgtgtgcatatatatgtataaacgccacaggagatattaaatttaagtcaactggaaggcatctatttggaagggttggataaatagaaataagaaaaacagtactgactgtagtcataaataatcagtaaatttggtcttactgtgcaaattccaaaaatcctacttcttgttaggcaatttaaaatacttgtgatacatcaggcaattattacggtataaataagcaactgaagtcacttcaaataacactgaaaaactcttgctgtacagcactgataaaagataagcatatcaaacacagttttgaaccatcttctatgtaccatttcccatcacatttatatcttcactactacccttgtggttgtggcattatctccagtttacatattaagaaactgaggcccaaaattaagcaattcacctaaggtcatagaaagtggcagatccaggaatcaagtcccatttagtgattccaaagtcagtcccctttccactccctcacagctgtctaatcagtgccaaaacagttcaaataatttttcttttatttcttcttttgagacagtcacccagtcacccaggctgcagtgcagtggcatgaacatggcttattgcagtctcaacctcctttgctcaagggatcctcctgcctcagcctcctgagtagctgggaccgcaggcacacaccaccaggccttgctaattttttgtagagatgggggtctcatcatgttacccaggctggtcttgaactgcaatcctcccgcctcagcctcccaaagtgctgggattacaggcatgagccactgtgcccagccttcaaataaattttctaattaccataaatgaatcagaatacattaaataaagcagttcataggcagggaatatcagtgctactttaataatataaaaccctattttaaaagattatatcaaagttctttgtatcttttagagctgtggttttcaaattttgctgactacacaacaccatcagttaaaaatatttgtacacacacctatttacttacaaaatatatgcatatattgtggtgagtctatatattcagtattaataaagattgtattttcttattttcagataaatagaaattctaagcctgggcaacatggtgaaactctgtctctacgatacaaaaattagctgggcgtggtggcacacacctgtaatcccacctacttgggaggctgaggcacgagaattgcttgagcctgggaggaagaggctgcagtgacctgagattgtgccactgcagtgcagcctgggcaacagagcaagaccctgtctcaaaaaaaagaaattacattttcttcctatactctaggtcatttggttgcccacgtcagacttcctagaagctctttacactcagtagatattcaataaaatgggattaaagggaagtgatgactcctacctaattatagacatgaacaggagggaaaaaagggagaatacagttttttgtcatgggctgggcaagcactaactggagagtctagactacaacataatggacaacaatacaattttttctctttaagatattcagtaaataatagatatccatagtagaaacctctttattaaaagcaataagtcaattataatatagcatttttagatattttcttatctaaaagaattgtgccttgagcttcaagttacgtggacacaggaaatcccgttgcattacagtgctattaaaccttctaccacagccacagtatcacgatgattaatgcttaccatgaccttcaggtactgaaataaccataactgcctttggatcatcgaaaagataagattaggttcaatattaacttagttatatacacatttaaaaattcataacctaggtattacatatatgaaaatgttcttttaacataaagttctacttctttacttttaataaataacagcacttaagataataaaaatatggttaatttaaaagtgaagggcttctttttgttttggtttggttttcaattgtaatttgttggaggatacatcagtggataccacatcagtgacataacattctatggggtttatgatccctttaagactccagtgaggccaggcgtggtggctcacgcctataatcccagcactttgggaggctgaggggggtggatcacgtgaggtcaggagtttgagactagcctggccaatgtggtgaaaccccatctctactaaaaataagtcaggcgtggtggcgggcacctgtaattctagctactcgggagactaaggcaggagaatcgcttgaacctgggaggtggaggttacagtgagccgagatcgcgccattgcactccagtctgggtgacaagagcgaaactctgtctccaaaaaaaaaaaaaagacaagactccagtgaaagccaaaggactttctccccagcacacaattcatacataaaatttgcttacaatgttaactgaattcacagacatcctaagtaagaaacctctattttgtaatacagacctgaatatattgtccaatttatttaaaaagctgtttgaaacccagctttataaaatagcaggctctttaaaataatgttcagtaccttccaccttctaggaactattattctaaatacatcatatgtatcaacttatttcatccttatgtcaatccccatgagggagattcttttatcccaagtttacagatgataaaactgaggcagaggaggtcacacagctagaaaatggcaaagcttggattgagagccatggagactgcttataaaagtgaggtgttacttaattatacagttttaacaaaccttaaaataccagaagtcctaatcagcatatttaagacttggaagtataacctcccttagaaacacagctgaacataatgggaattgctaataaacacagacagttaaaaacttatcaacttcctaaaattggttccctggtgacacagagaacctagttaggatcagctttctttcgttgtctttgtttttgagacagggtctcgctctgtcacccaggctggagtgcagtagcggaagcagatcatagcttactgcagcctcgaactgctggacccaagcagtcctcctacctcagcctcccaagcagctggaactacaggcatgagccacaatacttggctaatgttttttttttcagacatgggagctcactatgttgcccaggctggttttgtgctcctcctcccaccgtggtgtcccaaagtgctggagcagctttctttatcctcaccagaatttttacaaacttttaattttaaggcataaataatgttacttgtgtcttacattttttactattttttcttttacagaaataaattagacaataattctaagagaaagttgattcataatatttgtttcttcaagattattataaattaactggtaaaatcagcagttttccaaaacttcaaaatttggtaattcaggatttatctaagcataaggaacttccaaacgcgtatgaatcacactgaaaaataaagtctcctggatcctaaagttccaattctgtaaagaatctctacagataccccaaggcaatctgtcaaaaatgatgaaataggctgggtatggtggctcatgcctgtaatctcagcactttgggaggctgaggcaggtggatcacaaggtcaggagttcgaggccagcctgaccaacacagtgaaaccccatctctactaaaaatacacaaattagccaggcgcagtggtggtagcctgtaatcccatctacttaagagaggctgaggcaggagaatttcttgaacctaggaggcggaggttgcagtgagctgagatagcaccactgcactccagcctggacaacagagcaagactccatctccaaaaaaaaaaaaaaaaaaaaaaaaaaagatgagacataaatttggatgacagacattttagtctattaaaaacagactccagggcatggtggctcatgcctgcaatcccagtgctttgggatgctgaggctggtggatcccttgagggtaagaattcaagatcagcccagacaagacagcgagacctcaactctacaaaaaatttaaaaaattagccagttttcgtggcatgtgcctgtagtcctagcagggtggtgaggtaggaggatcgcttgagccccggagtttgaggttatagtgagccatgactatgccactgcacgccagcctaggcgacagagcaagaccctgtctctaaaacacataataaaataaaataataaaaaataaaaacagactccatactattaagcttagcaacttttactcaacatcaagcttgtgtatggcagtcaagggaaaagatgacttacctggatttgtgatgttgagtagtttacaggaataaggatcttccctgtcttccacaggcacttcacagccatgagcacctattatgaacttcacaagcacactgagagatgtgttggcattaacatcagttactgatcttcacctcgcacatgcacgtttcctcatgcccatttcagagcttttactttgagacacaagtgtttatgaggattaattctctacctttattcttctagtcagacaaaatgggggaacaagtaaactgaaagttgctaactaccaagttacttatgcatgagtcctttattgcaatgctatattaaagcaagtatgaatatgtctggcctcgctacaagcaaatgttcatatcatttaaaagcaaactatagtaaagtcagttctcatgcccatacctaaaaacatatctatatctaaaattttcctttgctgccttcttctatttcagaaagtgttccttttgctcaagattaggtctttccatccaagaggaaatccccttctctcctagaccttgcttcactggttacccccgtaactagtgactccttccctccacattacaaacatgataaagtcctgactctaattattctcttcaccttccatccttccttgccaccacactttacactgaggtcctacaaagaaattaaaactgcagcctgtttcttacttcccactcattttataaaacaagagttttagctttaatatcaccacctccactgagattccactaatgtaaccaatgagctgctgctaaatcaatagacactcttgaactcttaccttcctggtttctctacggcttaatactgcccagctccctaaaatgctctcttcccttccttctgtggcctgctcagtcatcttcactgcctcttgttccccagcttgtccactgagagtggtattagtctagggctctgcctttgggtcttttctcaatctactcattttttttacttcctctccctaaacaatattatttattctcatggcttcaaatagcatgggaatgattcctgaattagtaactccagttgttttctttttttttgagacagagtctcgctctgtcacccaggctggaatgcaacagtgtaatcttggctctttgcagtctccacctttcaggttcaagtgattctcctgcctcagcctcctaagtggctgggattacaggcgtgtgccaccacgcctggctaatttttgtatttttagtagagacgggatttcaccatgttggccaggctggtctcgaactcttggcgtcaagtgatctgcctgccttggcctcccaaagtgctgggattacaggtgtgagccactgtgtccggacctgaattagtaactctagtttagacccatgtaaaggacctgtaaattcactggacatcttcacccagataacccacagacagctgtgtgctaaagcctgctactactggcttctgggagccaactgtcaacttttcagaaattttgtgagacggttattaaacatagcctttatttaaaattaaattatataatcttataatatatattaaaatcaaaggaaatactcaaattaatcacttaatgttttactacattttactattatgttcttgagatcatttatatttattacatctacatggtggaaatagtatatatggcatgctactgcttatctttcccccactctgtgttcagtgatgtcacattagtcacttgaattggccatagtggaaatattcacaccctagaaactggcaaataatacaaataagggtttggtttattgttttgttgactgtctagacttaagaaagtatagagaaaatgttgataatgcaaattaagcttaatgtgatgtgtctatctatagccactacagagtgaatagttaaaaaaaaaaaaaaaaagtcaaggaagatacgattccagtgttccaaaactattacctgatacagcatagaagtcactgactttattaagtgtaaagctgacatatcttagttgtcactttagtcctcacctcactgtttaacttaaaagaaagacttttgtcacaactacactcttttgttaactgcaaccataagttggtcatagataggagagtctgacaaacaacaaaagcgttctatgagaatcaactggtttcatggaatttacgataaacagtattgtataggttattatctgtcaattacaggctgtatatactttatgtcaataaaatttataataaacatgtatgtacatataagcatcatttttcccagagagccagttagtaaacctttatcagtacactactgcctgtaggaacctcaaggtcaacatatacacaactgagtttctttcccatgaaacctgctcttctcttttagtatttttgttttgattgatgattccactattctccaagtcagaacactagcaatcttcctagcctcctcctccattttctacattcaatgaccttattctctcacaaggtcacccctctgatctctgtagatcagcccctcagcagtccttgccacaacaggtctcgtccttccactcaaccctccacatgcctgttacatgtgatctgctcactgtctgcctctcacagtcatatgcttcccccctcttttctttatatacacctctctactctcctacctctcctggctgtttctctcacactgtgccacaacccttcccccaccaccacaagccctgtgctcaagttatatagaagtgttaggagtttctcaaacaccccgggctattttatatctatttatatcacagcacatacaacattttattatacgattacacctatttccttctactaaatgtcaagcccctcctaacactctatttatctctgtattctaccacacatactacattatttgcttacagaagtacttagtgttgagtttgggtcctttggtgaaatgcaagaatggaaaatatgccataaccacagaaatgcagtttctgttactaattaccaattaaggcagaatacctttcatagataactagcatttggaataaaagtataaacagaaatgaataaatgtgctaactaaattattgcaagtatgtaccaaatttggttttttagccatcttactaggtactcttactagatccacaaaattactgtgtcccaggaaggtgtttctgcctaatatctatttttatacagatagctgatcattctcataacacaaatcaagcacgctaaatttaaagcaagactgttatgatggcaaataaattagtggtgaaatgtctgaatataaactatattcattacatttggttctgagtcattcattcaatagttgttgagtgccttagtctgcaccaagctaggttttaggtattgggaatacaccagtgaaaaaacctgaagccccaatgctcatgaaacctacattcaagtggagaaagacaaacaattttacaactaaatacaatacagatgccagctggtgataagtgttaccaaaaaaaaattaaagccaactaagggaagacacaaacaagataggggtgggctgctatttactatggggctgtctgctagagtgacatctaatcagagacctgaaggaagtgagtcctgaggacattagtgagagaggacgtaggaaatgcaaaggccctgaggtaggggcacttttagtgtatgaaagtacagtaaggcagccagtgtaggggaagtagatgtagataaggtcaaataccacaacaaagacttggagtttcactctgagcaagaaaggaggtcaatggaggggtatgaatagagaattgacataatttgactaattttaaaaggatcactctggctgctgtatggaaaataaaatgtagggggtcaaaggtagaagcagtaagttcagagaaggggacttctgcaataatccaggtgagacataatggcagcctagatcagatggcagtggtaaaggtggtgagaagtcagattctgggtatggtctaagcagcatctggaaggtatgctgatggattggatgtggcaggtgaaaggaaaaatcagggtaacaccaagggttttggtctgagcaactggtggaggagtcattattttctaacagggaaatactacaggaagtacagcttttggaggtggttctaatagtagtgatgattctgaggtctttcatttgctgtgtaataggctctattatcattgcaaccatgaactaaagaaacctgtcttgaaaaggaatgaaagctactatgagtaagcactactagtgacaagaaaattcacaactaggccgggcttggtggctcacgcttgtaatcccagcactttgggaggccgaggcaagcagatcacctgaggtcaggagttcgagaccagcctggccaacatggtgaaaccctgtccttactaaaaatacaaaaattagccgggcatggtggcaagtgcctgtaatcccagctacttgggaggctgaggcaggagaatcgcttgaacccaggaattggaggttgcagtgagccaagatcgtgccactgcactttagcttgagcgacagcaaaactccatctcaaaaaaaaaaaaaattcacaactgcaatttgcttgtatagctactcagtcacaaatgtgccagtgcaattcaatcctgaaagggccttctctgcttatcacctgagtcttcacatacatagaagtcaacttctatgcgtttcttcccctagtccctcactacacaatcttcagaggttgatctcattgagaacagactaaggctttgggcccctaactaataactgagagctatctaatgtcagcatgaaatggattaccaaagctcagttccagaagggtagtcaggaaaaagagcatggcatattacacatactgcagattacacaactaaaaaatactacaaaactgaaaaaaattaaatttatctctgtgaagttagtgaaaagtatatttagacatgcacatgtgtctaaggagagaactgctctagaacagaaccttttaagaattgctattctaaatcaaagcaaaaaacaaacaaaccacactgggtatctaaatactacacatgttaaccagtgaatatactctcttccaattatcatttggcttaaaatgttggttaaatttactttttggcccaaactatatggaagaaaagcaaatgaaacagccatttctcccaggaagagcccacatatctgaatgaacatttctattcaaagtaaggtttttcagaacttttttttttttttaaattaggcagggactcattcccatcatgcaggctagaatgcagtggtgcaatcatggctcactgcagcctcaattttccaagctcaagcaatccttccacctcagcctccccggtagctgggacgacgggcacacaccaccacgcctggctaggtttttcagaactcttatttcaataaaccaggcaaggcaacaactcagaaaacctaccgttgacttaatgtgggatgctgtagcaaatgtctcatccaggtgcttcttatcacgtttcgaagttcatggttattgcgagctgacaacacgccaactaccacatcatagtgagtagatttccactgaggaaataaggccaactgatctagaaataagaacaatacatgagaaataagtcatgtatcaattactatgaagttcaatatgtatcataagtttattacaaaataagcttatgtttgtaggaaattcagataaacacaaagaaaagaatttttaaatcacatatgaacccactatccagagacaaccactaataacattttggtttagagtatttttgtctttcacgtatatatgtatgtattcatgctcacgtaagtatactaattcttcaaaacaaacaagatgtggtaagaatctgtttcaaaaggcaacgtagcataaaaaaatagtaggcattaagagtcaattaggccacagttagaatccaggctctatcatatattaactataagttatttagcttcttgagcctcagtttcctcaactacaaaatgggtataataatacttctcataaagctgttgtaaaaattaaatgagataacatgtataaagctcttggtttggtattaggcatatatgaggcattcaatggcaactaaaaaaaatgtgctttgaaaagtgaggtcctacattaatgttagttattaagtttggcggatgacgctgaaggacttccataccggaaagtaatgcaacccttatttatatcaatgaattctatagccagtaaacctttcactacctacaaaatattctgaagaatgacgggaaagcaacacttttagtaaaaaaaaaaaataataataataaagtaagtcattctgaacggctcattttttactgtcagaaggtctaatgggcagggttacatttccatgtaaaacttgtccttagaagacagaagagaaagatatactttgtccttgtttttcatcaccagttttaaggcttgagagctacaagcttatatatagctctgatgaggtatccatttcatctctttctccagtggtgggaactgatccaaaacgtttccaaaaataaattattgaagcccagactctttactatattaaatgcaatgtttttatataccatgggatctaggtattcagtctaaaagacaacaaaaccaggttgatattttcttcaaaggcccaattaaaataataaaaacagatctttctactaggatagttttaaggatataatacagaaatttttgtgtagataccttattttccacaatagatatatttcttaaaatgtttcattctgggccaggcacggtggctcatgcctgtaatcccagcactttggaaggccgaggtgggcggatcacctgaggtcgggagttcaagaccagcctgaccaacatggagaaaccctgtctctactaaaaatacaaaattagccgggtgtggtggtgcttgcctgttatcccagctacttgggaggctgaggcaggagaatctcttgaacccgggaggtggaggttggggtgagccgagaccgcgccattgcactccagcctgggcaacaagagtgagactccacctgaaaaaaaaaaaaaagttccattccaaatggaatagaggtatttattatttcactctacaatgagtcatgtactaaaacgaattcttttataaagacaatttatttttaaataaattcaaattttcatggattaagcttattaataggccatatttattgaacagttaatctgtgaaaagcactacatatagagtatcatttaatgttcacaaccctatgaggtaggtacttgtttctttttttttttttttttgacggagtcccactctgtggcccagtctggagtgcagtggcggcgctctcggctcactgcaacctctgccgcccgggttcaagtgattctcctgcctcagcctcctgagtagctgggattataggcgcctgtcactgtgcctggctaatttttgtagttttagtagagatggagtttcaccatcttggccaggctggtgttgaactcttgaccttgtgatccaccgcctcggcctcccaaagtgctgggattacaggcgtgatccaccgtgcctggcccagtacttgttgaacaaatgaaacacccaaagaattcagtaacttaagtcaaacagcttggaaatggctgggctaagatttaatcccaggcaatctaacaccattctttatcactgttctattctaaagctatacagcttaatatagcttatctgagtctaaattctgatcttttaatccacaataccagttcaactgaattagcaataagcggatcattgaatacgctgggtaacacatcaattttttttaactcatagctcagaacattttttctcagatacataactatatgatggaagttgtacctagtgctggaactcactctaaatgagtgtctgaattcagagactaatttaaatgactatgtaaaactgacaatatgcctccccacctttttcacagagaaatatgtacattctagtgtcaggaaggaggcaaaacaaaggtagtgaccagccagttctgacattgattccacagccaagattttgcattacgttagtaagaaattatttaaatccctgtgcttcaacttcttaattagagaaaactgatacaaaaaaaattttggatattctatttcatttgtttcaaagtctcatctcaaaagattaaaagctgtagggcaaaaatcacatttaatctaaatgcctcatttatctgacatcatcagaaaataaggatgctgcacaaaagcaaactttcaaaatatttgaaacatcacttttaattccaataatttactaccttatttttgatggctaatcaaagcaaatcttttagaaatagattacatagaacataatttaatcttttcttgatgtctcaaaatcttcatgaaaatttctcaaatctatccctttcttgtcattaattctagctgctgctcagttcggtctgttttttcacctggaccagtacgagggcatcctaactggtttttacctgacttctccatataattgtcaaacaagatttttctaaaaataataaagaaatacaaagataaccatgtgacatgtgaaaatcccatggattatggatggaaacctctttttgatcttattccacctctctgccactctcaatcccccctgcttctaatccatgtctaagctgcttctgttcaactgctttactttacatgcatttctctttttcttgcagagggaaagtaacacggcatatcgtggtcttttagagaactacttcaagatatattgaagtcaaatgtcagaaaaataggttttttaaccacataccattaatgtaaattagtccaatagactcctgagtactgtgttacacagtacaaaacccaaagcagatgcataataaaatacctatgtaagaatgttgctcaaatttctagctccctttaccaatctagctctaaactcttatcaccttttatgttacaagaacagggtacctagttgactccagtgtctagaaacagagggaaaaaaagaaagtggtaagaagtaaacatgatacagaaggacataaagataattcagaaaagaaaaaaggcaaatagcaagcctatgaaaacatgttcaacttcaataagaatcaagtttgaattagagcaatgagacaccagttttctcctacattcaaactgacaaatgtcttcttaaatgattgtaactaaatgatggtacttcaaggaaatgttgttagtgatttcaacaaagtggctactctccgccgggcacggtggctcatgcctataatcccagcttcaattttgggaggccgaggagggcagatcacaaggtcagaagttcgagaccagcctggccaatatggtgaaacctcatctctattaaaaatacaacaaaaattagctaggtgtggtggtgcatgcctgtaatcccagctactcgggaggctgagtcaggagacttgcttgaacctgggaggcagaggttgcagtcagccaagatcccgccactgctctccagtctgggtgacagagctagactccttctcaaaaaaaaaaaaaaaaaaaaaaggctactctttttcattgcgggaaggaatgtaatttggtacagtcttctgcagggcaatttggcaatgtgtcaaataatttagaatggtgtaactttgtccagcaattctaagaactcattctaaagaaataatcagtgatacactcagaagatctttattaatcatagtgtcacctattaatagcgaaaaactgcaagctacataaacacataaaggactcattaaataaattatggtgtagctatatgacagaatactatgcagccattaaaattacatgttaatcatatcattaaacattattctattaatacatcatattaagataaacaggcgataggaactatgtagatactagacggttctgtttatataaagtacaaaagtagccaaatttctgccactggttactatccctggtagtgacaaaacagagcatgaagggaacttctgaagcactgatagttttctttttttaaatctgggtggtgattagttgggtgtgttcaatttgtgaaaatacatcaaactgcgccagttttattctcttgatttattcactcaaatgacagagcatctcctatgctcattgttctagatggcacagatacagcagtaaacaaaatcttcataatgtcaggactaaatcacaatcccaagcaagctccctgagggcaacgtaagggccaagggaaagttttccctctgaaggttcggtgaaaatcactgacaagagatggacaggagaaaaggcatataaatttatttgatcagtaaagatacaggagaaagtgcccatttctgtgcttaggtttaacaaagtatagatagctatgtggaattaagattggacagaaagggtaggatctaatgttaacagatggagttggaaaacccagcaaggcctgtctagattcttcttgtcctctctgagtatacattctttcctactgggtatgggataggaccctctctggtatgaggttcttatgacctgtaataaaagaaggtaagttaggtaatttttatatagaaaggtggtggtgggggctagttagagtaatatgtttaggttttatggctggctttggggaagagggattttagtttctacagctagcctcaggtgagaatgcaaggccagagagaggacagcagcagcaggtcagagacagctgcttctgaggccttattttggggtattgttttcttctgagaccctacagtaagaactatttcttttcttaatatgtaatatatcctgagagtctggcaacctgctcaaccctgcactgtgagtggacatccaaaggtatattaaagtctaagggagggcctggcgcagtggctcatgcctgtaatcctagcactttgggaggccgaggtgaatgaatcgcttgaggtcaggagttcgagaccagcctggccaacatggcaaaacgcagtctctactaataatacaaaaattagctgggcgtggtggcacacacatgtaacagaggctgaggcaggagaatggcttcaacccggaggcagaggttgcagttagtcaagatggtgccactgcactccagcctgggcgacagagtgaaactgtgcctcaaaataataatcaaaaaagtctaaagaaggttgacatcaaaattgattgctcaaaataagcccaagagtcttaaaaatcagaccaaaattccactctgatatgcatgctcttggaagagtcacaaatagatacaaatcttgaaaatgaagaaaacatgtgagcctgtcacagatctaatgataaagacaatcatcatacacactaccaaagacacctcccaaaacaccacactagcacaggcatcagcggccaccagactaccactcctctctcaaactcatggagtgtttactatgaaacaggcactgttgcgggtgtttcattaattgaatcttcacaataagtctatgagatcatcatcttataaataaggaaactgaagcacagagacacaattagcatatagggataattttggaagaactcaccccaggcaaaattacaaagcaagctcaatttgttttctgaccttctacttgctctacatctgtttccattagatactgtgagcaccttgggagaagggactaggcatccagcacagaatctaacactcaagtacttgttgagtgaatatgctcctttgttttggtttctttctttccagataccctagaaagcgaagccttcttttgtcacatcatttttctaaattaaccgttaaataattcctacttaaggcattacccaaaacgagcattttgtaatcaagatatcctatgtttagattccttagtccgatggttatctccacctgcattttcctctgtcaccctcaggtgtactggatttcacttcctctttaccagttgctttccctgactggtttaagggaacctatcacattaaaaaagttgctgattctggtactaaggtgactcacttacttcattctggtccctgctcaactgttacctcttcagaatggaatggacttccctgacctatttaaaaccatctctttaatctcttaacactgctttatcttttttccctatacttatcactaccgctgtgatatttataattatttcctgatgctctgtcttcccttctaaattgtaaactacatgagggcaggaagtttagcttgattactgctgtaattccacacctacgataggagctggcacagagtaggctctcaaatatttgctgaatcaactgcgagccaaagaaccttttttaatattcagggaaggtaaatcgctctttcaaaaaaaacaaagaaactgccattacttaatgagactgaagacagacaaagcagcagaagaggaaaaaaaatacatttaaaaatgttaattcaagaaaagaatacttagcaaaatcttgggtttttttttctcctgttaggcttaaagtacaagggttaaaatgtaaaaacacccaactattttagtttcaacatggtgacagcacaatggtaaaggaattatgggaaattttagcatttaagatgcttccactgcttttagctttgaaagtaccaaaaggaaaaaaggaaaggtaggagtcagtcttgtttaattaattaattaattattttgagatggactttcgctcttgtcacccaggctggagtgcagtggcgcaatctcgtctcactgcaacctccgcctccgaggttcaagtgattctcctgcctcagcctccttagtagctgggattacaggcatgcaccactatgcccggctaatttttgtatttttagtagagacggggtttcgccatgttggccaggctggtcttgaactcctgacctcaggtgatccacccaccacggcctcccaaagtgttgggattacaggcgtgaggcaccgcgccgggccagtcatgtttaacttagattattaaaatatcgatggttgacagctgcagcaaaccaccatggcacacgtttacctatgtaacaaacttgcacgtcctgcacacgtatcccggaacttaaaaaaaaatcccatttattatctgaccagatatacagtactcattcaaagccaaagttaattaacataactagtattgatcttcttacctacgttattaccctgttcctttctatggtctacttcttcatttccttaatctagcctggtctaactactggatggcagataaaggcatcatccttcaagtgcagtaagggagtaggaaaaacttgtctcaaactagaaaactgcctagcaagtctactaagatttcagtttgaagtctactaacatttcagtttttgtttgttttactgaaccctaaacaaccattaaggccataaacagacttaatgacgctctacaaggagattccagcagggctcactcataacaaaagagagaaacctgtaacacacaagcagctgttacaaagcattttttataaatggcgttctcttcttagttcacttcacaaaaacctaaaaaacactgagcaaaaccctgaccccatcaactggttaagtgcatagcaacactgtactttcattaaatcacttaaatagtgtttaattctattcaggtcacacaaatccttttcaaagagctagtgatctaataggaaaagagattgttaccaaaataacctcaacataatttcatataactgagactgttttgaggattgccgaatactttctacttataaggcatagagtgctgaactgcaaacactcaattctaattttaagaacttttggattagaaaacagctgttttggggagagatggtaagggaaaaaagtgccagtatagttacaaaattaagtattacataatatttaaaagagctttctaggtttctttcatgttctagggcaagcccttaaagaagaagacaagagatacagggaaagctaaagtagtgttcagggtggtggaacccactaacaaaacaatccgctgggcaccgtaagtaaagcattctattaggctgtgacgcgaaacaagaacaaaggtttcattcctacgagagattaagttttagagcaaatggacacgatcgttaaagaatttgatatttccatgtaaactgcattagcaggttatgcgatccaaactcacaggaacaactccaactctcggccatgccctatttcatgtctagatttgtttaaccgacttacatcataatccaagaatacgaactacagtatattcttacagcaaagttattccttaaaagcaaaaccgagccacctttgaaaacacgcacacacattatccacggcactaaaaccccagtcttgaccgagaaagaccaacaacttgggggggaagaaaacaacttcagagccagagctcccaaagcagaaagcgctggcggctgaagggcacacgaggttccgctcccgggcgaacgggcggcgtcggacatcactaaccaggcctggggacgggcgaaggacttgcagctgcgggcgccggctctgcgggcgttaaggcaaacggggaagtgagaagcggcggggacacgaaaagagaaaagctccctcaagtttgcccgatgttaacgctccaaggatgaaaagagccgtttgtttcgtctggggaccgtcgcgtttggcccttcccccgcctccaacaattcccggcgaagccccgcggcaccaagccgggcctcccacccccccggcggccgccaacccgcccggccccaggacctcacctgcagggccggccccggaggcgcaggcgggcggcggggagcgcagccgcagccagaggtgcagcgcggccccgagcacacacgggcacagcagcaccagccagtttcgcattggccgcccccgccgcgagccgggctctcccgcgtcccggcggagagggaggggacctgcaagtgcggagactgaggggcggcggctgacgagcgaccactccgagcacgcccgccctcgcgctcggcgacgtctggagggctcctcgcagctcccggccccgctcctccggtccctcagaccgcgggtggccgcggcttagccggccgaagccccgccccctccgcctggccttcccaccggctccgcccaccttttctcccactcgccccgccctctcctcccgcgtttccacacgcgccagccagccggccgggagctgaagtcccgctctgggcccaggcagggggcgcccgcggtttagaaaccacatttcccatgagcctaagcacgcgcttccgtcactcggcggccgcgggggcgaagcgcgaggccccacacagagcatgcgcatcccccttgacgtttgctgccaccccacggcccaggggaggtagtgccggagacccggtgctcggaggctgcccggagccgcgaagggaaatgcgctttgcctcagatttgaaggaaatccgagtggctcttgtgtgaaatcacgcagagctcctctgttccgcgtgctctcttgctcgactgctgtgggaggtgggatcctgctgacgtctccttggcccgtagagtggggcgaggaagcccgagtgtccgcgcctggagcggtgactcatcagggattagctctggtgccgtgggttcccggctctttgcccggttctgtgctctgggaacgcagggtgacagacagcgagctggggactaggctgtggaacacgatgatgacgagccaatcagggtagaactgcacgtgctccgggttcatactggagctgggagcgaaacgggagccgggcgagctgggagaacgtgggctccggggacctggggaagggtggccgcagcgcgccttccagggagaacgccggccccgcgtcttgaggctttgccccgggtgggagccctcctggcccaccaggcccgcgccgaggcagccggaaagcggggacggggcggtgaaggcactggggtgaggatgggagagaaggatgagaacgagcggctgggctatggggcggtttttgtttctgcttttgtttttgagacggagtctcactctgtcacccaagctgtagtgcaatggcgcgatctcggctcgctgcaacctccgcctcctgggttcaagcgattctcctgcctcagcctcctgagtggctgggattacaggcgcccgccactgcgcccagctaatttttgtattttttttgtagagacgaggtttcgccatgttggccaggctggtctccagctcctgacctcaggtgatccgcccgcctcggcctcccaaaatgcttggattacaggcgtgagccaccgcgctcggccgcggttttttttttttttttttttttaagtttccacaagtgtggaaacagaaggtgactgtattattgaaaaaaagtcttggatgacagaagacccaactcaaacaggcttaagggaaaaaagtactttggctcgccgtggctcatgcgtgtaatcccagcactttgggaggccgaggtgggcggatcacttgagggcaggagttcgagactagcctgggtaacatggtgaaaccctgtctctactaaaaatacaaaaattagtctggcgtagtggtgggcacctgtagtcccagctactcaggaggctgaggcaggaggatcgcttgaacccaggaggcggaggttgcagtgagccgagatcgcgccattgcactccagcctgggtgacagaacgagactctgtctcaaaaacaaacaaacaaacaaaaaaaaaataaaaagaaaaggcaagaaagtaataattggttgccagaaaaagtatactatttttatcctcaggaaaggtagtaaatggcctctgttgatattgtaaaattttcattttgtgaattagaatgagttatcctaaaaagaggactaatccctcatttcagcagagctagtcattcgacaaatacttattgagtgtctattatgtaccagacacttttgtaggtactttagatacaccagtgaacaaaataaagatccctatcctgtgttgatggggagtagggcgcagactatagacataataaagaaatatactcaaccagcatgttagaaggttattcctgctctggaaaatataacaattagggccgggtaggggaattgtgagtgtgggattgaaatgacacagattgcagtatcaactagcagtatttaaacaactgttcaaagttacaatgagcactaaagggaagaataaacataagtcatccgaatatattaaataatcaaggtgttgtttcacttaacaacctagaggggaagtttttcactggctctctgacaggcttgtaacaaaaatagttttgaataactttgtaacatccttcaaatcacatcagagtgggagctgtctatagtacttgttcataggaccagtgacctttccacttacctgttttctactgtcccctaataatctcatgactaaagtgagtgaagattgcaagacagtaattcctgtaatcccagcactttaggaggctgaggtgggaggatcacttgagtccaggagttcaagaccagcctgggcaacatagcaagacctcgtctctacaaaaaattaacaattagctgggcatggtggtatacgcctatagttccagctactcgggaggctgaggcaggatgatcacttaagccccagagttcaaggttagagtgagctatgatcacaccacaggactcagtctgggtgacagagtgggaccttgtttctaaaaaaaaaaaaaaaaggtaaaagtgacagtatgtgtaatggaaagaataaaaaaactcagtagtgatataaacagtctgtgcactcaaggggctcatagggtaagtaggaacaagttaacagaattagaattagggagagacaaactagggtggttggtaaccatgatggcaattcaatgtgataagtgctctgagaaaggaatgcacaggatgttagagcagcacaaagcagggggtacagctgtctctactcatgggggattggttctggaccttctatggataccaaaattcatggatgctcaagtcccttatataaaatggtataatatttgcatataacatacacacatcctctcatatacgcgaaatcatctctaaattacttataacacctaatatgatgtctacgcatcacttcattcacgtggattcaatggcatgcgcaaattcaagtttgcttttttcctgaatttgaggttggttgaattcatagatgcagtacccagggatatggagggccaactatatttaactctactcaagggtccccagaggaggctatctcttgaaaatacagggccggggcttgaagtcaaagtggccagttaacagggccagaaagtaggaaggacattcaagagcactgtaggcaaaaaaataaaaaataaaataaataaacctgagctagtgatgacacggcaattagggaaatgtaagcaattggtatgaccttagtgcaagttaggaacacggcaatgatgagaaggtgaacagaaggcagaggccaggttgtaatcataaactttgctaaggaatttggactttattgtgaaggctctaaagaagaatttttttttctgattaccaatgtaatacatgattatgaaaaggatcttggaaaacagaagaatataagaaatcatactacatacaattcatacattttttaaaagttttttcattaaaaaaatttgccattcatactgtaagttagaatttatatccaactattttcacctaacctataagccttcccatatttaattagtagtctcagaaaatataacttaatcatttgtccacactataatttcttatctggtcccgtattattggacatacaggttgtttccattattccactataataagtaatactggcacttctgtgcacaaaactttttccacatttcagataatttccttttctgatattatttttaagccgctttattcatactgctattgtttcaatgtgtatgtctgccttcaatatgtttctcttatctcaccctcatattttaaaaaagttctttattaattcaaaggacaaaacttttcatcaatgagattgaatattcttatgttcgttagctgtttctatttcttttgttaattagtcatgtatcttccttttatccatttgtataagccctttatttttcctcagttttcttgccttctaattttataacttttaggacacaaaaacactttaaatttttataaattcaaatgatcaatatttaatttttttccatattttaggatgattctgatcatgagatctggtcaatattcttgtttgttttatttaatgttttaatccatttggaatttatttaggaatatggtgtaatgcaaggatctcaaaattaattaatttttttcatatagctaactattgtcctggcccattatttccctattagtttatgacatcacctcaatttattaaaaatttttaacataatagtatttgtttccaagccacagttttgcattcatctgtcctttcatcagtaccgtaatactctaatgatcctagttgtataatattttgtaatccagagggcaattctccctctcaatactctttatttctcacatatatatatatttttttttttttttttgagacagaatttcgctctgtcatccaggtctgggctcactgcaacctctgcctcccagtttcaggcaattgtcttggctcagcttttcgagtagctgggactacaggagcgcaccaccacagcaggctaatttttgtatttttgtagagacagggttttgccatgttggccaggctggtcttgaactcctgacctcaggtgatccacccgcgttggcatcccaaagtgctgggattactggcgtgagcccggcctatttctaatgaattttataataatttgtatagttattcgactttcccctaaaccttatgtttaataaaaaactaatgcatggttatcataacaaacacaagtaatgtaatacaagtgtaaacaaaatatataatgttagaatccttcagcccaccccaatctttctttccagacttagccactatagcccagatatttcttcttgtatatatattctgaatttttccaaatttctttacttttccagtgatggaaagggaggaatcaccctccttttcaatccccatgtatgcaatctgtccccttaacctgtataactccagaaattctagtcccctctctcaatatttctaagtaccaaggcgtgttctcttttccacgaggtcatcatcagtctcgttgccacctcttgttccagactgctctagtgttctctatcaaccacctcaactcataaccacttctcgaggccacagccccagattcttctgctttgacccgaaacacagacatagtgcctccgtttatcccccagtcacagctaagacatggctggcatgtttaacagacttgtaaaaggattggccgggcgcggtggcttacccctgtaatcctagtgctttgggaggctgaggcgggcggatcccctgaggtctgggttccagaacagcccgaccaacagggagaaaacccatctctactaaaaatccaaaattagccgggagtggtggcatatgcctgtaatcccagctactcgggaggctgaggcaggagaattgcttgaacccaggaggcggaggttgcagtgagccgagatggcaccattgcactccagcctgggcaacaagagtgaaactccgtctcaaaaaaataaataaatacaagaatttagcctgagaagatacagacagaaaacttttaacttgatatgagataaacttgctcctatggtcccccaatagaggtccctactggctatctcttgccttaagccttaccccagccctttaatgacacttccaagcgccttctcatcccttccatatgagggtcacttcttgctggttctcttttctctagtacagggcccaattcgatcagccagtgaaataaaaattgcccttgaacatctcttagtttaaaatatatagtatgtatgtttttgtatatgtaattctgtaaaagtatttttttattcctctaattcttatttacttatttggtagggatgagctctcactatgctgcccaggctggtctcgaactcctgacctcaagcggtccttctacctcagcctcccaaagtgctgggattacaggcataagccactgtgcctggccctctaattctttatcattaaagtttctcgtcaggctttagttgttcactttcttcctcaaggaaaccatcttgcctggtcacttaatcaacaaatttcactttttttttttttttggtgaatagttgggaaaccttaaaatcattcagatattcttttcaggactcctggcactctgcctcgggtgggtacacgctgccctagtaatgcgtgctatttaaatgattgcttctctttcttttttaagccaatggttgaattcttttaaattaaatgcctgtgatatgacgaccagataatctttgcagaagacaacctttacactagcagacagaatcattaacatttcagtctgaaagcatcttgactcgggcttctccaagaagagtaggaaaatagacactgccaaactgtccttcaaaaatgtgctcaaggagggaggctggtgtaacaggaacagagtgagtggtgaggagaataatcggggatgatgtagtccctagcaagaatatgatataaatcatgataaggatttgggcttttactccgaaatgaaaggggagtagttacatggtggggttttgttttttttgtttttttgtttttttgttttttttttgagacagagtcttgctctgtcacctgggctggagtgcagtggcgcgatctcagctcactgcaacctctgcctcctgggttcaagcaattctcctgtctcagcctccagagtagctaggattacaggcgtgcaccaccatggccagccattttgtatttttaatagaaatggggttctaccatgttggccaggctggtcttgaactcctgacctcaagtgatccgccggcccagctcccaaagttctgggattacaagtatgagccaccgcacccagcctacatggtgggttttaagcaaaggagtgacatgatctgacttatgtgttagcaggaacactcacattgctgtgtggtgaatagactgactgggggtggggaaaaatctaccgtgtggagtagcggaggagatgatgagtatcattcaagtcttgagaaaagctgcagtagcaagagccaaccagaagatggaagagggatcctgggtgcttctatatggagttgatctatctgagggtgcagaggccgactctaagatgctgtggtgcatctccccaattcaggatggaaaatgttgactgcaaaggagtctcagttgaatctctctctctgggaactgcccttggctgaaggtggctgcctcacccaagggtacagctccctcctgagagacaacctgcatccagtgactactcaaggaacggtgtaaagatgtgggtaactctgaagagccatcccgtggcctctcttgcaactgcgtcacagtccaacttctccctccgcccaattctgctttcctcactcccttaccggcattcccaagagcagtccccagtaaacctgtatacaacccgtgtttcagagtatgtttccatgggaacctgacctaagacagcgattctgttaaatgacatgaaagatgatgtcatttctctacctaaaaccctgcaaatggctctccagttctgttctctcacagggaaaccagagtcccttacagtggcctgcaggccgttgtcatctgtaggccgttgtcatctgcaggccgttgtcatctgtaggccattgtcatctgcaggccgttgtcatctgcaggcctgaacccctctaacctcatcctctattcccctccttctcattcagtttgctccagaaccatcctggcctcctttccatcccgagaataggacaggtacattctttcctcgggatctttgcactttgtttcttctgctcttcttccagatattttcatagcttattccttcttcttcttcaagtcaactaaaatgttgccttttccatgaggccttccctgtcccttctattaaaaaaccctgctccaccatccccaatctctattactctattctgtatcacttatcactctttttttgttttgttttgttttgagacagtctcactctgttgcccaggctggagtgcagtggtgtgatttcggctcactgcaacctccacttcccgggttcaagcgattctcctgcctcaccctcctgagtagttgggattacaggtgcatactaccatgcccagctaatttttgtatttttagtagaggtggggtttcaccatgttggtcaggctggtctcaaactcctgaccttgtgatccgcctgcctcggcctcccaaagtgctgggattaatggcgtgagccactgcgacctgccatgtgtcacttatcactcttaaacatactgttcaatttacttatttattttgtttgcggtttattgtcttactgtctacacagggcagaaattttccctcccgttttgttccctgatatatcccagaacctggagaagtcactggcattttgtaggtgctccataaatatttattgaacaaacagtgaatgaatgagtgaatcaatgaatttgggaatctttagcaagttgattgcagtagaactcacaaggtgagattacccaggcatagtctgtagagcgatgatgaagggagacaccaacatttaggtgtgagcagaggaagttaaaattataaaggacattgacaagaatccagactataggaggaaaacaggaggatgtgtcacccaagacaagatgtaagatggcagagggagtgcagacgacagcgtacaacctgaccaacatggtgaaacactgtctctaaaaaaaacaaaaacaaaaattagccgggcgtggtggctcatgcctgttgacaacatatgaagcaagatcaaggcagaaatgtgtctgctgatttgagagtggccaggtaactagcagtttcgaggaataggtagagcagaagggagagtactgtgagttgaggagtgaatgagaagtaatgaagtggaaatggtgtgtgcattactattttgagaagtttggtcatgaagatcagaacgagaaagaatgggagctgggaagagggctctgattgaagaagtgtgtgtgtgcatttagatgggagagataagcctgacttgagtattttaagtgatgtatggaaacagccagtaacaaccatataatttgtaatctaaatcaaggttttgagagaaaaagggggcaggacaaatgctaaaatggataaatgtcaagacaacaggaactatctgcaaaccagaccatatggtctccctgtccacgcctcaagttttccatgcaagtcatttatccttacacttagtgggctatttttttctgacggtaggtggcagtaaagagcttgcctctttttgcctcgtttggtttggtttggtttggtttttgagaaaaatttaattagagattttggatggcaactaagattggtaaaggttagctccacaggcttaaactcaaaataggagatttcaacttagattttactttgggaaaattcatacacgtttttgtgaaaaagaatatctcttggttctcaaagaaaaaataatttttgggtaattataaaatatgttgcattttcacactgagccattttatctttaaaatgatgaacttccatcttcttcctaatacagaataatttccattagttttatcacttctttttttttgagacagagtatcgctctgttgcccagcctggagtgcaatggcacaatctcggctcactgcaacctccgcctcctaggttcaagagattctcctgcctcagcctcccgagtgggattacaggtgcctaccaccacgcctggctaatttttgtatttttttttggtagagatggggtttcaccatgttagccaggctggtcttgaactcctgacctcaaatgatctgcccacctcggcctcccaaagtgcttggattacaggtgtgagccactgtgtctggcctatcccttcagttttagcacacgcattgctatatgcacacatttcttatttgtgtatataaattttcagtcaagtctagcttcagtagactttgggggaccttgctattgaagattataaacattttaaaaaactataggccaggcgccatggctcacgcctgtaatcccagcacttcaggaggctgaggcgggcgaatcacttgaggtcaggagttcgagaccagcctggccaacatggtgaaatgccatctctaaaaaaaataacaaaaattagcctggcgtggtggcgtgcacctgtaatcccagctactcaggaggctgaggcaggagaatcacttgaacctcaggaggcagaggttgcagtgaatcgagatcacatcactacactccagcctgctgggcaacagagtgggactctgtctcaaaaaaagaaacaaaacaaacaaaccaaaaacctatgacacataacagcaaatttcttgttatcaaagataggactagagatgtctaaagataagaagttttaggagttcggaatggtaaagtgaatgagcacaccttattcagggaatcttggcagaatctaatgtcataaaatttaaaattcagaaatctttgtcagagaaaaaacagaatcaaaatattatctgcagatccagcaaacaaatttgagttcaaaactcagatttgcatttattagctgtgtggccttgagcatggcaagcactttacctctaggtctcagattcctaatctgtgaaatgagactcacaggatatacttcagtggattgttttgaatattaaatgagaaaacatattggtaaaatttatacatgttattttcattcttttccctaaacatgaatatgaagacatccagattaaaatgtggcatatgcaacctcaacctttggaaaatatatctcaaatgattaaggaaaaatattaattttaagaattgctttaaaacaacaaaaccaaaaaagccttggtcataccttaattcagtaattcttcaactttacgtctcagatccaatattctaggcactgcttgacacagagagcagttttcttacaaggaaatttggggaccagagggggttctttgcatgtttggataagtgctagaattcaaattccttctcctgagagtcctctgcctttttcgtttaatgaactcggttgctttctttatttcctctttctatcctcattagcgtaaagcaaactctaaaagcaatccacaatatcaatcacatcaaatatcatggaatgtggcctcagtcctggaagatgtctactccatataggtgacttggtacattacagtagattatagtagctgaaaagtatcctttggccagccattgtcaaaactagagtcactaatgagatcacaaatgagaagcattcattgtctctataagacttcctaaaatgcccttattattaagggaagtcctggctttctgccagtatcacagactaatttgttcattagctggttgacttcttggttcttgcatatttcaatggctaaagtttgtagtaagtttgagaaatataaagagaggagtatggggaggagagctggcgggaggtgggtgctggaaatgattaagaccactggaagggaaaaaaatggggtatgatatcaccatggaaacgaagtttacgtattgcaaaaatttgcccaagttggatagcattcattcattcattcattcattcattcattcaacaaacatttactcggtgtctttgcatgcctagaaccatcaaagttacaaatgagaacaaaacaagcttggttcttgtcttcacggagcttccattctagtgggggaaggtacacaaagaacaaacacaagtaggtttccccctggaaagaataactggcaggtttgcaggcattaccacctaatttctttttaaaaagaaacctaaagacttctttgggtgtccaaaggtctaaaattttagaagttcaaaatggcaaagtgaaagagcacacattattcaggcaatcttggcagtatctaatgtcataacatttaaaaatcagaaatctctgtaagaggaaaaatagaatcaaattactctctgtaggtccagcagacaaatttgagttcaaaacccagatttgcatttttataattatttactttagtaaattacttacaatttactaaaattataaataattatagtaaaacaaaaaaattaacaatgagccagcctcccagtgtcgctcaggagacctcacggctaaataagtaatcactgctatcccttcctctccagcagtctccatcaacttgttctgcattcagagactgttcttgggccttcccatacgcagctcacatttgaaactcctgcccctggtgccttaatgcatctgactggcagccacacagcccctccatgtggctcagtttcagtgggtaggtagggaaatgccgatttgtttgcattgttccccacaggctgattacagtaaaggctgtcacacagagctcttgcatacctaacaggagacttggtgacagtgaaaccaagaatgaccaatgactgtgtgtaaaatgaatcaaggtgaggtgtattgaaagcaaagaggtcaattcaaaggcttagaaataatccagacagtaatcaaggaagaaagcagccatgtcactgggaagaaaaacctcttgggacactcagtatattcaacacgatgaagtaattcgccctgtgacatggacaaaaggagctttccatgctctaatgggcagtaggattccataaagtgaatcacgtttaaaagagacactcttaaaaaatgaaatacgtggccataatcccagcaccttgggaggccgaggaaagtggatcacgaggtcaggagttcgagaccagcctggccaacatagtgaatccctgtctgtactaaaaatacaaaaaattagctgggcatggtggtgggcgcctgtaatcccagctactcaggaggctgaggcaggagaatcacttgaatcagggaggcagaggttgcagtgagccgagatcgcgccattacactctagcccaggcaacagtgggagactccgtctcaatgaaaaataaataaataaatgaataaataaatattgttctaatgagcaaatttaaaaaatcctaagtaaaatttggtctctttctcattagtgcttaatggtcttcaatcaccccagtcctactttgagtatatactaaatccctttcaaggacagattctagacttttcccactttggctcatctgaaaggtttctaaaaggattggtccttaatatttcttttcacaacttaatagcgtgatttgagtttatgcacacagaaagagatttgttcgtaccctcctctcctctgatttttaaaccttgttccccttgttcattctgtatgttgagatgtgatcttgcttttaggagatcaaagaaaaagaaaaacaagtttctctcacatgtttgtcttctctttaacaatccacattgtttttatatcggcccaagatacaccattaaaagttctgcaaagcttttaaactttgcagagtagttttagactgtgtgcagagaagtcttgtgccaaattgcagagcctgttttttttttttttttttttgagacggagtctcgctcccttgcccaggctggagtgcagtggcacgatctcggctcactgcaagctccgcctcctgggttcacgccattctcctgcctcaacctcccaagtagctgggactacaggcgcccaccaccacgcccggctaattttttgtatttttagtagagacggggtttcactgtggtagccaggatggtctcgatctcctgacctcgtgatccgcccgcctcggcctcccaaagtgctgggattacaggcgtgagccactgcgcccggcccagagcctgttgtataagaaattaatttcaaatgctagcagagaggatggcattatgttttcaaaatgatgctacattaattcagcaagaaaagtttagagccattctgagtcagaggacaggatattttaatcttaaaagataaaagggcaattccaaatagctgattatgcatagggttcatcattcatattgatgtaagtattatggggcatttcctctgtgatgacagggctagattctactcacacacactaataaacagtttttcctcctggtttatacacaacgaggtgaatgtctctttcccctgatgaactagtgtttggaaacaaaaactataattatcttcagtggagatggcaattggataccccagagaatttgtctgatctttataaggtattcagcagtgaaaatggggttttgcaaaaagccagaagacttgctttggaatcctaactgtgtcacttactaaaattttgactttagataagctatctaatttccctgagccttagcttccttgtctgcagaatgtgaaaaataatgaccaccccataggatgaaaaaaaaaaattaaatctaacgccatatgtgaaagtactcagcattagtcagtccttagaaaatgttagtctcagcctggcacggtggctcatgcctgtaatcccagcaatttgggaggccgaggcagacagatcacgagtcaggagtttgagaccaacctggccaacatggtgaaaccccatctctactaaaaatacaaaaaaattagccaggcatggtggcatgcgcctgtaatcccagctactcgggaggctgaggcaggagaatcgcttgaacctgggaggcggaggttgcagtgaaccgagatcgcgccattgcactctagcctgggtgacagagcaagactccatctcgagacaatgttagtctcccctttcctctgtgagcaggaggaatgaagaacataaagacggttattagctactgctgtgtcacaaaccacatgaaaactcaggaccaactctcagcactgattttttttttttttttgagacagtctcactgtgctgcccaggttggagcgtggagttcagtggtatgattagagctcactgcacacttgaacttctggatttaagtgatcctccccattcagcctcctgattagctaagactacgggcacgccaccatgccaggctagtgtttttgtttgtttgttttagagatgaggtttcctatgttgcccaggctggtctggaactcctggcctcaaacaatcctcccacttcggcctctcaaagcactgggattataggtgtggtgcacctccagcaggaggtatctggacccattcactatcatgaaaacggcatgggaaagacctgcccccatgattcaatcatctcccactgggcccctcccacaccacgtgggaattatgggagctacaaggtgagatttgggtggggacatagagccaaaccatatcattgacctgctggcaccatcaaatatttctgcatgatgaaatttcagctcagttttaagtgtctatgcctacaatcatcatgggactctttctaactatacactgtacatcacatacaacacctgcatccttctctgccacacagatctgctgagatttgcattatggctgaattagccgaaatttacatgccaaaggggcatcgatatttttcatctgctgctttctacgtgtaggacaaggcttatattactggtcctacactttcctagaaaccagaaacatcggtattatgttactatttatagtaatagcaactacatttataggttgtgtcctaccatgaggacaagtatctttttgaggggcaacagtaattacaaatctattgtcagctgttccatacattggcaccagcctggtacaataaacttaggaggcttttcagttgacaaagccacctcacaccattcttcaccttccacttcatcttacctttcattatcatggacctagtagccatctaccctctatttcttccagagacaggatccaacaacctgtcaggagtttcatcagattctggcaaaattccattccatccctactacacaatcaaagacattttgggtctaattctccttctactattactacttatattagttctatttcacctgacctactaggagacccagataatgacactgtggcaaaccccctcaacacaccacctgacattaaaccagaatgagactttttatttgcctatgcaattctatgctctattcccaataaactaggaggggtactagccctagtcttctctattgttatcctagctattgttccaatatctaaacagcaaagcataatattctggccgtcaagccaatacttattctcagcatcatgcactctacccatgtaacagacctgcatatgtacccctgaatctaaaaagttgaaattataaaaagtaaaaacatatacatacatatatgtatacatgtacctacacctatgcaaaaaatatgtagtgttggctgggcatggtggtttgcatggtggtttgcacctgtaatcccagcactctgggacgccaaggcaggtggatcacttgaggtgaggacttcaagactggcctggccaacatggcgaaaccctgtctctactaaaaatacaaaaattggcgggtcatggtggtgggagcttgtagtcccagctacttgggaggctgaggcaggataatcacttaacccgggaggtggaggttgcagtgagccaagatcatgccactgcactccagcctgggcaacagagtgagactctgtctcaaaaaaaaaaaaaaaaaaaaaaaaaaaaaaatatatatatatatatatatatatatatatatatagagagagagagagagagagagagagagagagagtattattattttgtttttttaaattcacctgaatagcatactttatatatattgttctacatacttggtcttcttgctcaacattgtatttttgatacttgtcctatttggtatatgtagacctaatgggttccttttaactaccgtctaatgtgagattgcaccattggatgaatgggccacagtcgatttttgcatttttctactgatgaacatgtatataatattttttatcctctaggctcaatttaagtgctttgcaaattctcattcatgtatctttataacaggtagtagttttgccttccttattttacagatgaggaaactgagacacagagaagctaagttacccactcaaggtcacaaggctagtaagctagtaagtgacctagacaggtcacacacctgtcacatcagaatctgtgtcctaaacctgggcttgttgcctctttgaggtatttccattgctcactgtaacagtcctgtttacttattctcatgtccactgccatgtgtacacgaaagtttctttccagttatacctagaaacaggattgctgggttcacataatatctttcatcatggtgagttttttttttttgttttgctttgtttttttgagcactgttacccaggctggagtgcagtggcacgatctcggctcactgcaacctccacctccctggttcaagcgattctcctgcctcagcctcccgagtagctgggactacagctgtgcaccaccacgcccagctaattttttgtatttttagtagagacggggtttcaccatgttggccaggctgacctcgaactcctgacttcgggcgatctgtccgcctcggcctcccaaagtgctgggattacaggcgtgagccaccgcgcccggcctgcatacttatttgtatgcccaccgccatgtgcaaatgaaggtttctttccagttatacctagaagcaggattgctgggttcacatactatctttcatcatggtgagtttttgcagtgtgaactagagtggggaataaagtgtcataggaacaattctgcggctttgaaggacttcagagccgttaaatagttacttcaatgttttatccagctcttaactttaggctcttttctgtcgtggtaatcatctgagatgaggttaatagaatatgaaactactttgagagaagacagaagacagaatggccatgtcacataagtaactcttctgaatggttcatctcaatgtactacatttatttattttttgtttcgcttttttttttttttttctgaggtggagtctcgctctgttgcccaggctggagtgcagtggcgccatctcagctcactgcaagctccgcctcccgggttcacgccattctcctgcctcagcctcccgagtagctgggactataggcgcccgccaccacgcccggctaattttttgtatttttagtagagaccgggtttcaccgtgttagccaggatggtctcgatcttctgacctcgtgatccgcccgcctcggcctcccaaagtgctgggattacaggcgtgagccaccacgcccggctgttttgctttttgagacagtctcactctgttgcccaggctggagtgcagtggcgtgatttcagctcactgcaacctctgcttcctgggttcaagtgcttctcctgcctcagcctcctgggtaactgaattacagatgtgggccaccaggcctggggctaatttttgtatttttagtggagacaggggtttcaccatgttagccaggctggtctcgagatcctgaactcaagtgatctgccccctttggcctcccaaagtgctgggattatgggcgtgaaccgtcatgcctggccacaaatgtactttaatacagctgcatgttgctgtgtgatctattctagaattgaacattttctctgtataatttctatatatctaactctctatatataatttctatatatctagcctatatatctagatatataatttctatatatctagcctatatatctaactcagtctgctaaaccactgagcatcatgaaaaatgaaaagcagattctgtatgatggcctaactcaacaattccaaacacatttttgcactattacgagcttttggttttataaacttgcagtatatttgatgtaggtctttatatgtttgtgtaagttggctgtaaatgccaagatacacttaatctcttaccatcatgccattctcattcagatataaactatagcaacctcacttggaaaagaatcaacacacttgttgccgtagtaatcaaggccactcattaaaaaagctatcttacagatgagatatccccaatgcccttacccatcaaatggaaatagaattgaagggcttttggttaatccttcctgaagacctttttgctttgacttagtctaaaatagcaaacacataaactataacacacctctcagaattggtaagatccatactgctctttccccaacattggtccatttctggggattcttcagggacacacaaaagaaagaacctgtttgtgtgtctggtttaaaggaatcctgtctgcatgggcttgcgtttgaaggctggttctcagctcaccagttgaacagttctaatcacatctctgtgagccattgtttcctcattgtaaaatggggatagcacccacctcattgactaactcgttcatatacgttggttcaacatctattgagtacctcaagtccctattctcaagttgttcacagtccagtaggggaaatagatatatttaatgatatggaagaaatcataatttttagcaggttgcaagaggcagttttgttggatgagtgctttgatattccctttccgaagctagggctccatgacttgttaagtaattggtgcattgtgctgaaagaaaccaactgtgctgccctgtgtgaattactaaaaggaatgcatctgttcctgggaggcggggagggagggcagaagggatctggccctgcagtggggtggggtggaggagcaccctcagttggtgggggcagacatgtccaagggaacttataaaactgtgggtgacataaaaccctcttccatcacccctgtaaagtctccagcaaaatctacattggccactagtgctttaggtgtaaataagattctggagaattcaaaggcagccagacatcataatcatacattatgcaaaagtggtttccaaactgcaggtcaggatttttcggtgcatgtgaaagcaatttggtgcaccatgcccagcattcaacaagggaaatagaacagtatagaaaacttcagggcaccttgcaaatagtagaggtaatgatgctttctgaaacttttttatgtaggtcctcagctgtggaataaaatgtttttctttttgtaggtcatggtcaaaaagagagaatctcggtattataatacattgtgctgattacaatagcaattttttttttttttttttgagacagagtctctctcctgtcgcccaggctggagtgcattggcgcgatctcggctcactacaacctctgcctcctgggttcaagcgattctcctgtctcagcatcccgagtagctgggacttcaagcgccggccaccatgcccaattaatttttgtatttttagtagagatggggtttcaccatgttggccaggctggtctcaaactcctgacctcaggtgatccgcccacctgggcctcccaaagtgctgggattacaagcgtaagccaccacgcccaggctacaatagtaatcttgatggctcactctgctctcactggtccctagaatccttataaaaggggtcttggttcaacagttccctgggttgaagactagcttctacctcctgttttctccaattctctgttttaaagtcctttggatcttccttttgcatccttgcagagcctctttgggctcctgtctcggcccagctcgccttgctctgagggttgcctttgatctggtcagaactccactccacttctgccagctcgactcccacgttggaggcaggaaatagcactctcttgttcttgcatgtatcaagtcctttgcctgctctctgctcctacagctctttggcctggctaattcctacttattttcaggtcttagcagaaatggagcatttacaatgaagctaatgaagcttaagcttcagggtctgtgccaaaccctgacacccaattttgtaatctggtattcattttcttagggttggatttcatgaggcctcatgaaacctgaatccacttctgggtctcagtttagaaaacctcacctcctaactccttgcagtgtgggtgctgatctcctatacatgcccttgggtcccctgcacccactcccaggacagccctgaccacactcccccataggcttgccagtcttcaccccgaaactcacataaaggaactatgccagtccttgctggtgagtgccaaggtgccctcatagtagacaataaataaaaatgtggtaaatgtctgaacttcataagttgatttggggaaacaatgctttttatgcttcccaaagtattccataaaactgctgacaggggccgggcatggtggctcatgcccgtaatcccagcattttgggaggccgaggcaggcggatcacttgaggtcagaagttcaagaccagcctggccaacatggcgaaaccccatctctactgaaaatacaaaaattagctgggtgtggtggtgcacgcctgtaatcccaggtactcaggaagctgaggcaggaaaattgcttgaaccccagaggtggaggctgcagtgagccgagatcatgtcactgcactccagcctgggcaacagagcgagaccctgtctcacaacaaaacaaaaaaaacaccaaaccaaaacaaaaaatcctgctgatagcaatgaagaggaatgaggattagccaagaagaaagtttcagaacactgacctcccctgccctggcccgtgtttgtggagtgctgctgttcctgattgtgctccatttctgagaggttaaaggaatttgtgtcaattccaccaagtaaagatagcttaattgtctgccccaccacctaaggatctctctggagcagatatttttattagaaaatcagaaacaggccaggcgcggtggctcatgtctataatcccagcactttgggaggccaaggcaggtggatcacttttggtaaggagttcaagaccagtctggccaacatggtgaaaccccatctccactaaaaatacaaaaattagctgggggtggtggtgcgtgcctgtaatcccagctactcgagaggctgaggcaggagaatcgcttgaactcaggaggtggaggttgcagtgagccaagattgcaccactgcactccagcctgggcgacacagtgagactccatctcaaaaaacaaacaaacaagcaaacaaaaaaccagaaacaaaagatatagcatctcctcaaaccgaagagctgtcaaatttgtcaatttttcttttgcttagagttcatgatattaaatgatttgtcttttcctttccttttcttactgaagccttcagttaaagcagtctgactctaatctagccctgacccagttactcttgctcaggtgcagccctgggagctctggggtctcctttctgttctttttcccctcgtggattattcttcctaaaagcggatgacagtggttgagaacacaggctctgaatcaggctttctgggttcacatcacagtttcctccatttacggattgtgtgactgggaacttgagcaagtgagttgattggctagcgaatcaagtcaacatcaggaatgttgcaagcctgcaaatgttaccatggtagcttgaaagtggctttggttgggagtatttactgattagcttgaaatttactttgattggcagtatttactaattgtgtgactaggaacttgagcaagtgacttgtttggctagggaatcagaccaacatcaggaatgtcgcaagcctgttgatgttacgttggtagcttgaaattggctttgattggaagtattcacaccatggaaattggcaaatgctgcaaatcagtgcctgcccctttccccaacctgggcattactatttaccagaacatcaagctcagtttcctcatctataaaatgggagcaataatagtacctaccttgtggagaattttgtgacagtttcatcgtgcatggtaaatacttcgtgcttgtgagctgctcttagtatttccctcattttacaaggtccagtgcctttttgtttcatgtgccccattctgacacagcttcaaacacaggaccagccagatctagcacatgccttggcaataaacttattttttattttttgataggtagtcttgctctgttgcccaggctggagtgcagtggcacaatctcagctcactgcaacctccgcctcccaggttcaagtgattctcctgcctcagcctcccaagtagctgggattacaggcgcctgccatgaggcccagctaatttttgtatttttagtagagatggggtttcaccatgttggccaggctgttctcaaactcctgacctcaggtgatctgcccgcctcggcctcccaaagtactgggattacaggcatgagccagtaacaaacttaaaaaaaaattacttagctagattatttagtcttcaaacagccagctcataactgataggaaatgtgtggtcttaggttgtttataaggcataccctggtgacacatatgttataaaattagaattcttctaaatctagcgctgattacttatgttatatatatttcatttggctgggtgttagaaagaatttcttctttgagatttctattattttttctcccaattaaggcaaagactgtaaggatagtttattacagcatttggtggttcagtaaacaaacatgctctaaaaaacctaaatagctgtgttgaagtaaaacatgtgtcccaaattcacatgaattatatgcaagttaatactttggtgagcaaataaactcttggtaatatattgctgtcacctgagggctaaaaatataatatatattataaatatctgactcaatctgatcatgaatgaattgatcacttatgtgtatttaaatataatggcaaagcttaagctcagtattctcttaaatgagttcatttactctcaataggtttgggggcctttatttactgaaaaaacagattcacgattattggaatatgtgttttttttttaatttttagttttttgagacaaggtctttgaattaatcacgtgtgtatttaaatataatggcaaagcttaagctcagtattctcttaaatgagttcatttactctcaataggtttgggggcctttatttactgaaaaaatagattcacgattattggaatatgtgtttttttttaatttttagttttttgagacaaggtctttgaattaatcacttatgtgtatttaaatataatggcaaagcttaagctcagtattctcttaaatgagttcatttactctcaataggtttgggggtctttatttactaataaagtagattcatgattattggaatatgtgtttttttttaatttttagttttttgagacagggtcttgctctcgcgcccaggctggagtgtagtggcccaatcatggctcattgcagcctcagactcctgggctcaagtaatcctcccacctcagcctcccaagtagctgggactataagcacatgccatcatgcccggttattttttccttttctgagatggagtctaactcagtcactggggctggagtgcagtggcacaatctcagctcactgcaactttcacctcctgggttcaagtgagtctcctgccttagcctcccaactagctgggattacaggtgggtgccaccatgcctggctgatttttgtgtttttagtagagatggagtttcaccatgttggccaggctggtcttgaactcctgacctcaagtgatccacccacctccgcttcccaaactgctggggttataggtgtgagctagcgcgccgggcctgtggctattaaaaaaattttttgtgtgtgaagatggtgtctccttttgttgcccaggctgttcttgaactcttgggcttaagtgatcctcccattttggcttcccaaagtgctggagttacaggtatgagccactgcacctggtcagaatatgtatatcttaatctaactttatcagcatttaaatgacaggaagtgaaaatgttattaatgcacaattgatcacaaaaccatcacaggttctgcaaccaggatgagtttatatgagaattcttcatccaagatgcttggaagttcatctcttcaaaggattgccctcttcggaaacaagtaatagcctgctttgatgatgtttacaaaataccacatgtcaacatttaagaagacaatggttttcaaaggaactggaaactcctttcctggattgagaaggcagactctatggccactgagactccttctccttcaagatgctctgaggtcaacaagtaccttgtttgcctctgggaattctttcccttgcagtagtaaaccttttccaggcctttttctatcactggaattgcgtctggtctcagcaacaagtttcaggaaaattaatatacataggtcccccttctttctcaggcagagggacatccccagaggatgcaggactaccatcatgagagtggactggtggctttttttttttttttttgagacagagtctcactccgttgcccaggctggagtgcagtggcgtgatcttggctcactgcaacctccgcctcctgggttcaaccgattctcctgcctcagcctcccaagtagctgggattacaggcacacgtcacaacacccggctaatttttgtatttttgtattttagatggggtttcgccatgttggccaagctggtctcaaactcctgacctcaggtaatctgtccacctcagcctcccaaagtgctgggattacaggcatgagccaccgcgcccggccggactagtgactttataagaagagcttctcccactcttccctgctcctgatccttcagcatgccagagttgggcttccggagtctcatgtggtcagtaacgttattactaatccaacttgtgctcaagcaaccttggccccactggaaaggtttgtctccaccactgctgacgagttcaatctaggtgggaggcagtggccgtcaccctggctaagcatctgcaatgtccttctgaccacagcccaccacctctcctgctcataaggctcctgccctggacctcccaggcctgagctctgctgcccattgtgtgttctggtttgcagaattaggcttctgctatggtctctgctatgatttgcatatttgtctccttaagaactcatgttgaaacttgatccccagtgtgggattattgagagacggggccttttcaaggtgattgggtcatgagggctctacccttgagaatagattaatccattaattaattaataattaataaattaatggattaatgggttatgagagtgggactggtggctttataagaagggaagagagacctgagctagcacactcagacactcgccatatgatgccctgagctgtctcaggactctggagagagtccccaccagcaagaaggccctcaccagatgcagcccctcaaccttggacttcccagcttctggaacagtaaggaataaatgtaatttcttataagtaacctagttccagatattctgttataagcaatagaaaatgtactaaaaccactattaataaaacagtctctactgcaaattcttttctggaaagtgctagttctccagactcaatataggaacccagattttgctctagccagcaggcccatcatggggctggggcctggccctgtgagccttcccagtggctttgtcccagctacgtgaatgtgtgttttcatgctctcccatctctatgtctcctgtccccaggatgactgccaacctgccagcattctccagcatcacccaccaaggtgccctcaaactcctctgtcgtcctccccagctgctcactgttttcatgtgaaccttgagtatcaactattttcccacctcctccaaggggagagcatagcaaagtggttaagagcctgtgctctggcactggatagcctggttccagcttcacctgttacgacttatgtgactttggcaagtcacttaatctctcatgcctcactttgccatctttaaaaatgggtttaatcctagtgctcacaggtttgtcatgagcatatataaagtgatatttgcaaagtacgtagaagacggattggcacctggtaagctctgtataaggatttgatcattgtgttagtttgctagggctgccataacaaagtactatagactggatggtttaaacaacagaaatggatttccttacagttctggaggctggaagtctgagatcaaggtgaccacagggttggttgcttttgaagcctctctctccttggcttgcagacagctgtcttttcttcatgtcctcaaatggtcttccctctgtgtgtgtctgtgtcctcatctcctcttcttataatgataccagtcatattggattaaagtccaccctaatgacctcatttttgctttattatccctttaaaggccctattttcaaacacagtagcctctctttttctgtggggatacattccgagacccccagtgaatgcgtgaaaccattgatagtaccaaaccatatatatatatataccatgtttttttctatacatacgtacctatgataagtaagagattaacgacagtagctaataataaaatagaacaattttaacaatatgccagcatcactactcttgtgctttgggtcccttatgaagtaaaataagaattatttggatacaagcaccataatatcacaacagtgataaccaagacagctcctaaatgactaacagcatggggtatctacagggtggctatatggattaagggatgattcacatcctgggtgggaccgagtgggatggcatgagatttaatcatgctactcagaatggaatgcaatttaaaatgtatgaattatttctggaactttccatttaatatttttggactgcagtagaccatgggtaatggaaactatagaatgtgaaactgcagataagggggaactactatatggttatattatgaggtattagggtttaggatttcaacatacgaatttggaaaggaggtacaattcagcccaaaacaataactaaatgaataatttgtgcctggacactgccaagctcctgcagccattgctatagactgaatgtttgtgtctccctgaaactcatctcttgaaaccccaccccctaaaattcaatggggcctttgggagtgattaggattagatgaggtcaggaaggcaggattagtgcccttgtaagagtcctgaggcagtttgctcccctctgctctgggtcacatgagaacacagtgagaagagggccatctgcagcccaggagaggcctcacgagaagctatgctggtgccctcatctcagacttccagcttccagaactgggagaaatacatttctgctgtgtataagctactcagttggccgggtgcggtggttcatgcctgtaatcacagcactttgggaggccaaggcaggaggatcacaaggtcaggagtccgagaccaacttgaccaatgtggtgaaaccccgtctctactaaaaatacaaaaattagctgggcatggtggcttgcacctgtaattccacctactcgggaggctgaggcaggagaatcacttgaacctgggaggcagaggttgcagtgagccaagaccatgccactgcactccatcctgggcgacagagtgagaatctatctcaaaaaaaaaaaaaatctactccgtctatggcatttgttttttatagcagtgtatactggctaagaccatgcccttttgactatctctggctggccccgcgatggctgtctagagtgatttctccccagcgttagcctgggacagcagctggacatccttcaccagctccatcagagtgacagcagccggctctccccctctttcccttctaggtccctgcatgacctggccttgtagaggaggggcccagcctttggtatcttggtccactgcttactcattcaaaattggcagaggtgaaaactggaatataacagagaaatcagctcaccacaaaaagacagcactacttgttagtatagttgaggcttgaacaacaggggcttaaactgcgtgggtccacttatatgtggattttcttccacctctgccgcccggagacagcaaagccaactcctcctcttcctcttcctcctcagcctactcaatgtgaagatgaagatgaggatgaagacttttatgatgatccactttcacttaatgaatagtaaatatactttatcttctttatgaccttccttccttcccttcccttccctttcctttcccttcccttcctttcccttctctctttctttccttccttccttcctccctccttccttccctccctccctccctccctccctccctccctccctccctccctccctctctctctctctctttctttctttctctttcttttctttccttctttcgtcctttcctctgtcacccagactggagtgcagtggcacaacctagctcactgcagcctccaactcctgagctcaagctatcctcccatctcagcctcccaaagtcctaggattacaggcataagccaccatgcctggctctctttcttacagttttcttaataaaatttattttctctggcttattttattgtaagaatacagtatatgatacacatgacataaaaaatgtattaattgactgtttatattcttggtgagacttctggtcaacactaggctatcagtagttaagtttttggagagtcaaaagttgtgtgtggctgggcgcggtggctcacgcctgtaatcccaggactgggaggctgaggcgggtggatcatctgaggtcaggagtttgagaccagcctgaccaacatggcaaaactctgtctctactaaaaatacaaaaattagctgggcgtggtggcgtgtgcctgtcatcccagctactcgggatgctgagacaggagaattgcttgaacccaggaggcggaggttgcagtgagccgagatcgagccactgcactccagcctgggtgacagagcaagactccatcttgaaaagaaaaaaaaagttataagtgaatttttgactgctaggaggagggaaaggggttggtgctcctaatccctgcattgttcaagggtcaattgtggttagaaacaaagtcaagtcccagccaccagagagatatttaatggttaatattgggttaatactgtggccccttcctagaccctgaatgttttcccaaataagtacttcgacctccaaaatgacttttgcccaggctggagtgcagtagcacattcttggctcactgcaacctctgcctcctggttcaagagattctcctgcctcagcctcccgagtagctgggattacaggtgtgcaccaccaggtccagctaatttttgtatttttagtagagacggggtttcgccatgttggccaggctggtcttgaactcctgacctcctcctgcctcaacctcccaaagtgctgggattacaggtgtgcgtcattgtgccccgtccttcgaaaggcttttatcatcacctcttgaaatagcaattttgaagtttgagagctttcattacagacttgacctccccttctggtgctgattatgggaaagtgctatctttccggcatatcatgagttattttcttcataattcagttcctggagtgagggggtcttagcttgtactcctgtataaacagactgtgatgttgatgtgttatgaaactggagcgcgatgggcacccagttactagctggtaagtgttactgtctctccttccctccatgcatcttcggcaaatgaccaactcttatctgaaattctgagtctttgtgtggactcgttaccacaataattatggatagggtaaatacagttaatgcctatttactgagcatgtgttatgtcccaggcatgtgttaaatacttatgtgatttcatgaatcatcaagagctgcctgtgaaataggtgttattatcctcattttactagatgaagaaatgagagctttggacagtggcaaagccagtagatgtcagagccaggatttcaacccgagcatctctgattccaaagcccaggctctttgccattctgatttttggtttttggcctcctaaatacctcctggctcaatttttatttatctatcaagcaaggtgtcttctttcctcttggattttcttcttcctatgtaatttttttgttttgtttttttgagacagagtctcactctgtattttaggctggagtgcagtggcacgatcttggcttactgcaacctccgcctccaaggttcaagtgattctcctacctcagcctcccaagtagctgggactacagatgcgcaccaccatgcacagctaatttttgtattcttaggagagacagggtttcaccgtgttgtccaggctggtctcgaactccagacctcaggtgatctgcccgcctcggcctcccaaagtgctgggactacaggtgtgagccactgctcccggccgtaatttttaactaaaggaagctgtgccaatgtggatctgcacttccaaatgttacacaccagtaagggctaagatgaaacaactaattatttgatcaggagaaaggtattagaaaagtagcatcaaaggccaggcacagtggttcatgtctgtaatcttagcactttgggaggccaaggcgggaggatcgcttgagcccaggagtttgagaccagcctgggcaacatcgcgggacctcgtctctataaaaaatagaaaacttaggcatggtggcgtgtgcctgtagtcccagctattcaggaaactgaggtgggaggattgcctgagaccaggaggtacaggctgcagtgagccacgatcgtgccactgcattgaagcctgggtgacacagcgagaccccatctcaaaaacacaaaacaaagcaaaaagaaataaataaagaagagtggcatcagctgcatagcactggatttgtccaaaccaatgaattcctttattttgccccagggattggtttatatgtaaaatcaaattgaatgaagtctaatataactgaaaaagaaaagatgagataaaatgtactaaataatgagaattttaccaaatgatttggaaagaacagccagagaatgcatacttgtgcgcacacctggccatggtaataataggtctcttttctcacggaaacacttcagatactccctactcctaataacaggccttatgtgtgaactaaacggaccatgttaccttcgtgtttcatgggacaatgtttctttcctcttcaagctgttctttcacttcttagcagcagtggccctccccggccttaattaccacaatgaaaccagtacacagctacactgtgtgaaggtgcatttatagaatgcaggtgctttttgatttttaaatggcaagaaagtataacaatactatgaagtcaatagtgtgcacactccagcctgggagacagagcaagaccctatctcaaaaaaaaaaaaagtgtgctttcatggttaattagtagctgcttttttttttttcttttcttgagacagagtctcactctgttgcccaggctggagtgcacactatgagtaattagtgagtaactaataatttttattagcgagtgtgttttgcggatattgaccattagtgttcttctagttgaagttcaacaatgatttttcatgtcattagtcatagttatagtccatgtgggaacaatggcatattttatatctttattaagtgtccttttggttatagggtttgtaggtttctccttgaaaccttctcctatttatgggggcctagagctaattattagtggtgctgtaggttgtggtattgtgttgatttttggtgtggcttttgtggggttgacagtctttttggttcacttgggtggcatgatggttgtttttggctataccatggcaatggctgctgaggaatatcctgaaacatgagggtcaaatattgacatctgaggggctttactattatgagtattaaaggggttgctgtcggtttggtgaatagttgagcatgatggggtggggatcatgattgattttaacagcatagagagttggatgatttttgagggggagggggaggggttgttgcatgaggatcctgtgggtgcggctgccttgtatagttatgggtgttgaatagtggtagttgctggttgatcattatttgttactatttacgttgcgattgaaattactcggggtaatagattagataattaggagtagggttaaaagggatgggataaaaaaagagagaaagtagagtttaattaggcctttttgagtagacacagtaatggaggctgaaatttgggtttgtgaaatggtctttggtatagacttttctagtcaaattaggtctagtagtagtgaagccagattttggcttgtggataggtttgagttgggggttgtatggtgaattgtgactgaatagaatcctagtattttggagaagttgaatgtctgtagtgggtattttagtttaaggttattagttatgagattaaactccattgctagtaagaagcctaaggtggtcacacctagggctgtgagcttcaggtggagtggtatggttgtttggggggatgacgcaggaataatactgttggtgaggaggaatccggcgaagatgctgctgattgttaggtgtttaattaggaaggggttattttcgttaataataaccagagtcatgaagtaaggttgccctattagagcgaagaaaataatatgggtactgtagacagctgtcaaggaggtggcaataagcgtaatagaaagggctcaggcattggtgtatgatgtgtttgcaggttcaataatgaggtctttggagtaaaagcctgtgaggaaggcatacctgtaagttgtgaggctgctgataaaatgggaggaggaagtgaggggtagagtcttgaatagccctcctatttttcggatgtcttgttcttcactgaggttatggatgagggacgctgaacatataaataatatagttttgaaaaaggcatgggtgcagatgtgaaggaatgctagatgcagctgattaatgccaattgtgactattataaggcctaactggcttgaggtggagaatgctatgatatttttgatatcattttgtgttacagcacaggtggctgtgaataaggtagtaatagcccccagacataatgtaaaggtttggattgataggttattttctattaaagggtagaagcagatgagcaggaacactcctgctacaactatagtgctggagtggagtagggctgagactggggctgggccttctatggcagatgggagtcagggatggaggccgaattgagctgactttcctgctgctgctaagagaaggctaattaatgggagggagttgggggtagggtctagaatttattttttgctgatattctcatgtgttggaggacaggaggaatcatgctatagctgaaataaagccaatattgccgatgcggttgtacagaactgcttggctgctgtattagcatctgctcggccgtaccatcagccgattagtaagaaagacatgattcctacgccttctcatccaatgaagagctgaaagaggttgttggcggtaaccagaattaatattgtgatgaggaaaataagtatttgaacaattgattaatgttagggtctgagtttatatatcatattgagaattctataatagatcaggtaatgaacagtgagtgttactgggataaatattgtggagaattagtctagcttgaagcttagtgagagtttgagagtttggacggtcattcagtgtcagtttgagataatgacttcttggtctgtgcatatcaacattgttgtaggaatgaggctaataacgaaggcacatgcgatagatgtttttacgtaatttgggtgtgaaacttttgcgggggttggctaaggtaatggtaatcggtaagattaaggggattagggatgttatagcagtggaagaatacatgtttgttgctttatttggagttgcaccaatgcttttggctcctaagaccaacggatgactctaatcctttaaaagttgagaaagccatgttgttaggcatgggggcacgagttagcagttcttgcatactttctcagtaggtaagaagttgcaggcttctatgattagatctgcaatctaatgttttggttaaactgtagctacagcatgcaaaccccataataagtttagggtttaaagataataggaagatagacgcaagatgtataagtattaatgtgttctctcgtgtaaaggaaggtttagtactgttaatataatatgcaagtgtccctcgttgtgttgtgattagcatatttagggagtaaagggctgtaattagtatattaagtcctataagcataatagtgatattagatcagaagaatgaggccacggtcacaaagagttctactagattaatggtgtggggtaaggcaaggttagtaagatttgctagaagtcatcaagaggctattagcagaagcagtgtttgaaggcgttcggtaagtaatagggttcacctatgggcctgctcgtagtttgaatttgctaggcagaatagtaaggctgaagtgagtccatgagcaattataagggtgactgcacctgttaagcttcaaggggtctgaatgaggatagccatgataacaagtgctatgtggcttacagaggagtaggcaatacatgattttagatcagtttgtcatagacaaatagagcttgtcataactctccctcatagggacagtatgaggaaagggtatgctatatgttctgttaggggattgaggagaagagtaagttgtattatactgtagccacctagctttaggagtcctgctccaggtactatcgagccgcaataggggcttctacgtgggctttgcggagtcataggtgaaacctgtatagaggtatttttactataaaagctatgatacatgctagtcatgtaggattgttggatcaggaggctaatggctcttgggtagtaagtattattactagcatgtttagtgaacctgaggtattttgagtataaacaagtgttacaagtagaggaagggatcctactagtgtgtaaaatagaagtatgagcttgcattgaggcgttctggttggttgcctcagtgggtgatgataattagggtaggaactagtgtggcttcaaaggggatataaaatataattagttctgtggctgtgaatgctctgattaaaaaagtcagtagggaaatcaatatagaaatatagagcttttttcatgggggtgattcattggacaggtgatattggcttctagcaaaaactgtaagaggcagtagacaggctattaagattagaagcggtgacgtcagcgggtcagaagagaaaattaatgagaggttggatgggttatcgctgaattggttaaaaaatagtaggctggcgaggctgatgagtaggctgtgaataatcatgttgattcagattatagaatttttagagaatcatgtcattggtaacagtataattgttggaataataatttttagcattgaagtaaatttagattttgtacgtaatccaggccatatgtgttggagattgaaactagtaaggcaaagcccactgcagcttcgcagggagcaaatactaggaggatgatggggattatgggtgctagagtgaaatgtatgcttaaagctgtaagagtatttatgataactattgatagtattatgccttctaggcataacagggatgatactaggtgggatcgatagactaatatccctagcagtgatatggtgtgtgctaataagggcatttggtaaacatggtctatcataatctaatgagtaaaaatcatttattttggcttaaactatttaccaattcatcccggtctaatcctttttgggctcattcatgtcaagcctaggattaaagtggtaattgtataagggctgcgctgattattagtgtcaggttggttatttgaagggctcatggcaggggtagtagtagagtgatctctgagtcgaaaaggaggaatgtgatggctactaggaagaattttatggaaaagaggaggcaggcggaggctattgggtcaaatctgcattcacaggggctggatttttctatataagtattacgctgtgggagcaatgcaattgttattagtaatagggccagtaaggtgttggttactagggctagtgtcaggttgattactctcttggatattattgaaactgattggaaatcaatggtattgtttatactaaaagagtaggatcctcatcagtagacagagacgtgtaagaatagtcatactacatctacgaagtgtcaaatcagacggcagcttcaaagccaaagtggtggctggatgtaaagtggaattttaattggcggagaaggcagatagtgagaaatgttgatccaatgatagcgtgaagtccgtgaaagcctgtggctgtaaagaacgttgagccgtagtttccatcggagagagtaaagagattgtgcagtgagcacaatctcagctcactgcaacctccgccttccgggttcaagccattctcctgcctcagcctcccaagtagctgggattacaagcaggcaccaccatgctggctaatttttgtatttttcttagagatggggtttcaccatattggccaggctggtctcgaactcctgacctcaagtgatctgcctgccttggcctcccaaagtgctgggaatacaggcgtgagccactgtgcctggccctgcattttttctttaaatgaggtatggaggagatgagagccttttggctcttttttttttttttttttttttgagactttttggagtttcactcttgttgcccaggctggagtgcaatggcacgatctcggctcaccgcagcctccgccttccgggttcaagcgattcttgtgcctcagcctcctgagtagctgggattacaggcatgtgccaccacgcccaggtaattttgtatttttagtagggacagggtttctccatgttggccaggctggtctcgaattcccgacctcaggtgatcagcctgcctctgcctcccaaagtgctgggattacaggcgtaagccaccgtgctggccgagccttttggttcttaaatgcctcagtctgacagcaggcagggtagtggtgttgtcaagtggactgattcaaattcaaattcagtcacttagtagttgtctaacatctggcaagttacttaatttgaattcagtttcttttcttttctctgtttctctctctttgagacagcatctctttctgctgcccaggctggagtgcagtggcacgatctcagctcactgcagccttgacctcctgatcccatgtgatcctcctgcctcagcctcctgagtagctgtaattacagacatgcattaccatgcctggctaatttttaaatttcttgtagagatggggtcttgctctgttgaccaggctggtcttgaacttctgagctccagcaatctgccctcctcggcctctcaaagcgctgagattacaggtgtgagacactgcacccagcctaaactcagcttcctcatatttatatgaggaacctacatctaccaaatgaggataaagaatatcacaatgcaatttgtaaagatttaaaaactcctggctgggcacagttgctcacacctgtaatcctagcactttgggaggccgagacaggcagatcacctgaggtcaggagtttgagaccggcctggccaacatggtgaaaccccatctctactaaaaatacaaaaattagccagacatggtggtgtgtgcctgtaatcccagctacttgagaggctgaggcaggagaatcgcttgaaaccggggggtggaggttgcaatgagccgagattgtgccactgcactccagcctgacagagcaagactctgtctccaaaaaaaaaaaaaaaaaaaaaagaagttaactcttttgcttaagacctggcacatgatgttcgcactcaacaaatattggttcccccgcccccctttccttggttactatttcagtcttctaagggttcattcacacccctaaggagaagcacttaatgtcaagaaaggactagtagtaactttcatgcatttattcagataataccttctgattgccatcatgtgccagatgatatgttaggtactgggaatgagtaaaaccatataaaccaaatggtatccaagataggtgtcaatcagtttagaaagttttttgtgctagggttaagaacacacccatgacacagcctcaggagctcctgacaacatatgcccaaggtggtcggggcacagcttgattttatatattttagggagacatgagacatcaatcaatatatgtcagatgtacattggttcagtccagaaaggcaagacaactcaaagtggggaggggccttccaggtcctaggtagataagagacaaactgttgcatgcttttgagtttctgattagcctttcattgaataaacagtttacagcagtggtcccttacccccaggccgcggaccagtatgggtctgtggcctgttaggaagcaggaggtgagcagccagtgagtattaccgcctgagctccacctcctgctagacctgtggtggcatgagattctcataggagggtgaaccctattgtgaacggtgcatgggagagatctagattgctccttatgagaatctaactaatgcctgatgatccaaggtggagcagtttcctctgaaaccatcccgcccaccccacatctgtggaaaaaatgtcttccacaaaaccagcccctggtgccaaaaaggtttgggactgctgatttacaggactagtcacttatgccttagtctggcttagtgaaacaatagggcagagcaagcaaatcagatgtgcatttgtctcacatgagcagagggatgactttgacttctgcctgtcctttgtctgcaaggaatttcctcatgggcaaattgtgagggagtgcggggcttgcgggggtggtggtggtggagggtggggtgggtatgtagctatcttacttaggaatagagtgggaggcaggtttgcccaaggcagttcccagcttgacccttccctctggcttagtgatttcggggagatttcttttcctttcacacctagaaccccggctctcagagggtttatggcattgtgggggagacagatcttccttgagtcatcacttacacaagtgtacaactgcaaccatgacacgggtctcaaaggagagcctcgcagtgaataagaacctagagatagatttgacctcgtcagagaggtcagagaaggcttgagtcttcagtgatgcttgagtcaagatctaccaaataagtccatctggcaaagagaggagggaagagtgtgccaggcagaggaagctgcaggtgcaaaggccttgtggcagcagggagcatggctagtaggtgggtttgaatcatgaccagcgtggatggagtacagggttttcagggggagtgaggtgtgaaagtgacgctggagagtaagtaggagtcagggcaggcagggccttggaggccaccctgggtcactagtgaatctttgaagtaagtggctacaataccagcatgcggttaatgattgtatgtgggtttgaacatttacaagttagtaaattatgtatagctgaaactgaagcaagttgtgagggttttcctagaaaccagatggaatgcaggatggtactagtgtgtccctgttttgtccacacatcaacaaaagcattaaaactgggcagacgcccagctcatcctccacctctgctgctctgggcctacatcctggggacggcggagcagtgcgccacccaggagatgtggctggaagctggggagtagagggcatcctctgatctttcatgaaaacagcccatggcagtgcacggtggctcccacctgtaatcccagtgcttgggaggcagaggtgggaggattgcttgagcccaggagttcgagactaacccaggcaacatagtgagaccctgtctctacaaaaaaataaaaaaaagttagcctggcatggtggcatgcacctgtagtcccagctactcaggaggctgaggctggaggattgcttgagcccaggagctcgaggctgcagtgagctgtgatggcgtcactgcactctggcctgcacaacagggcgagatcccatctcaagaaacaaaaaacaaaaaacaaaaaaaacccgcccatgatctggcgtcttaccccccgaagagctgaggagatgtaagtgtgaataattctgtctaatggattgctatcatccacgttcttctcagtgttaagaacagaggtcccaatccagaccccaagagagggttcttggatctcatgcaagagagaattcagggccagtccacagtgcaaagtgaaataaacttgctttattaagaaagtaaaggaataagagaatggctactccatagacagagcagccccgagggctgctggttgcccatttttatggttatttcttgagtatatgctaaacaaggggtggattattcatgcttcccctttttagaccatatagggtaacttcctgatgttgccatggcatttgtaaactgtcacggtgctgacggcagtgtagcactgaggacaaccagagaggtcactcttgcggccgtcttggctttgctaggatttagccagcttctttactgcaaactgttttatcagcaaggtctttacaacctgtattttgtgctgacctcctatctcatcctgtgacttagaatgccttaaccgcctgggaatgcagcccagtaggtttcagcctcattttacccagcccctattcaagatggagtttttggttcacatgcctctgacatcagatcaatgttgcttgttattactcttattattgtcatctcaaatctgaagagtcaccagaacaaacttccttctgccctttggtttgctccctcccctggctcccagcagcaggggggctgctgacaattcacagattagtagttgacttccatgggggctggagctcaggatcagaggcaagcccttttgactcatggtcgtggggtcccagcgtgaagctgctctgtgattgccctggaactcaacatgtcagagctgccacagggagatggcagaggctgcttggtagctgagaacaagggagacgccctgggagatgctcagaaacaatccgaggttcagaagcagggccagagcccccagggatgtgagcagagtggaaggagcaaggcatggccatcagtattccggccccagtgtattaatacctacgggctgggcgacctgggcatctgagcttgcattcagaggtgtcataggagagccccctggggcctgtgctgcggctccctccccaacggtggtgtctgatgatagggttttgcagcaggctatctcctccatccattcctgatggtcagaaggcaggagagcctgagaggacaacatctctgccatcaagtgggaactcgcagtgggattcctcactgtcttcccaaaagacacaatttccacagcatttgcgcatcttgttcacagggccctacctgtgtggtgctgatggcttattctccatccagatagccgaggatcgtagtttgtattttaaaatgatgtcaagcatgctcttaaaatgccccactagcgatgttagttatcattaatgtaatgttaatgatatccaaagaggagtaaaaatttgagcaaagtgccaaaaaagtaggattcttgattgctagtcacaaagcccaactttttattgaagtataacatacacacagaaaagtgcccagatcaaaagtgtacagctccaagaatgttcacaaacggaaagcacccaggtaaccggcaaccagatcaagaaacagaacaccccagaagcaccacctcatgcccgcttctggttactgtcttcttaggactgatctctacttgcaaccgcatggatgaattttgctgggttttaaactttatataaatggaatcctatggtgcatttttgccttatctcgttcaacactagggttggtgaatacactccaagttgggggtggagttgcagctcattcccattgcagtctgggattccatcgtgtgaatataccctaatgtgcttatccagccaacatgggcattggggtgctttcctgttcggggttattatggagagtgtttttgtgaagatttagagcatgtctctggatgaacacatgtacacatttctgtagggtatacacctaggggtggaattgttaggtcatatatatttacatccaactcaagctctttcatgaaagaagaaagaatgtactggatggagtttgctggctcaaagaattgacagaaaactagaagggaggtctgtaggaagataggtggaggcggagacagctcagcgagtccaaggagtggagcagaaatgacattcccaggacgctgccatccctggacattgctaccagtggacacaccatccctgcagcctgccagccctacccacctgccttgctgtatgactaccaaccccggaccacggtggcttccttgaaatgagtctcagcatcccttcatttgtgtcacattctccaggctcatagccccaagcaagggtccaggtagtccaccccaggtcaatgaccacttcccgactggtatggggctggaagcggggtgtgcctgagagacaggaaatacttcccttcttcagcttccacggtgggtactgcacaccactaagtttatatctaaggcatgatgtccctgctgtaggaagggaggggagatgctggacagttaagctgaaaacacaaaaatgacaactgtccccacagctgcactccacaatgcaagcaggctttattccattcatcttccactgacagagtgggggagctcagtgacatgtctgtggatctcacagctcatgtgcagaaatctccatctaagaagagggaactaggccaggcgcggtggctcatgcctgtaatcccagcactttgggaggccaaggcgggcggatcacttgaggtctgggcttcaagaccagcgtggccaacatggtgaaactccgtctctactaaaaatacaaaaattagccgggtgtggtggcgggcgcctgcaatcccagctcctcgtgaggttgaggcacaagaatcgcttgaacccaggaggcagaggttgcagtgagccaagattgcgctactgcactccagcctggacgacagaaagagactctgtctcaaaaacaaaaacaaaaacaaaaaaagaagaggcagctggattcaggatcactctaggaagggtgacccgtccccaaatgccataggtctggaagaggtgcagtaaaaggacagaaaagcatctcacaggggaaggtaaggaagagaggaggaaaaggaaaaggagagagaacaaaacggaggctgaatctggagggacggggcatgtaaaaacaacagggagaaggtttggtggaagaggaaagcagcatttttctgacctgattttgatgctctctgtacggccccgctttctcggcttctctgatgtgcctttatgacttgtgcttcgcttcatcgggttaatgatgttgacgtgaagcacagaataaagagatcctggtcataactgcactatcaaaggatctgaggtcctagcgtcacatccagcatacaattctgctctagtttgagcatcttaacaacactggtattattagtgagctgataatgaaactaagaatgagttttaacaaaagaagcaaggaacaaagatgtcctaaatccatttacgagggcagcaagtcattaattggtctggaaattacatttgcctctttgcaggcaattttatgcctccaacggaaccatggtctctttgaagtcatccattcttccctatattataccacggcatttagtacatttatttgttttaaatgataatcagagctttcatctatgtagcatctctgtttcctcccagacagaaaggcaggataattaccattaaacccaatttgcaggttagaacatttcaggcacaaatggcctgttctctatcacacagcaagtctctttcagaactagggagagaggcagtttccaaataaacagaatagaacaaacttacacaaagagctctgctcccactgtgtattctcctctttcatcgggatcatatgagtttggtttaggtaggaccttcaggttgatcttagacaatccaagagctaattcatcgatgtctagcctttccttggggcatccatgaatcaccttccttaaactaccagaatacggcttcctcctggagaatgtgggaagtgaagtgtgccacgggttactgcaacaaaggtgtttgcttcacggtgtgcagttatgatagtttgtgggtctccctacctgcaaacaggtagacctggaaggtagcacagttcagggggctaagggaactctggggccgggctgcctgccctcaaatcccagtttttctgcttaccatgtgtaaccttgggcaaactacataaacgctttgtgcctcagtttcccctcactctaagacatacggccgggtgcactggctcacacctgcaatcccagcactttgggaggccaaggtgggcagatcactcgaggccagtagttggagaccagcctggccgacatggtgaaaccccgtctctactaaaaatacaaaaatgagccaggcatgttggcgtgtgcttgtcatcccagctactagggaggctgagacatgaggatcacttgaacctgcgagtggaggttgcggtgagctgagattgtgccattgcattccagcccgggcgacagagcaagactctgtctcaaaaagataaataaataaaataaaacagacatgcacttatggtatttattgttggaagattgagtaccttaatgcacaccaatgctcagatgacttgggggcacataggggactgctgtcaccatgcctcactcctgcagggaaggggctgccctactaaaaccccagcgggcccagtgctgtgtccagaacaggtccttatattactgcagcccacaatggaactactgagtaggagccaaaagaggagggagcaggaagaggtggcatttggagaggggagaccgcacccacaggtctgccacagcgcgtcaacggtatggggtacttttacagtcaagttgacttcggtgtccgcccaccatctacctttgtaggaccactgaaacaagggacatccaccacggcccacagccggggcgccacggccccaggaggatatgctaagaaaaccattccacggccgggtgtggtggctcacgcctgtaatcccagcgctttgggaggccgaggcgggtggatcacgaggtcaggagtttgagaccagcctgaccaacatggtgaaaccccgtctttactaaaaatacaaaaaattagctgggtgtggtggcgcgtgcctatgatcccagctactcaggaggctgaggcaggagaatcgcttgaacccaggaggtggaggtcgcagtgagctgaggtcacgccattgcactccagcctgggtgacagagcgagactccatctcaaaacaacaacaacaacaaaaaaaaaacaaaagaaaaccattccaatcctgtgggttgttgtctttttactaggatgatggaaatgcaggaaatacagaacctctgcagct

SEQ ID NO: 349 - DNA, 229133 bp, Homo sapiens
gcagtgttcctatactacataatttgtccaaagtatccattcatctattgccatcaagccatcattattatagtgggtgtaacactaatttggtaagcgagagatggtgtgattacttccacagcagttactccatcatttctgaactttcaagtcactcaactttcatattaaaaataggtttggtctgacaaatcttttttaaaagcctccatttgaggcactttcagctgccgaaaaaacttgtcctttctataacctatctttaatgctggccagttttaacaaatggctttacagcttttgttaaagaaagttttgtctacataatgtgatgccgtaccattatcaaataataagaagtcaactataagtaatctagaatcttcattaccaagtgatttgttcagaagccagttgtcattttagttattaattggaagtacccaaattaaaataataatgttatagataaatgaaaaacaaaagtaacagaagtggtatttctcagtgcataaatttggggatttgaagaagataaggacatttatgttgaaaaacattccatgttgaataaaaataagataacaaagcatatataaatatagcctgtactgcatatgaaaataagcccagtaaagaattgtagccttgaggcatttcttttttttcttatttagttttaatttttgtgggtacctagtaggtatatatatttatggggtacataagatattttgatacacacatgcaatgtgtaataatcacatcactataaatagggtctctatcccctcaagcattttatcttttatgttacaaacaatccaattatacttttcagttatttttcaatgtaaagttaaattatttttgactatagtaaccctgttgtgctatcaaatacaaggtcttattctttctagctatttttttgtacccacttatgatctccacttttccccccaacaccccgactatccttcccagcctctggtaaccatccttctactctccatctctatgaggtcatttgttttatttttagctgccacaaataagtgagaacatgcaaagtttttctttctgtgcctggcttatttcacctaacataatgacctctaattccatctgtgttgttgcaaatgaccagatctaattctttccgtggctaaataatactccattgtgtatatgtacaacattttctttatccattcatctgttgatagacacttaggttgcttccaaatcttggctattttgtatagtgctgcaataaatatgggagtgtggcatatctttctgatatactgatttcttttcttttgggtaatgtatctaggagtgggattgctagatcacattgttgctctagttttaggttttcgagaagcctagaaactattctccatagtggttgtactaatttacatttccaccaacagtgtacaaggattcacttttctccagatcttcaccagcatttgttatcgcctgtcctttggctaaaagccattttaactgaggtgaagtgaggtgatatcttattgtagttttgatacgcatttctctaatgatcaatggtgttaattgagcaccttttcatatacttgttagtcatttgtatgtcttccattgagaaatgtctattcagatcttttgcccactttgcaactggattatttgattttttcctatagagttgtttgagctccttatatattctgattcttaatcccttgtcaaatgggtagtttacaaatattttatcccatgctgtggattgtatcttcacttcgttgtttgtttcctttgctgtgcagaagctctttaacttcatgtgatcccatgtgtccaaattgctttgatttcctgtgtttgtggagtattactcaataaatctttgcccagtccaatgtcctgaagagtttccctaatgttttcttgtagtagtttcattgtttgaggttttagatgtaaggatttaaaccattttgattgatgtttgtatatggtgagagacaggggtctagtttcattcttctgcatatggatatccagttttaccagcaacatttattgaagagacttgtcctttcttggcaatttagtgaataatgggtatactgtaactgtatggatgtatttctgggctctctgttctattccattggttgatgtgtccgtgtttatgccagtgccatgccattttggttactatatctctggagtgtaatttgaagtcaggtaatgggattcctccagttttgtcctttttacttacgatagctttggctattctgggtcttttgtggtttcatataaattttgagactgctttctagttttgtgaagaatgtctttggtattttgatatggattttattaaatctgtagattgctctcagtagaatggacattttaacaataaagactcttccaacccatgaacatcgaatatctttccatttttttgtcctctttaatttcctgcatcaatgttttatagatgtcattgtagagatttctcatttcctcggttaatatgtaggcatttaattttaattgtagctattgtaaatgggattactttcttgacttctttttctgattgttcgttgttcgcatgtagaaatgctactgatttttgtctgttgatttcatatgctgtaactttactgaatctgtatatcagttctaatcgttttttggtggagtctttaggttttttcaaatataagacctatcatctgcaaacaagaataagttaacttattcctttccaatttgggtgccctttatttctttctcttgtatgattgcttaagctaggacttccagtactatgaaaaattacagtggtgaaagtcagcatccttgccgtgttccagatcttagaggaaaggctttcagttttttctcattcagtatgatactagctgtggatctctcatatatgacttttattatgttgaggtatgctccttcaatactaagttttttgaggtttttatcgtgaagggacgttgaattttatcaaatgttttcccagcatcgatggaaatgattatattttttgtccttcattctgttgatataatgcatcacatggattgatttgtatatgctgaagcatctttgaattcctaggatagatcccacttagtcatgacaaatgatattttaatatgttgttgaactctattttccagtatttagcttagaatttttgcgtcagtattaatcagtgatattggcctgtagttttctttctttttttttttttttttgatgtgccattgtctcattttgatatcagggtaatattgacctcatataataagtttggaagaattcactcctcctctattttttggaatagtttgagtagaaatgatattagttccttagtgtttggttggattcatcagtgaagccattgggtcctgtattaatctgttttcatactgccttaaagaacttctcaagactgagtaatttataaaggaaagaggtttacatgactcacagttcagcattcctggagaagcctcaggaaatttacaatcatggcagaaggcaaaggggaagcaaggcacctccttcacaggcagaaggaaggagaagtgccaagtgaaaggggaagagcccctcacaaaaccatcagatttcatgagaacttactcactatcacaagaacagcatgtgggaaaccactcccatgattcagttgcctccacctggttgctcccttgacatgtggggattatggggattatacaattcaagatgagatttgggtgggacacaaagcctaaccatatcattccaccctggctcctaccaaatgtcatacgcctttcacatttgaaaaccaatcatgccttccaaaaagtctccaaactcttaatcatttcagcattaacccaaaagtccaagtccaaagtcccatctgagacaagacaagttccttctccctgtgagcctataaaatcaaaaacaagttagttacttcttagatacagtgggggtacaggaattgggtaaatatacctgttccaaatgggagaaattgaccaaaacaaaggggctacaggccccatgcaagtccaaaattgagtgggcagtcaattcttaaagctccaaaatgatttactttgacttaatgtctcacatccaggtcacactgatgcaagaggttggctctgatggccttgggcagctctgcctctgtggcttcacaggatatatcccccctccaggctgctttcacagggtggcaatgtttgtggcttttccaggtgcacagtgtgagctgtcagtggttctaccattctagggcctggagaatggtggccctcttctcacagctccactaggcagtgcccaagtggtgactctgtgtggggactccaacctcacattttccttctgcactgccctagaagaggttctccatgaaagcgccactcctgcagcaaacttctgcctggacacccaggcatttccatacatcctctaaaatctaagcagaggttcccaaatctcaactctggacatctgtgcacctgaaggcccaacaccatgtgtaagcttccaaggcctggggcttgcactctctgaagcaacagcctgaactgcatgtggccacagctggtatgcagggcaccaagtctcaagattgcagaaagccacaaggccctgagctgatcccaggaaaccatttgttctcctaggcctctggggctgtgattggaagggctgccaggaagacctctgacatgctttggagacattttccgcattgtgttggtcgttaacatttggctccttgttacttgtgcaaatttctgcagctggcttgaacttctcctcagaaaatatgtttttctttactgtcacatcatcaggctgcaaattttccaaactttaatgctctgcttcccttttaaacataagttccaattccaaataatctctttgtgaatgcataaaactgaatgcttttaaaagcacccaagtgacatctttgctttgttgcttagaaatttcctccactagatatgctaaatcatctctcttgagttcaatgttccaaagatctctagggcagggacaaaatgccactagtctctttgtgaaagaatagcaagaatcacctttattgcagttctcaacaagttcctcatctccatttgagaccacctcagcctggacttcattgtccatatcattattggcattttggtcaaagccactcaacaagtctctaggaagttccaaactttcccacatcttcctatcttcttctgagccctccaaactgttccaacctctgcctgttaccctgttccaaagtatcttccacattttcgggtatctttatagcagcaccccactttctgtagtacaaattcagggtatttgtttattttcatactgttataaagaactgcacgagactaggtaattcataaaggaaatagttttaattgactcatagctcagcatggctggggaaacctcaggaaacttacaatcacagtggagggtgaaagggaagcaaggaaccttcttcacaaggcagcaggaaggaaaagtgctgagtcaagggggaagagccccttataaaaccatcagacattgtgagaactcactcactatcatgagaacagcatggggaaaaccacccccacaattcaattgcctccaactggtctctcccttgacaagtggggattatgggaattatgaggattacaattcaaggtgagatttgggtggggacacaaagcctaaccatatcgggtcctgagcttttctttactgggaggctttttattaccacttcgatctcattacttgttatttgtctgctctgatgtcaaatttcttacttgtccaatcttagaaggttgtatgtgtctgggaatttttctatttcttctagatttttcaatttacaggcatatagttgctcatattagccactaatgtttctttgaatttcagcagtatcagttctaatgtttcctttttcatctctgattttatttaggtcttgtctcgtttcttttagttaagtctggctaacaatttgttaattttgtttatcttttcaaaaaatgaactttttgtttcatagatcttttgtattgtttcttctttccatttcatttattttttctctaatctttattaatccttttcttctactaattttgggttcacctagctcttgtttttctagttctttaagatgcatcattagattgttcatttgaaatttttcttcttttttggtgtactcattcatagctatactcttccctcttagtacttcttttgctgtaccccataggttttagtatgttgtgttttccttatcatttgttcaagaaatttttcaaaatttttcttaatttctttattaatccactcatcattcaggtgcatattgttgaatttgggtgtgtttgtatagtttccaaaattcctcttgttattgatttctagttttattccactgtggtcagaaaagagtctagatttttttttatttttttgaatattttcagccttgttttgtaacttaacatatggtgtattttttagaataatccatgctgaggaaaaagtgtgtcttctgcagccactggatgaaatgctccctgaataactattagatccattttgtctgtagtatagataaagtaggatgttctttgttaattttctgtccagaagatctgtccaatgttgaaagggggtgtgaaagtctagacctattattgtattgaggtttgtctctctccttagctctaataatccttgctttatagccctgggtgctgtagtgttgagtgtgtatatatttacaactgccacatctccttgctgaattgacccctttatcattacataatggccttctttgtctcttcttcacattttgtcttgaaatctattttgtcttataaaactactccaggtttttatttattttatttatttatttatttatttatttatttattttgagacagggtttcactgtcatctagcctggagtccagtggggtcaacatagctcactgcaacttcaaactcctggactcatgcaatcctcctgcctcagcccctgaagtagctgggactacaggcatatgccatcacacccagttaatttttgtatttttttgtagagatgggggtttcactatgttgcccaggccagtcttgtattcctgagctcaagtgatccacctgtctcaggctcccaaagtgtcttgctttttgggtttccattggcaagtaataactttttccagccatttattttcagtctatttgtgtctttacaggtgaagtgtttcctgtaggcaacaggtcattggatctttactattatgaattcaaccactctatgtatatttattggaaaatttagtccatttacattcaatgttattactgataagtaagaactgactcctgccattgtgttatttgctttctggttatattacagttttctcttctttcttttcttccttccagtcttccttttagtgaaaattattttctctggtaatatgtttagtttctttttattttctgttgtatctattctatgttttttcatttaaggttaccatgaggcttgcaaatgaatactatcttataacccagtatttcaaacagataacaacatctgcatatataaacaagtgaacaaagaagctaactaaaagaaaactagtaaaaactatatatcttaactttgttcccacactttttaactttctgttgtttctatttatcttactggtctgtttcagtcttgaaaatttgttgtagcttttgttgactggttcatttgttagtctttctacttaagattagaatagtttatacaccaaagatacagcattataatattctgtgttgttttgtgtattcactattatgagtgagtttcataccttcaggtgattattgagtgagttttgtattttcaggtgattattgattgctcattaatatatttttctttctgatttaaatactccctttagcatttattataggaaaaatctggtgttgatgaaagccctcagcttttgttttcctggaaaagcctctatttctccttcatgcttgatgaatatctttgccagatatacaattctagaataaaggtttttttcttcttagctttaaatatgtcatgccactctctcctaacttgtaaattttccactgaaaagtctgctgccatacatattgaagcatcattgtatgttgtttcttttctgctgctacttttagaatcctttccttttcattgacctttgggagtttgattattaaatgccttcaggtagtcttctttgggttaaatctgcttggtattctatagccttgtacttggatgttgatatctttctataagtttggaacattctctgatattatcttttgagtaaactttctaccctgatctctttctctacctcctctttaaagccaataactcttagatttgcttttttgaggctattgtctacatcttgtaggcataattcattcttttttatttttttcttttcagtcttctctgactttgcctttttcaaatagcgtgtctttgagctcactaatcctttcttctgcttgatcaattctgctattgaatgactctgatgcagtcttcagtatgtcaattgcactttttaactccagagtttctgcttgattctttttaactatttcaatatcattttaactttatctggtagaattatgaattccttctctgtgttatcttaaatttctttgagtttcctcaaaacagcttttttaaatttctttgtctgaaaggttacatatctctgtatctccaggattggtccctggtgacttatttagttcaattggtgatatcatgttttcctgaatggttttgatacttgtggatgtttgttggtgtctgggcattgaaaagttagatacttattgtagcgttcacagcctgtgcttgttggtacccatccttcttgggaaggcttttcatatattcaaatggacttgggtgttgttatcaaagccatatctgcattagggaacaccccaagcccagtaatgttatggttctttcagactcatagaggtacccctttggtggtcttggatgagatctggaagaaatctctggattaccaggcagtgattctcgttctcttcccttactttctctcaaacaaatggagtctttctttctctatgctaagcctctggagctgggggtgagtaacataagcacccctgtgcccaccaccactgagactgtgctgggtcagacctgaagccactacagcactgggcctcaaccaatgcccactataaccactaactggctaccatctatgttcactcaaggccctagagctctataatcagcaggtagaaaaactaaacaggcttgtgtctttcccttgagggtggcaagttcacccaaggacctgggcaggctcacagatgccatctaggagccagggactggagtcaaaaaccttagaaatctatctggtattctattgtactgcaaatgagctggcacctataccacaatacaaagtccttcccactcttcctttgccttcccatacaaggagcctctccctatggctgccaccaccatcatcccatgggggcttctgccaggcccacaagtgttcatttacaggccaagggctcttcagtcagcttgcagtgaatgctgccaggcctggaactcaccactcacgtgagtaggatcccctctgcccctgggaaggtccagaaatgctgtttaagagccaatgcctggaaacaagagtccccagaagcccacttgatgatctaccccactatagctgagcttgtacctcaggtgcaagacaaggtctcctttactcttccccctactttttctcaaatagaaggagtctctcaccatagccaccacagctggaaataggctgggtctgacctgaagccaacacatctcagagtctcacccaagatccatggcatactatgagggaatcactgctgggtattcagaacccatgggccctttcgtcagcatgtgatgaggcctgcctggactgggtatttctcttctaggcaacaggttcccttttggcccagtgtgtgtctagaaatgtcatccaggagctagcgcatgtaatgtcaaccaggagttaggacctaaaacagctcacttggtgccctgtcctactgtggctgagctggtatccaagaaacaagacaaacttatctttacttttcccccttctctccttaagcagaaggatgggggtctcttttagagccacaagctgtgctgcctggtgttaggggaggagtgacaacaggcactcccttagccaccctggctggggtctcattagtttgcatgatgcccacaagtccactggctctgatccccactcagcagtaggatttgcctaggacttgcagtccttgtggcctagcctgcctttcaaatttatttggagtcccagaaaactttagcccatggtagtgagtcttgccagaattcaagttctagccactgggatgggcaattgccctctggctagggctcatctaaacgttccttccatgggtaggcatcagctgagttcagcccagttttgctttctgatgtgacaagacagcactgagttcaatacaaaatctcacagttgctgaactctccttcttccaagtgcacagattctctctctgtgccatgtggctgcttccaggagatgggaggcagcattagtgattcaaggctgtatttcttttcatcttcagtgcctctttcagtgatatgaagttaaaatcaggtattgtgagtgctcccctgatttttagttcttaagaaggtgcttttttgtgtagacaatttttaaatttggtgtttctttgggggtacaatcagtgaagacttctatttggccattttgctcctagtcatctgagctctccctttcatttttggatagacaattattgtaacatcgaacacttcatctgagatataaatgttttggtggggtgataacacacctacgcactggaacaacagatatgcattacttcgtgcaaaatttgctgagtaaaatcccaaaactagtataaacacagacacatagaacaatggaacagaatagagactccaaatgtaaatacacacatttacacacaactcatattttttaaatttaatttaatatttttatacattaagttctgggatacatgtgcagaacgtgcaggtttgttacataggtatacaagtgatgtggtggtttgccacacccctcaacccatcatctatattagttatttctcctaatactatccctcccctagtcccccaccctgacaggccctggtgcgtgaagatctcctccctgtttctatgtgttctctttgttcaactcccacttataagtgagaacatgcaagtgttcggttttctgttcctgtgttagtttgctgaggatgatggtttccagcttcatccatgtccctgcaaaggacatgaactcatccttttttatggctgcatagtattccatggtgtatatgtgccacatttttttaatccagtctatcattgatgggcatttggtttggttccacgtctttgctattgtgaatagtgccacaataaacatacatgtgtatgtgtctttatagtagaatgatttataatcctttgggtatatacccagtaatgggatttctgggtcaaatggtagttccggatgtagctccttgaggaatccccacactgtcttccacaatggttgaaataatttacactcccaccaacagtgtaaaagtgttcctattcctctacatcctctccagcatgtgctgtttcctgatttttaatgatcgccattctaaatgacatgagatggtatctcattgtggttttgatttgcatttctctaatgaccaatgatgatgagcattttttcatatgtttgttggctgcataaatgtcttttttgataagtgtctcttcatatcctttgcccactttttgacggggttgtatttttcttgtaaatttgtttaagttctttgtagattctggatattagccctttgtcagatggatagatggcaaaaattttctcccattctgtaggctgcctgttcactctgatgatagttccatttgctgtgcagaagctctttagtttaattagatctcatttgtcaattttggcttttgttgacattgcttttggtgttttagtcatgaagtcgtttctcatccctatgtcctgcatggtattgcctatgttttcttctagggtttttatggttttaggttttatgtttaagtctttaatccatcttcaattaacttttgtgtgtaagtgtgtttttggttttttgtttttgtttttgtttttttttttttttgagacggagtctcactctgtcacccaggctggagtgcagtggtgtgatcttggctcactgcaacctctgcctcccgaattccagtgattttcctgcctcagtgtcctaagtagctggcagtacaggagtatgtcaccacacctggctaatttcttgtattttagtagagaaggggtttcaccatattagccaacatggtctcaatctcctgacctagtgacctgcctgccttggcctcccaaagtgctgggattacaggtatgagccatgatgcccagccattaatttttgcatatggtgtaaggaaggggtccagtttcagtgttctgcatatggctagccagttttcccaacccatttattaaatagggaatcctttccccattgcttgtttttgtcaggtttgtgaaagatcagattgttgtacatgtgtggggttatttctgaggcctctgttctgttccattggtctatatatctgttttggtaccagtaacatgctgttttggttactgtagccttgtagtatagtttgaaatcatgtagcatgatgtctccagctttgctgtttttgtgtaggattgccttggctatataggctctgttccatatgaaatttaaactagttttttctatttcctaattctgtgaagaaattcagtggtatcttgatgtggatagcattgaatctacaaattactttgggcagtatggccattttcatgacactgattcttcctatccatgagcacagaatgttcttccatttgtttgtgtcctctcttatttccttgagcagtggtttgtagtcctcgaagaggtccttcacatcccttgtaagttgcattcctagatattttattctttttgtagcaattgtgaatgggagtttactcatgatttggatctctattattggtgtataggaatacttgtgatttttacacactgattttgtatcctgagaatttgctgaagttgcttatcagcttaaggaaatttggggctcagatgttcgggttttctaaacatacaatcatgtcatctgcaaacagagacaatttgacttcctctcatcctatttgaataccctttatttctttctcttgcctgattaccccggccagaacgtccaatactatgttgaataggagtggtgagagagggcgtccttgtcttgtgccagttttcaaagagaatgcttccagcttttgcccattcagtatgatattggctatggatttgtcataaatagctcttattattttgagatatgttccatcaataccgagtttattgagagtttttagcatgaaggggtgttgaattttatccaaggccttttctgcatcttttgagataatttttggcattgcttctgtttacgtgatggattacatttatcgatttgtgtatgttgaagctgccttgcatcccaagaatgaagttgacttgatcgtggtggataagctttttggtgtgctgctggattctgtttgccagtattttattgaggatttttgcattgatgttcagcagagatattggccttaaattttctttctttcttgtgtctctgccatattttgctataaagatgatgctggcctcataaaatgagtagggaggagtccctcttttcctatcatttgaaatagtttcagaaggaatggtaccagctcctctttgtacctctggtagaattaagctgtgaatctgtctgatcctgggctttttttggtttgtaggctattaattactgcctcaatttgagatcttgttattggtctattcagggatttaacttcttcctggtttagccttgggaggattatgtgtctacaaatttatcctttttttttttagattttctagtttatttgcatagaagtatttatagtattctctgatggcagtttctgtttctgtgggatcagtggtgatattacctttatcattctttgttgcatctatttgattcttctctcttttattctttattagtctggctagcagtctatctattttgttaatcttttcaaaaaaccagctcctggattcactgatttttttaagggttttccgagtctctatctccttcagttcggctctggtcttagttatttcttgtcttctgctagcttttgaatttgtttgcttttgcttctctagttcttttttttttttaactttttttttttttatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgacattccccttcctgtgtccatgtgatctcattgttcaattcccacctatgagtgagaatatgcggtgtttggttttttgttcttgcgatagtttactgagaatgatgctttccaatttcatccatgtccctacaaaggatatgaactcatcattgtttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcatttgggtatatacccagtaatgggatggctgggtcaaatggtatttctagttctagatccctgaggaattgccacactgacttccacaatggttgaactagtttgcagtcccaccaacagtgtaaaagtgttcctatttctccacatcctctccagcacctgttgtttcctgactttttaatgattgtcattctaactggtgtgagatgatatctcatagtggttttgatttgcatttctctgatggccagtgatgatgagcattttttcatgtgttgtttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccattttgtaggctgcctgttcactctgatggtagtttcttttgctgtgcagaagctctttagtttactgagatcccatttgtcaatttcgtcttttgttgccattgcttttggtgttttggacatgaagtccttgcccacgcctatgtcctgaatggtaatgcctaggttttcttctagggtttttatggtttcaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctctttttcggttccatatgaacttgaaagtagttttttccaattctgtgaagaaagtcattggtagcttgatgcagatggcattgaatctgtaaattaccttgggcagtatggccattttcacgatattgattcttcctacccatgagcatggaatgttcttccatttgtttgtatcctcttttatttccttgagcagtggtttgtagttctccttgaaggggtccttcacatcccttgtaagttggattcctagatattttattctctttgaagcaattgtgaatgggagttcactcatgatttggctctctgtttgtctgttgttggtgtataagaatgctcgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaatacccttcatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggttttcgtctttggctctgtttatatgctggattacatttattgatttgcatatattgaaccagccttgcatcccagggatgaagcccacttgatcatggtggataagctttttgatgtgctgctggattcggtttgccagtattttattaaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttatacctctggtagaattcggctgtgaatccatctggtcctggactctttttggttggtaaactattgattattgccacaatttcagctcctgttattggtctattcagagattcaacttcttcctggtttagtcttgggagagtgtaggtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttcttttttctttattagtcttgctagtggtctatcaattttattgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttctgtctttgttctcattggtttcaaagaacatctttatttctgccttcatttcgttatgtacccagtagtcattcaggagcaggttgttcagtttccatgtagttgagcagctttgagtgagattcttaatcctgagttctagtttgattgcactgtggtctgagagatagtttgttatagtttctgtcctttcacatttgctgaggagagctttacttccaactatgtggtcaattttggaataggtgtggtgtggtgctgaaaaaatgtatattctgttgatttgtggtggagagttctgtagatgtctattaggtctgcttggtgcagagctgagttcaattcctggttatccttgttgactttctgtctcgttgatctgtctaatgttgacagtggggtgttaaagtctcccattattaatgtgtgggagtctaagtctctttgtaggtcactcaggacttgctttatgaatctgggtgcttctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatactgttatgtgtgaatctgatcctgtcattattatgttagctggttattttgctcattagttgatgcagtttcttcctagtctcaatggtctttacattttggcatgattttgcagcggctggtactggttgttcctttccatgtttagcacttccttcaggagctcttttagggcaggcctgctggtcacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcattggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagacttcttctctcagctcgtcaaaatcattctccatccagctttgttccgttgctggtgaggaactgcgttcctttggaggagaggcgctctgcgttttagagtttccagtttttctgttctgttttttccccatctttgtggttttatctacttttggtctttgatgatggtgatgtacagatgggttttcggtgtggatgtcctttctgtctgttagttttccttctaacagacaggaccctcagctgcaggtctgttggaataccctgccgtgtgaggtgtcagtgtgcccctgctggggggtgcctcccagttaggctgctcgggggtcagggatcagggacacacttgaggatgcagtctgcccattctcagatctccagctgcgtgctgggagaaccactgctctcttcaaagctgtcagacagggacatttaagtctgcagaggttactgctgtctttttgtttgtctgtgccctgccccccagaggtggagcctacagaggcaggcaggcctccttaagctgtggtgggctccacccagttagagcttcccagctgctttgtttacctaagcaagcctgggctattgtgggcgcccctcccccagcctcactgccaccttgcagtttgatctcagactgctgtgctagcaatcagccagactccgtgggcgtaggaccctccgagccaggtgcgggatataatctcgtgatgcgccgttttttaagccggtctgaaaagcgcagtattcgggtgggagtgacccgattttccaggtgcgtccgtcacccctttctttgactcggaaagggaactccctgaacccttgcgcttcccaggtgaggcaatgcctcgccctgcttcggctcacgcagggtgcgcgcacccactggcctgcgcccactgtctggcactccctactgagatgaacccggtacctaagatggaaatgcagaaatcacccgtcttctgcgtcactcacgctgggagctgtagaccggagctgttcctatttggccatcttggctcctcccttctctagttcttttaattgtgatgttagggtgtcgattttagatctttcccactttctcctgtgggcttttagtgctataaattttcctctaaacactgctttagctttgtcccagagattgtggtatgttgtgtctttgttctcattggtttcaaagaacttatttatttctgccttaatttcattatttacccagtagtcattcaggagcaggttgttcagtttccatgtagttgtgcagttttgagtgactttcttaaatctgagttctaatttgactgcactgtggtctgagagacagtttgttatgatttccattcttttgcatttgctgaggagtgttttacttccaattatgtggtcaattttagaataagtgcaatgtggtgttgagaagaatgtatattctgttgatttggggtggagagttctgttgatgtctattaggtccacttggttcagagctgagttcaagtcctgaatatccttattaatatttggtcccattgacctgtccaatgttaacagtggggtgtttaagtctcccacttttattgtgtggaagtctaagtctctttgtaggtcgctaagaacttgctttgtgaatctgtgttactatattgggtgcatatatatttaggatagttagctcttcttattacattgatccctttaccattatgtaatgcctttctttgtcttttttgatctttgttagtttaaagttggtttaatgttggtttgttttatcagagacaaggattgcaaccccctgctttttttttctttccatttgcttggtaaatcttcctccatccctttattttgagcctatgtgtgttttgcatatgagatgggtctcctgaatacagctcatcaatgggtcttgactctttatccaatttaccagtccatgtcttttaactggggcatttagctggtttacatttaaggttaatatattatgtgtgaatttgatcctgtcattacgatgctagctggttattttgcctgttagttgacacagtttcttcatagtgtcgatagtctttacaatttggtatgtttttgcagtggctggtaccagttgttcctttccatatttagtgcttctttcaggagctcttttaagacaggcctggtggtgacaaaatctctcagcatttgcttgtctgtaaaggattttatttctcctttgcttatgaagcttagtttgactggatatgaaattctgggttgaaaattatttttgttacaattgttgaatattggccaccactctattctggcttgtagggtttctgcagagacatctgttgttactttaatgggcttctctttatgggtaaaccaacctttctctctagctgcccttatcaatattttccttcttttcaaccttagtgaatctgacaattatgtgtcttggggttgctcttctccaggagtatcttcatggtgttcattgtattccctgaatttgaattttggcctgtcttgctaggttgtggaatttctcctggataatatcctgaagagtgttttcctacttggttccattctccccatcactttcaggtacatcaatcaaatgtagatttggtcttttcatatagtcccatgtttcctggaggctttgttcattccttttcattcttttttctctagtcttgtcttcatgctttatttcattaagttaatcttcaatctctgatatcctttcttccacctgatttattcagctgttgatacttgtgcatgcttcacgaagttcttgtgctgtgcttttcagctccatcaggacatttatgttcttctctacactgattattccagttagcaattcctctaatcttttttcaaggttcttagcttccttgcattggcttagaacatgctcctttagctcagaggagtttgttattacccaccttctgaagcctacttctgaaaattcatcaaaccaattctctgtccagttttgttcccttgctggcaaggagttttgatcctttggaggagaagaagtgttctggtttttggaattttcagcctttttgcactggtttttcctcatcttcatggatttatctacctttgatctttgatgttggtgaccttcagatgggtttctgtgtgcacatcttttttgttgatgttgattctatggctttctgtttgttagttttccttctcacagtcaggaccctctactgcaggtctgctggagttcgctggaggaccactccagatcctgttgccgggtatcaccggcggaggctgcagaacagcaaagattgttgcctgttccttcctctggaagatttgtcccagaggggcacccacctaatgccagctggagctctcctgtatgaggtgtctgttgacccctgctgagaggtgtctcctcatcaggagccaggggggtcagggacccccttgaggaagcagtctgtccctcagcagagctcaagtactgtgctgggagatctgctgctctcttcagacctggcaggcaggaatgtttaagtctgctgaagctgcacccatagccgccccttcccccaggtgctctgtcccagggagatgagagttttatctataagcacctgactggggctgcctttctttcagagatgccctacccagagaggagaaatctagagaggcactctggctacagcggctttaccaagctgtggtgggctcctcttagttcaaacttcctggtggctttgtttacactgtgaggggaaaactgcctactcaagcctcagtaatggcagacacccctccccccaccaagctcaagcatcccaggttgacttcagactgctgtgctggcagtgagaatttcaagccagtgtatcttagcttgctgggctccatggggtgggatccactgagctagacaacttggctccctggcttcatccccctttccaggggagtgaatggttctgtctcactgacattacaggtgccactgggggggggaaataacctcctgcagctaactcagtgtctgcccaaatggctgcccagttttgtggttgaaaccctgggccctggtggcataggcacccaagggaatctcccagtctgcaggttgcaaagaccatgggaaaagcatagtgtctgggctggagagcaccattcctcatggcacagtccctcacatcttcccttggctgaaggagggagctccccaaccccttgcacttcccaggtgaggtgacaccccaccctggttcggctcaccctccttgggttgcacccactctctaacctgtcccagtgagattagccaggtacctcagttgggaatgcagaaaccacccgccttctgccttgatctcgctgggagctgcagactggagctgttcctattcggccatcctgccagccactccaactcatatttttaacaaaggtgccaagaacatacaatgaggaaacgacagtgtctttaataaatggtgttgggaaaactggataactagatgaagaaaattaaactatactcctatctcccatcatatacaaaaatcaaattgaaatgggttaagaacttacatctaagacctgaagccatgaaagtactagcaaaacacatcagggaaatgctgcaggacattggtctgggcaaatatttttgttcaatctcaaaagcacaggtaaccaaagcaaaaatagacaaataggattacttcaaagattctgcacagcaaaggaaacaatcaacaaaattaagagacagcccgccaaatgggagaaaatatttgcaaactacacatatgacaaaggattaataagcaaaatatataaggagcttaaatatctcaatagcaaaaaacaaattatccaatttaaaaatgggcaaaaggtttgaatagacatttctcactagaagatatacaaatggccaccaggtatatgaaaaaatgctcaacatcactaatcatcagaatgatgcaaatcaaaagtacaatgagatatgatctcaatgaatggcttttatcaaaaagacaggcagtaatggatgctttcaaggatgtggagaaaggggaaccttcatgcactgttggcaggagtgtaagttagtatagctactatagagaacagtattgaggttcctcaaaaaactaaaaatagtactaccatatgatccagcaatcccactgctgggtatatatccaaagtaaaggaaatcaatatattgaaaagacacctgaaatcttatgtttattgcagcactatttataaaagccaacatatggaatcaacctaggtgtccatcaaaagatcaatggataaagaaaatgtggtatatatatatacagtggaatattatccagccattaaaaaatgtaatcttatcatttgcagcaacatgatggaattggaggtcattatgttaagtgaaataagccaaacacaagaagacaaatatcacatattctcacttctatgtgggagctaaaaacaaaaagtagatctcgtgaagatagagagtaggctggtggttaccagaggccaagaagggtagtggagaggggatattgggtagaaatatacagttggatagaagaaataaaacctagggttagatagatctgtagggtaactatagtttataataatctattgtataattcaaaatagctacaagaaaagaatttgaatggttctgtcataaagaaaagaccaatatttaaggttatgaatatcccaagtatactgatttgatctttacaaattgtatgaatgtattaaattatctcatattccctgaaaatatgtatatctattacgcatcaatttaagtaaataataatatgcataaaaaatttaaaacttagagttgaaatttcaatacaaaattattgaatcaagtgaaatatcacaactcttctcttaaacttgttgcatttaaacatctggttggccgggcgcggtggctcacgcctgtaatcccagcactttgtgtggccgaggcgggcagatcatgaggtcaggagatcgagaccatcctggctaacacggtgaaaccccgtctctactaaaaatacaaaaaaaaaaaattagccgggcgccgtggcgggcgcctatagtcccagctacttgggaggctgaggcaggaaaatggcgtgaacccgggaggcggagcttgcagtgagccaagatagcgccactgcactccagcctgggcgaaagagcgagactctgtctcaaaaaaaaaaaaaaaaaaaatacgtctggtaatcgtgagtctgttgttactacttttaagtatttcagtcctaaaacactaggtgagcttttttccatagattctctatttaaatgaacattttagtggtggtatgcacaaatcattaagaaagtgaaaaataattgatgtttatataaggatcctgtattaatttgctagggctgccataacaaacatattatcaacaacagaaatgtattttctcactcttttggaggctaaaagtccaagatcaaggtgctggcaggattgccatctcatgagacctctctcttcggtttgcagatggctgccttcttaccatgtccttataggaccttttctctgtgtgtgcacatccctggtatctgtttctcttcctataagactcccagtctgatgggattatggtcccacttttatgaccttatttaactttaattacctttataaagttcatatctccaaatacagttacattgggggttaaggcttcaagatattaattttgaggaaatacattttggttcataatatatccatttccagtattacctgttgggtgcatttatgggatccaacatcaataaacatttaccatcaatttcatcatcatcatcaacataaccatcaagtattttgaaaatacctagaaaatcacttaaaaatcacttaaaaattccatttgtatgtggctattacagtttatgagggaccattaggtacatcttctcattcaattctcacaactattctaacgttaaaaagtcaagattattatcctagtcttaaaggtgcaaaagagacacagaaaggcctcctcaagctgcagaaaattccctcgctgcaactgcagagaacaagagccttggaggttatctgtcatggagaggaagttccataaattgaagcaggtcaatagtcaccatctaagccaataaataaaaaatccacccccaggactttccagatagataccaaagcttggtggttaccaaggtcaggaatccatatgctgacccaatttccattcccttgtttatgaatctcccttcccctttctccatttggtttggaagtaaatggaagaagaattgaagcagaccagacaagaagggaaatagtcacttattcacaattttacacctgaaacctaaatttgccatgatttttcattggaatttgattgctacaaatttcaaagatatgctgccttttaaaatctaaataggatttcactgaatagaatacaaggaaattcaagtgactaaaattctttcacatcattattagagtataattctatttagagagatttgtgataataaactgctacttgatacagaagttctaaggattggagagatatagttgcacagagctgtgaatagaatcattttccaaaaagcgacattcataacaattccagctggggagaataaatggtacattcatgcatctacatggtcatcaccatcatgatgtttaaaaaagaaaagctgtggtgtttgactgctatacatgcatttatgctaagcgtctcttcttttacagtatctgctaaatcagtggttctcaattggacaggtaacagaagctgatcagtgagaaaagccaaaagaaggagatttcatttagctggggaaatttttaaactacaacacccactctccatatgtgccagaatcagaagcaacagaagaggaaaagcatctgtaatttgatagagctttctagaggattccactatcctccaactatttttattcttaactcgctgttttgagtaatggaggactactacttttctgacaggtcaggggaggaaaacacccattttataattgaggattttagacccagaaaaaaatattgagatcacagtacccagtttcctcattttatagtttaaggccccacattgcactagtttttatagtttaagtatagttgcacaattaaaacagctttttataatcctttgtgtatatagccagtaatgggattgctgggtctgttcacaacagcaaagacttcgaaccaacccaaatatctatcaatgatagactggataaagaaaatgtggcacatatataccatgaaatactatgcagccataaaaaaggatgagttcatgccttttgtagaacatggatgaggttggaaaccatcattctcagcaaactaacacaggagcagaaaaccaaacaccacacgttctcactcataagtgggagtcaaacaatgagaacacatggacacagagaggggatcatcacacaccaggacctgtcagcagtaggggactaggggaggtacagcattaggagaaatacctaatgtagatgacaggttgatgggtgcagcaaaccaccatggcacgtgtacacttatgtaacgaacctgcacattctgcacatgtatcccagaacttaaagtacaataaataaatttaaaaaaagaatttttatcacttaaaaagagagcttttttccatagcaaactaatctacaatagaaagttgaatccatgaatgtttatttactgcatcctttggcaaaacattactgagcaattggatatattatttctaattctgacatctactctgtactctgtgagataaatattttccctattttacaaattgggttgtaaattttcccaagatctcctaagtagtattggtggggttgggatttgaacttaggccatataactccggagcctgcactcttagccaatatgcttctctagttgctgcttgccatgtacctggttctctgttatattctgcaaatataataatgggaaaaatatcctactttcatgaagctagcataaattaaaaatataccaattattaagtatatactttcacattttgataagtaccacaaataaaaaacacaagatattataagagggaacatcttaatttgtgaggtcagaaaagagaagtgatacctaaactgaggttaagaaggggccatacacgtgaaaagaatttaaggcataggaaataacatatgccaaggccctgagatggaggagtttagcctcctcaagaaactgaaaggctgatatgagtaggatgtgggtagtattcaggagagtaatgccagaaaagatgaaaaggcaggcaaggaaggaaaaaccatgcagaactttgtattccttgttaaagggtctgaatttctctctagataggtgatgccaatgtctggggaggaggtggggcacatttcctgcttccttgatgtgtaggccacttgaatattgcaactagtttttctcctgcttattgccatctactagggtctttgtcatccccctttttctatgtatggtcttcctttccatctagactctatcatcattcataatagcttcaacacttacaagattatccactagtgattctaatttattttgtaccattccaccacagtcacccacactatggttatatcctattccttatgttttatcactggaaattgctccaccttcaaaaatctcaatttcaaacattacagttttcagtcaccacttccaaatcctctagaacacttgcttaatacccccactgccaaaattcttgaacctgatcaaaccctctgtcccgtggactccaccattttctcaccatcagcacatcttcttttctccgcactaaatgtaacagtagaaaataaaagccctggttgatgccaatatttaaggtggtcaaccaaacagctgaacattgatgaaagacatcacacaggtaaattaaccaactttgtataacattcataaccacaaagcccgctggacctttaaaacacttgcaatctgacaatatttccccacggtttttgctacattgtgaggtgactattttacatctttttctcacttttctatttgtaatgatttgtctcatttagatttcactttatgtatatggagtaaataaaagccattaaacaagagctctctcatcttcatgtcgccaaatctgtaaaccttcctgcactagcacccacttctgctccttccctcttcttaaaagggagaatgtgtctttccttctatcagagttcacaccttgtttttttgaaggccatctcttttgccttctgaagggcttcactctggcactatcccctctgtttcatatcataaatattccatttctagtgtttgttcttcagagaaaaaaacacaaacctccattggccccacattgcacttgcacttcatttcccttcttctacttctctttttagtagaacctctcagtattgtccacttcttcagccctgttcactcctctctgaaggtctaccttctggttctataagcccgctgctggagtctgtcaaagtcattgacaccaccttgttgccaaatataatcatcaattatctgttcttatattagtcctcctctcagtagcatctgatataattaaccactcctgacctgaaatgcctgtctcctttgattctacaacaacataccccctgattttcctcttacctgattgagctcctcgtcaatcctctttccaggtcctccttctccatctgatctctgattcttcctcttctacatgtcttactctaaatgtaatggttctccactgctttgtccagggtttccttatcttttctctctctctttctactctctcccagggtgaattaaatagcattcatgtactgatgacttacaattttacatgtctggcctcaacctatcctctgaccttttgacctgtatattaacgtcccacttgatatctatcaaagagaaatgaagtaagacagattttattcagattactgcagtaaagaagagagaattgagtgcaaactgatctgaactccaccaaaacaagtcaggagactttttaaatactgggatatgctttcttaaggggttggaggtcaggagtaggaggtggtgaggggttggtgaatgtgattaggatatctgagtttgcacattggtgagtataggaggagaaacaaactcttcttatctataggacagaaggaagtattgcaaattaaagcaagatgtccatcaaagttaggctctttcccttccacatgaactgagagtcagaaaaactacctccctagatgtttatatttccaagagatggctctcaggctcttaaggagagcctgagatataaacatttatgggtgaaagaagatttacttatcaaaggggcagataaaggatcgacaatggcaagttttctaaactgctccaagaaaagggagactaggagcctatggtcaggttttggctggaacaaatgataaattattttggcagtattgagctttctcaagaagactggggttatcctagggacacggtcttgggctgatagaagccactagagtttggtcaagccttttagtgcaggaagttggactaaatcattcacaccaagaattttgcagctgtcacctgtttacttaatagttgataggcatctcagaactaatctgatcagaatgcacctcttaatttcttcccagatatgaccctatcctagtttgccctacattgttgtatctgttgcctcatatttacagcatatcttttcttatccccacccacagcccagcaatcaattagcaaatttgggccctaattggtctagttattctctccctgtctactgctgtcactctgattcaagacaccatcatttatcctctaggactctggtctgatatacatatatccagtggaaatcactgttcattaggtcaaatgtccatcccaggtgtggctgggcagtatctacaggggtctgtgatgggcaggcacagtgacttatatttctaaggtaaaagctagttcatttaggttctagggcatgaactgtaatttcccaatctgtgacaactccccttcctcttacagtctccctgggcaatatctattctttggtccttctttcatgcaatactttaaaatgtaaatataaaagacaatgttgtttatcacagtttttaataggaactaaaaccccacacaaaaatatagatatgtgaacaagtaaaattcaggtatcaaccagtaaggggaactccaagaggcagtttcagggtgcacattccaacaggcccttgtgtactcaccaggcctacaaacagccctactgtgtacaagacctcaaagggataaagatattcatgtacctagaataagccttagtgacccatatgctagcactgctaagcatcactcaaagactctatctgtgataattcagcattgccttccaagtatggtctgacttcctcttctatgaccctggaatctgtttttgcaattgccagtgatgatgaataagtgcataggctacagtgcatgtttaaggcatgctttaaaaagcacatcattatttcaaaaattttaaagattcctaaaagagcatcctgtgtgagtaaatccccataacaccttgattgttaaatgataataaagctaattatcattcacataatctttgcatttatgaattctaatttctacagtgaataacacttcatcaaaatagcttctgacaattggctcagttggaagaattcatctaaacacttaagacaaaaaaaacagcttttcattgtgttgacggggttttgagccttagtcaaaataattgagatagtacagataaaaaaaaaaacaaaaggaaagacaaattggaaattgtgtttgattaaaatgtaaatttcttattgtagtgatgttcttatttatggtaacacattgtagcacttcagtttggcagcatttgttgacctatctctgttcagcagctaaaacttaacataatagatgcaaaattgcttctttaatttacattttcaaaagaaataatctaggtcacttttatgttacttgcatgtaaaatcaactcctttaacagaaagcaggcatctttgaaaatattgccaattttctaactcagagtatgaagattataaaagtaagaactctgcatgatttttaagctaatagctagttcttacttcttgagacacttattttccaacttatggatctaccagattttcagttgcttttctaacttgttttctactgcctttgggtgatttcactgtttattggtagctaattcatagtaaacgaaggcattgaggtagaaggcaaactcagtcaaattcctgagttttccagtaataatttcattggaattaatagctgataggtggtttgttcatttacatgtacccaatttcctccatatctgcattgatccttggcaaaaataactgagaaatgattatagtcaagaagagcttgctcttacgaagttaatacacattcaccatataagccagcaatcttcctcctagacatttaaccaagagaaatccaggcatatttctacacaaaaacctgtatataaatagttacatcagctttagttattaccactaaaaaccaaaaaaaaaaaactgcccatcaactggtgaatggataagtcagtagcatctgtatgattcaatttaaatgacattttggaagagacaaaactggatgaaaacagatcagtggttaccaaggactgtgagcctggaaggaggataactgcaaaaggccatgcagaaccctttggtggtgatggaaaagctctgtactttgacttcagtggtggttacagaacacagcaaacatttgtcaaagttcattagaactctatacacgacagggtgaactctactctacatagattatatctgagtaaacttgctttcttttaaaaagtacagaacattgtttttgatcttagggagcttacggatggtaaagaaggcaagatcagagaaaaatacgattcacaataactgaatatgtatatatatgtgtgtgtgtatgtgtgtatatatatatatatatttaaagtagaagatcttacgagacatttgctgttataacatccccttgtgtgatttctcttgggtttaattatgaggtaaatggaatgtaaaattaccatgtatgaagtcatattttctgaggctttgctaattgtggcacttcaacactcaattacttttgaagcgtgtgagaatgaaaaagattgagttttctaattgtggttggtgaaatctaatcaaattctcaggagtgaaaatagatttttgcatcagtgagacttgccttgtggaaagaaagggtaatcttttctagggttaatcttgtggctgtacatgatgttactttatcacagttatgcagttgtcttatcacttatcacggaccttcagtgaaatcactggcaaaaagacccaaaattagtattttggatggatgacttccaacttttaactgggttatagcagatgctccatactgagctatgcattcaattatataggtttttctttcattttcacaaagtctcctggaaccctggtgcatgctgtcttgattcaccatcacatagcagtgtagatcagtaatctccatttctccaaatgcatttcaatacttctctctccattcccatctctctgggccctaactgataattgaactcagaattgcagctctcaaggtgcttgcaaagggatataatctgagttactcccaagcaataccttccccaaaatcaggcaaagaagatcatctatgaaaattgcctcagtgcagcatgttccaaaccctttaaatagactcacactgggaggtacattttgcatcatgaccctgtacatacaatggaagtaaatattaacatatttctcaaaacactctgatttttcaaactattcttgtttattatatttttttaagttggttgcaacgctctgaaataattttacccactaacagatgcaaactgtagtttgaagatcactgccataaaagatataaagtttagcattcatctaaatattatctaatctaaataatagttcactagggggcatttcaccttggccactttaaaagtacccctctaatcccccacccccatgggtctgaattgcttttactgagttgtactttggcttgatgctataaggcaatatgagaataattcctatgttaattgctgataatgctattgagaactttgttcactacactacacagtctcctctctctaaggaccaagtgtagaaatctttctgttgtccctgtaaggaataatggtgattaacctaggataccagattatttctccttatgaaaaaacctagtgtttccttactcacattgccagttagaagccctagttttgcatccactgcctacctctaacaagtacttggggttttgtagctacaatttgaggatttaatctcactcctaatttagttttactgtcctttattttttcctttgtgtcacatgtcttgctggtctaacattcattttaacttgttttctttttaatatctttttgtgtcactttaaatctttgtgaaacaaaagagaaaaagataaagaggaaagagcaaaggaagagagagagaatagtttccatgtatagcaagaagactcaaggtttttaggtctttattccttacattttcaaactaaaattatatgaaggtacaaattcagaacactttgtcctacctgtatcagaaacaataattataagagaaaccattttgttgatatcttaaagttaatattaaataattttacagctttactgaagctatttcatatgcaatataaacaatgcctggaccagtaaggaacaacttcaggcaaaatctgtaattgtatatgatttgccataatgccaaagagtgcagtattttcttcatggccaagaaaagtgttgaaacactatttggtgcctaaactgaaaagagagtttcttctgaaagaagcaaataacaggcatttaccagtggccaaggtgactgtggcttcaaatacatttctaagtaacgaaatgtcaggatattagaagacagataaaatcaaccatgaaaatgtgtgtttggctctatttttaaaaaaaccttcttgacgtagttcaaaatgaaggaaattatttggtgacaccaacaatgaagtaaaattaattttttgatgatgttttggaaaatcacattaaagttagactttttaaagtaacacccaagctgaaaagctgacttattaagtctatattgattgagtaggtcaaatattaatatccatcccactatttttgagcagattttatgctcttactatactgtgtttgttaatttcaggatactagtacataagtaatcaatggcaacaccattttctttaatagcctgtctctaagagctaaatgaactattctgatgctactttgactttactgtttccccttcctaccctcgatccagtttttcatcacaactacatggttatatcaaacagtgacaaaaagcagacagcaggaacaaaaataatcgtatggagcagtttaaaaacagatatttgtacatatttggcaaataggtaccttttcattaggtaaacagtagtaggaaaagagattgataaaaggactgtaattatgacatacaatatcagattaattatttgaatactttatctccatgtataaggaatagtctatgtatgactaggttttagttatgccaagaaattaagtaataacgtgacagttaataaataactttgttgaagaaagatctagtgaaaagggattgcttccaccatcctatagcactctctttttggaatcatgcctctgtgctcccctggtttacctcccagatcttccagtcttctttgattgtcacccttcagtctctattggctttggacctccctcacttcctcaatccaacctctaactgggagtctgtcagcactaagttttggcccacttctactcataatacacactctccctggatcatcctagctatcactggagctttacacaccatctacttgtatcccaaatgtacattctagttgcaaccattcctatgcactctatcataatcattcattctgttaatatttattcaattattgggtgtccacaatatactaggtattatcttgggtactggagatataatggagaattgacaaagtccttgccttcatggggcttatttttaagtgggcaatcagatcataaacaaaataaagtaaaatattcatatatgttggaagcattcattgctgggggaaaaaattaagcaggatatggggagagagtgttgaagttgaaggtagaagccattctagttgagtgatcagggaggaatttctgaggaggtaatatttgatcagagacctgcatggagtaaaccataagggccaagcaaagatcatggaaagaggctatctagcacaaggaacagtgagctcaaatgttctggaacacgaatagcatggtgagtttccatgatgagtaagaagacaaatgtacctgaagcagagtgaatgagggaaagaaagcaggcagatggaatctgagagcagaggccgaaacaagacttgtcagccattataagaactttagattttattctaaccaggatacaaaaccaatagagggtttgagcaagtgaatggtgtgttttgaactagttgccaacttgctatctctacttgaatgtctcacaggtatttccaacttaacatgctccacacagaacttttaatcttccctcaccaaaaaacaaaatataatcatcctactccttcttcagttttcccccattttagcaaatgataccaagaactatccaatttttcaagccagaagcttgcaaaatcattctgaattcatctatctcctttagctctcatagtcatcccatgctaggaaaaaaaaaagaaaaagcctatactttttatcttcaaaacagatgactcttctacttgcttctctgtgcatctcacagagaatgtcaccaacctagtccaagctgtgatcatccctaactcatgtttctaaatcacatcacaggggacagatcttttataattttgactttctattaatagctttcccatgcttaaaggaaaagccatcctctttgccatgatctacaaggccctgcatgattagttccagggccagtcttttgcagtttcacactactctttccaaccttcctgtgctccagccacactgacctttatcatttcctcgtacacatctttctgaccttagggcatttggcttactactctaaatcactctctcacggctggctgtttcttattccttccatcttaaccaacatgtctcctcctcagggaggagttccctgtccacccaatccagagttgtacttccctatcattctctatcacaacatcctgtctttttactttatgtcacttctcatacttcataagagcagagaccatgtctgtctcattcaccattgtgtacacagtctcagaatcatgcctggtgcatagtaggtacttaataaatattgaatgaaggacaagttagtattgatgtctccctgtgtcatgaaaaaatgttagcaaacatccaagatcacgtatcttttttaaaaaataaacatttttctaaaacaacagctggaaaaaacaaaattaaagaattaaatcttattacctattttacttttatgtaaactcggttacatatttccaaggaggaaaaaaaagattctaagaaataattaaaagtagaactaaaatagcagcaattttttgaaaaccacacatttcatgcatcaaatattttttgaatgaaagggataacatttgagtctcttctgtgtcctagataccatcctagacatgttctctatctcataacactcatcctcacaaccatcctgtatcttagaaaccattctgcctaattaatagatgagaaaactgaagctcagaattgtccagtgacctgcctaagattatacgaccaattaggacagaagcagaattcaaattcagctgccaattatgttgcagataccatctgaaaaaattctatttttttctaatcataatattttaaaaatcaataaatgtcaatgccatttaatcaaaacttaaaacattgaatgagaaaatgttttactctgacctacagcatgaaaagaaaaagtaaaataaactctttgggcaagcacagtgcagaacccgtaacaggtcaatggctgtttatcatttcaaagatttctcaaattttggttatgggtttctctatcctaaggtaaacattcttttcattaaacctgtaattttattttttccttgtatgaattcccttgcttattagtttctttaatagtaacgttcagtgttttaatgacagttagtacctattagcattttttgtaagatttttttcaatggcaaatataccacctatatctttataagttagtcttccagtagccattgaatgtatgatagaaataatctattattttcctgaagctgagtttctatttcctattcttgttcagtgagctcaaatatgcatataaagtatacatatctgactgcccaagaagggtgcatcttcctggcatttcattattctgaggaaaagatgtcatcaataacccattatgaattaagaattacatctttttctaatctcctcacagttcctgaaacatggtggcacttaaatattatttgttgaatgaatgaataaatgtataaatgactgacagaatgcacatgagcagatggaagacatacgtggatttttactttaaatatcaaactctccttttcagccagaggctatcgacttttttagaaagttgttccttttttaaattcttaatattttatcatttaatgcttaaaccaatttttatcttatagcttcatatccactataaaaacacttcttatttattatagaaaaaaagaaaatatgtgtaagagacagaacatagaaatcatcaataatgcccttcttctcccacacatagccaaataatctacaaattaaaaaatagcactcagtactaaaaaatagtattcagcatttaaaaagaatgacaaattatttcttatctaaaaatacaatattaaacatacaacaaacaattaaaatgctcctcttattttccaatttggtatttgttaatcccttattggcaataatatctgctgtgttctatttacaacttactatgcataatatactgatatactgagataggttttttgcagacatggcactgtgtgctcttcataaggacctttaaaggaagtaccattctccaccatttttaaaaatgaggaaacaaaggcttaggaaggttaaacaaaggcttagaaaagttaaacaatatagaagtaattcaattctgacatgaggtgcagctgggattctagcttaggctagtcagatgctaaaatctacactatttccccacagtacttggctatctatattaagtagaactacatgatattgccaatattcaacgattttagacattaaaaatggaaattgcatcttattctatttgacacaaatataattcctttccattattactctagaatcaagtcccatgacttgcacaggcatcaaaatgtcaggttaaaagcaggtctgagaggatggggggttcaaatcctggcttccccggtgactagctgtgagaccctgagcaaatcatcttcactacagggttatttttctgttgaaaaaaatagcattgcccttccctgcatacttcataggaattcactaagagaaaaatagaatatacaaaactgtaaaggatataaaacttaaagtgattattataaacaaaccttctaaataaggaaaccaacaagccacattcctaagttacaaatgtgaaagaggagaattagaaaccagtgtataaggccctaaagagccctctacagtgctgtttgctcagtttttgataagagtgtcaaggccaaagccaatccttcagaactctgtggctagtgattctgatagcaaggatcaatagcctaaatgtcaaccagatgattcaaagtgcttacacaaaaatttggctttatatgcaaaacctcatccccattcctggaaagagctcaaagctgtataagaaattgttattggtatactatgtaaaagccctaattgagatttcaagaagctcccagctttctgagcatcctacataaatccaaagagaaagaaatattatttccgctggcaaaatatcaaatcccaagaacatgtgcctaacctggaacaggcttctttaacaaggacttacaagaactctgagctgcccttgaggattcatcttttcttttcttttcttttttctaaacaaggtcttactctgtcgcccaggctggagtgcagtggcgtgatctcggctcactgcaacctccatctcccaggttcaaaagattctcctgcctcagccttcctagtagctgggattacagggacctgccaccatgcctggctaacttttatatttttaatagagatggggtttcaccatgttgaccaggctggtcttgaactcctgacctcaggtgatccacccacctcagcctcccaaagtgctgagattacaggcttgagctaccacacccggccctcttttctatgctttctggaaatggcagttatacagcatgagagactctttcccttctctgaaaatatttttccagtgtgatttatactcaagaagatttttcttccttccaggccttttggaatgtaagataacatgagttatcatattttctaaacaataaagcccgatacaaatggaaggaatctttatgatcacttcctgagttagacatagaagccacagttctctctgtacccttcatccaagcaagaatttaaaggagaactcaacacataagttatataaagatttatattttttatttctgctgcaatagaagaagatgtcttcaactattaggtttatataactaaagaatttgtatagcatattgatccaattttaaatctggtttgaagttggcatatgagcttctctcgttaaataaggtaagcatcaaaactcctgcatatttttttaaattcctaacttgagtccattttctctacatgattattcagaatattttccactctattaacatctgtttcatgcttgccttcactacccttaccaatgacctcgcctcctacagtttcttctatggtaatatctcccctcccctacctgtcttctcctcaactctcctcagaagagagtgggaatttcttcttttccaaagtggactcttccactgggggttccatttatttctatataccctctcttccttttctcctttatcttcacacattcccttcccatcagatggaagtcttccttatccctaagaaaacaaaataaactagaagcaaacaaaaaagcaaaataaaaaatgtacctccattttattccccctttgagttaacattccatgttacatattccttgatatcaagcccttaaaagagttatggacactcatttcctgaacttcttagccacgtgctgttaaccctgtaatatgattcctatttacccctttcatgaatcttctaaaagtcttgtctcagagatctttaatgcgctcctaattactatctaattaattttctcaatcgacaacctacaggacctcttggcagcctaacattgttgatcacatcctcctagatattatccttatggttaactctttgaactatcttaacgctaattcttccttgacattctgactctttttaaagtttttcctttccatttcctcaccccctagttactgatttttcttacagttgcatttttagattatgtgtattttctcattatacataatcacacggatttgtactttaattatcctatttgtactgatcatttcaaaatctttagtttgtcttggcttctctcctaagctccagatccaaatttccatctgttttggacatggtgacacatataccacatatactactcctcagactcaacacatgtgattaagacgttgggttcactagcagacagaagacacctcaaaatctgaccctacttttttataagctgtattactttaaagaggaattagcttctctgagccatattttctcatctataagtttgtatttacagatgagaatgtgtatttatagatgagaatttatacttacagatgagaatatatggcttggagaagttaattcctctttaaagtaatacagctcatatattatatctatatattatagacaataaaaaggttatgaggattaaatgagataatacatataaaatgcttagtataatgctaaagtcatactcagtgtttaacagataaactgccactattattattattattatcatcaccatcattttctagtttgaatttattacagcccagctgcctctcctcctctattcttctctctctgaatagtgcaacactctcccaatcatactttctataattctcagagcctctagaattctctagaatctttatctcttcccttttcctctaacaaacccttatctaatcagtcagtacattgtgtcaattatttctctacactgcctctcatacccacagcttcctatttattccaacagaaatcgtgcagtccctatttcagtccttcacccctgctgccttgcattattgcaattgactcctaactggtcttcctaaacccaccgccaacctaacccactattactgtctaaacagcaagtgctcttgttcctccataatcagacccaagttctcctttatcctccccacctcctgagccctcctgtacccacctgagtgtctcttttccttcctgggcttcctgccttatgtttttgtttacaccatactcctaacctgcaaactcctttcaaatctgactgtggaaatgcacatgcatttactagcccacctcctccacgaagccttctccaaagtgcttgtgagacacagcagagactttcctctcagtggcctgcaggcctcccaagcatggaaataagggaaaatattgagctctttcaagagaaattgcaggtacctagctagccttgagaagttaagcaacttgataagcatgaaggtaaaatagtaacctaaaacaatagccaaggaagctagaatcacaagatgtttggttccccaatagagactaaagataacatcttcacatatgtctctgagtttttttttcaggaacccagatccccaacaaacaactcgtccccacagtagacctcagataaaagggaactggggactgaactctgaccgtcattctttgttctcagtttcttcctgaggagcctgaagaaagtcacattcatgaaccagagctaacattcttttctgctgaccccaaattttcaagcaaagcttctcttcattaaccaatggcaaatcagaaaatctttgaatatacctatgacctgtaagccctcacttcaagatatcccacgcttttaggtcaaaaccaatgtgtaacctccttatattgatttatgattttgcctataattcctcctttcctgaaatttacccttgcctttaaaaacccttacctgcaagccatggagaggagtggggtcaggatttaaacaccagctgcctgaacctctttgcttggagccctgcaaataaacaccttcctttctaccgctgcaaacctcggtatggacatttggtcttactgtgccaggcaagcagaccctggttcagttctataacactcatagctaatattacctgaaaataaatcaaaaccctaagatgtaatgacagtatgatctcaatttatatgtgtacttgtatatgatatgtaaacatactgaatagaaatagggcaaaatgtgaacagtggtcctttacaggtacgataatctggagatgtgctatgaatcggagaaattcttattttgttttgtattttctaaattattcaaaagagctaatatttctatgtactaaaatctttatatgtattaactcatttaattttaatcaaacccgctgacgtatttgcattattgtcctattattgaggtatatgggggtgaagcaacatgcccagagccatgcatctatcaagagtagtctggctccagacctgtgctcttaagcactccactgaattgtactaagggttttaataattggaaaaaaaaatatttttaattaccttttcttctgtctctgacctccacctactcctaaccctgacaccaccaagttccaaattttccttccatttccttcctagagaccaatctcagctaggtgttaagaagaaaagctatctgattaagaaaatttgcatgaattgttaattagtaattgccatcctaaatcctaattgcatcttaaaaagggtgcttgttaacataagtgaatccctaattagtggaatttctgttgctatgactaagcaattatgtctactactgacagtgtgtggaggcgaggaaagtatcttggaaaagaggattttcttcttactccttaaagtttaaggctgcctcatgtacaaggtctccctcagtctctcaaattcatccatcttcccacacaagtttggtttaaagcaccaataagccctacccttaggcctatgtaaaagcctatcattctgatgctgcagaagccaccaagaaccaggctaagaaccaaaggtcaccgtttgtgacacaggagtcttcataggaaatgaagacccaaagaaacacttaaacccatatgtttttttatagtaggtttgatgaagagtgtacagttgcagagaaatataatagggcaaagaacatgaggtaagtgtaataaacaggaggtaatttagcaaggtctgtttgttcagattcctcactgtatcccttcatcttccaagataaagatgctgttttcctccaggtatagggtgggcatctctcacatgagggtcttttgacctgctttagaggaaaatggaagagggaagtcagagagctcttccttcttctgtaaatcccttcggcttaaaataattcatatgcccaggtgctatatttttataactggcaaaagagtctggctgctcgctgcttgtagaaagaagccaaaataataacaagatgtgatagaaaggaagcaaaactttattttgctagcaaggggaagagtaggcaaaaaaaaattcgcctttaacttggggaaggaacgcaggagtttttaaagagagggtttggggtgcagaagaggcaggggttgggggagcgaggaggtcccaggtggcatgatttgctctgatggctcatcttgaatgattgtccccatctggtgaaggggcccatctgatgaaggggccaacaccaccatgggcccaaccaggttacaaattaatctcaattaatcttaccttggatctctagctgggagtgtgttctggccttgaagtaatcttttgttggagagagaattccagaatatctggtctgtatcaggatccaatacctgaagattctaaggaaaaatatgaccagataagtaagaatggtatatgcttaataaacatctacataaataaatgcatataaggtatgggagcataaagtgccaaagggaagggagtggagaaaagaaaacattttgaggctgtaaaacacatttgtactttatctcagagctacgtcttgaaactggggggaaaggaggaaagggggaaaaaatttaaaatatgatttgaggctaagctgctaaactgctcagctacattttggggtagcatctcctgaaccccactgtgatgtcaacacacataatcaagagggaaatgcaatgaaaaaaatcatattccttcttccttctgccagtttggaagagagctttgttgtatatattcaggaaatttgacacaaaggcaagaactttgctctaataggcttctgcaggcagcaccaaatctcagtgggaagagaaggatggctggatggtggcaaagctgaaagggaatctcagtcattctaagattttacatatccagtggagtcccaaaggtgggaggggagaaaatctagaagcaagtataacccacagacttgcataccacccctccccacccccaagaaaaaggaacaccacaacagggggagcagatgaagtgaagaggttggacaagctgaagtcacccagaaattctgaatatctaatgcacattttctcctggcttaatgtgtgacattcatattatccaatagctttctgttatttaaaacttttaaggaagttcatagtgagaacagctatggcagagatacttgctgctcatcaggcattctttgcttccctacatttcccacccccttgcagttaggtggagccacacgactagctctggatgagatgttacaagcagaagtgcttttgtcactgcaggaggaggcacttaaaaaccagcatgtgattcttggctctcctctcctaacacatagactgaggaatctacacgttccagatggtcagctacaacatggcagagcctccattaccctgggcccctgtaagaccatgcagagaagagtcgcttcccccagtctcccatccccacatagctctgactgcccacactgatatgcagaatggacaaaagagttttgcataaacttacgttgtgttaagccattgcaatttgggggctgtttattactactgccatggcctatctaatcttgactgatacagtggttgcttgtggaaactggcatagatggtctacacatacaaagtatgcacaaataaacacacacacacacacacaacatacacacgtatatctcacagaaaaaaaagttgactgttgactggaaatttcaccatggagaaccccttaatgaaaagttgcaggtttaaagagaagacagccataaaacagcagttcagaaaacacgtgctggacaatatgggttcagatgtcaattctttcacatactagctaaatgacgttgggcgtgttgcttaacatctctgggtctcagtttcctcaactgtaaaatgagtacaagaatagcacctacctcagagatttgtttgggggggggcacagagtaagcactcaataaatgctatatataactaataatcttaaagataataagaaaggctgaataataaatgcattcctttaacatctctctcttacaaaaatggaggtaaggctgaagattttttcaataactgataattattatgatttatcatttatgcatctttttctttgttatggcttacatttccaaactcagaatcaactctctgcttcaaaaaaatctaacatgactatagtcaataactttattatacattttgaaataacttagagtgtaattggattgtttgtaactctatggctaaatgcttgaggggctggataccccattctccataatgtgcttatttcacattacatgcctatattaaaacatctcagtcatcatataaatatatacacctactatgtacccacaaaattaaaaaaaattttaagtacttttaaaaatctaacaggaccacatttttggattacaaatattttagcagctcttatcttttcttttataaaagaagtacatcttttcagaaaaaataagaacaagtgatagtgatttgctatgccacttaatgattatttccagaaaagattacagcgtgtaaaagattgcaataagaagaaagaaagagtgcagtttcaaataaaggtttgactctgaaatgggggtaccaaacattcataaaagtcagttctctgacttactgtcacacctcaaacctcatatttatcaaaaccttcagcactgataaagcaatcaaaatgaaaagaatgcaacagtggtcccaaagttgtgtcttatctaggtgttaccctgaacattatttcaactcttcttacctttgtgactctgtttccacattggaatgagagtgaaatgattttgcttctaccattgtagaaagctgagaaattgaatcaagactatgtttcctgacgaaactctaactgtaaaattacgttgattgatctttaggcaccaattaaggtgggtataacctcaaaggcacttggcattccctgtatccaaaatgtctctcctactggtaacctcatcttataccatcgtaactcactcctctccaaagactattattttcctcattaatccccacttatgcccagaaataactcatcatccttcccaccatgccctctctagagctgtacggacttccagtatcatcctgtcattacagaacatcacagaaattgttgtccacatagttgaatacatagacaaaggattagaccgtatatacatgatgctaattcattttgcctatacagctatttcaacacaacagccagggtcttttgttttaatgaattttgtttgagttctgttctctcattaaatagtgaggtcctagaggacagacagcaattttgtgccatttacccttgcaagccctcacattatctaaaaaaaagctttatttgctgaaattaaatcatcaaggcaggcataacaactaagttactcattcagtaacaagtgaagttaggtcctcattgtgtcatgtgatttgaatatttattactgatataaccagtatacttatcattaattagcccagttcatcattgcactgtgattctgaggctaagcacagaggtgttcaattaagcccaatagatcatcaaagtatcatcaaaactgcaataatcattctggagagccagttttctgtactactgtactgctgatctatggattgtgttaaaactgtaaatttccaaattcccattaaaatcctagttttcataattgaagtgtcagcatcaatttcttagcatcaacatttccacaaacccaaaaacttgatatctatctctttagaaacctaaaatattaaaatcccccacaatttttatacgatttttgccccctctatcatatataataattctgccccttgcacacacacactgagatactttctgaaatactgagaagtcacctatgatttgccctctgtataatctgatatgaaagtaatgtacaagcagcaatctggttctgtctccagagattctaaaataatatccaaacaccattcactcacagaaacgtaatgtgctcagagttttctttttcttttgtttctttcatgtcctctcagtattaaatgaggagagacaaccccacaaagcctgatttaacctctcatgatacagctgagtaaagctgctcattagactcaaaaaacagaatattatcaccactaatcagccacaagaccttgggtaactcctatcacatcactgagcctcagtttctcacctgtaaaatcaactgaataccttccttctttactacacaaagggtttttttgaagtagacaatatttttgaaacacacctcaaaaaataaatggcattaagtgtgcagagaggcaaaaaatataccaaatttttttattcattagaagtttagaatttctttttttttctttttttattattattatactttaagttttaggatacatgtgcacaatgtgcaggttagttacatatgtatacatgtgccacactggtgtgctgcacccattaactcgtcatttagcattaggtatatctcctaatgctatccctcccccctccccccacccgacaacaggccccagagtgtgacgttccccttcctgtgtccatgtgttctcattgttcaattcccatctatgagtgagaacatgcggtgtttggttttttgtccttgcaatagtttactgagaatgatgatttccaatttcatccacgtccctacaaaggacatgaactcatcattttttatggctgcatagtattccatggtgtatatgtgccacattttcttaatccagtctatcattgttggacatttgggttggttccaagtcttcgctattgtcaatagtgccacaataaacatacgtgtgcatgtgtctttatagcagcatgatttatagtcctttgggtatatacccagttatgggatggctgggtcaaatggtatttctagttctagatccctgaggtatcaccacaccgacttccacaatggttgaacgagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcatagatgtcttctttcgagaagtgtctggtcatatcctttgcccactttttgatggggttgtttgtttttttcttgtaaatttgtttgagttcattgtagattctggatattagccctttgtcagatgagtagcttgtgaaaattttttcccattttgtaggttgcctgttcactctgatggtagtttcttttgctgtgcagaagctctttagtttaatgagatcccatttgtcaattttgtcttttgttgccattgcttttggagttttagacatgaagtccttgcctatgcctatgtcctgaatggtaatgcctaggttttcttctagggtttttatggttttaggtctaatgtttaagtctttaatccatcttgaattaatttttgtataaggtgtaaggaagggatccagtttcagctttctacttatggctagccagttttcccagcaccatttattaaatagggaattctttccccattggttgtttttctcaggtttgtcaaagatcaaatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccacatgaacttgaaagtagttttttccaattctgtgaagaaagtcattggtagcttgatggggatggcattgaatctataaattaccttgggcagtatggccatttacacgatattgattcttcctacccatgagcatggaatgttcttccatttctttgtatcctcttttatttcattgagcagtggtttgtagttctccttgaagaggtccttcccgtcccttgtaagttggattcctaggtattttattctctttgaagcaattgtgaatgggagttcactcatgatttggctctctgtttgtctgttattggtgtataagaatgcttgtgatttttgtacattgattttgtatgctgagactttgctgaggttgcttatcggcttaaggagattttgggctgagacaatggggttttctagatatacaatcatgtcgtctgcaaacagggacaatttgacttcctcttttcctaattgaatatcctttatttccttctcctgcctaattgcccgggccaaaacttccaacactatgttgaataggagtggtgagagagggcatccctgtcttgtgccagttttcaaagggaatgcttccagtttttgcccattcagtatgatattggctgtgggtttgtcatacataggtcttattattttgagatacatcccatcaatacctaattcattgagagtttttagcatgaagggttgttgaattttgtcaaaggccttttctgcatctattgagataatcatgtggtttttgtctttggttctctttatatgctggattacatttattgatttgcgcatattgaaccagccttgcatcccagggatgaagcccacttgatcatggtggataagctttttgatgtgctgccggattcggtgtgccagtattttattaagggtttttgcatcaatgttcatcaaggatattggtctaaaattctcttttttggttgtttctctgcccggctttggtatcaggatgatgctggcctcataaaatgagttagggaggattccctctttttctattgattggaatagtttcagaaggaatggtaccagttcctccttatacctctggtagaatttggctgtgaatccatctggtcctggactcttttttgttggtaagctattgattattgccacaatttcagagcctgttattggtctaatcagagattcaacttcttcctggtttagtcttgggagactatatgtgtcgaggaattcatccatttcctctagattttctagtttatttgcgtagaggtgtttgtagtattctctgatggtagtttgtatttctgtgggattggtggtgatatcccctttatcattttttattgagtgtgtttgattcttctctctttttttctttattagtctcgctagtagtctatcaattttgttgatcctttcaagaaaccagctcctggattcattaattttttgaagggttttttgtgtctctatttccttcagttctgctctgattttagttatttcttgccttctgctagattttgaatgtgtttgctcttgctttcctaattcttttaattgtgatgttagggtgtcaattttggaactttcctgctttctcttgtgggcatttagtgttataaatttccctctacacactgctttgaatgtgtcccagagattctggtatgttgtgtctttgttcttgttggtttcaaagaacatgtttatttctgccttcatttcgttatgtacccagtagttattcaggagcaggttgttcagtttccatgtagttgagtggttttgagtgagtttcttaatcctgagatctagtttgattgcactgtggtctgagagacagtttgttataatttctgttcttttacatttgctgaggagagctttacttccaactatgtggtcaattttggaataggtgtgatgctgaaaaaatgtatattctgttgatttgtggtggagagttctgtagatgtctattaggtctacttggtgcagagctgagttcaattcctgggtatccttattaactttctgtctcgttgatctgtctgaagtttagaatttctaaatggtgtaaacaacaatgtctaagattgctgtattaatgaatgaattactctatgagaagcaggatagcacaatatgaacctagagtagataaattgtcttcgataattgcttaaaggccagggtgagtcagggatgggaggattgttgacaattaaatttcaaagcagagaggagatcttgagctatgattttaaacagaggagtgtcgtttggtaatgaatgattgtctcatacttagagaagatactggctttttttaagccaagaaccacatggttcagtctcagcagtataatgagaaaatatagtgcaacagtaaaatgtcattttaaaattaactcaagttctttatatacatttcttgaacactgtgaagggtatgtgtagaccaaagcaaaactttgttaaaactctttcttcctttctgtttaccccccgcttctgacactaccctcacataccataacagtccttgatttaaacactctggagaacattttttgttcatctgggaatcatctaccctggctagatatcaccataagaatatcactcctccctcctgtcatgaagctggaggtccaagcacctgcatgcacagcccccatgctgccaccaccaataccaccctcctgcaagtatcattggtcttcaactcctaataatttgttatgataattgtgataaacatctcccttgctctctccatttctgcaagagtgggaaaaggttgtaggcacttttatcccatcatatttatttaaggttagatttagtatagtgggtttgaagttctaaatataggggggaatggaaaggcagagaaagctagcttgacattcaatgggaaaatgtgagcaagcagccaaggcagggttgatacaaacccaggagccatgatgaagacagagaccaggggctctctagtttatctggccacaaatgtttgaatgggaaggttactgaaaagtagccaaacccagtatcagacttcaaaattaggaatgaaaaagaaatgtgtatgtgagttatgtttcctacgtctcttgagcatgggtcttaagagcttcttcaggagttccagcaggggaaccacagacattcaaatatttttaaacaaagtattgtgcttctctctctctctctctgtttgtgtgtgtgtgtctgtttgtgtgtctgtttgtgtgtctgtgtatgtaagacttacaaaacatttaccatttgccaggcattattcttagtactgcaacactatgagagagtactagtaagatccccttttttcagatgacaaaactgagccactgaaaaattaagtaactgacccaagtggtacagctggagggctcaagcacaggcaatctggctccagtacctaagcatttagacactacattatcctggctcctaatcaatggcactgtcttgggaaggatgcaggtagcacagaaacatacttaaggagtagaaagatgaggatatattcagtcttgttacaaaagccaaaggagtagtaatttcaaggaggaaattacaaaatatgtcaatgtgcagaaagtcaagtcaaaaaaggcctggaaaagtgtctgttggatttgacagtcaaagagtaactgttggcctgtgccggtccagtttacatggaatagaaggaaataagctagagtgtccacagtgctggagtgtggagaggttttactcagatgggaagaaacagaggaaggagaaatgcattccctcaagatggagagttgtaatgagacagaatttcttcccttctttttcttctcttctccattcttaacacacttctaaagaaggaaagacagaataaaataatggtgcagatcataatgaggcttttagtggtgaggacatgggtacatggaaggcttaagaaaaatgctctgtttgtaagacttttcattaaggatagactgaagatcggcctgtatctgtaacagagaagagactgtgaaagttgatcatacaaatggggtcattcttgtcctatacaactaaaacagagttgagatgccaggggccaggccgcagggaagcactcagggcacagaacattactccaagaatgtatttctccacaagcctggctgctgaaactgcctgctgcaacctcaaatcagttttatctaatggctactgaaacaactgctacaactctaagactagttttacccacagctgtcactcaccagtcagagcttactagcccccaaaactttattcgtgttcatgaactttcttacaaaacaatacataacattctcttttttataaaacctccaaccttctatttcttcttcagacataccaaagacaacctggtctgtgtgtatgtatgccccaaattgcaattctgtcttcccaaataaaatgttttacatttagagatttgtctctatattttctttgacttcaacaagatggaagaggggagggaggaatgagcctactacatagagatggtataccacaaaaaccaggagggagaacagggcctgaacttcctaggtaatacaaccagattttgacccatgcactgatcaaatctttcattaactgctgagatgaggtaaacaaccattagcaggctgcagtagaagctcagtttaacctccaggaatcagtttccacaaactaaaaaacataagagatttaatcatctctgaaaccctctgcattttttaaattctatgaccttatgagtattatccgagaatggccatggtcaaagatatctgaattactccataactgtaactccccttcacctacattggtttccatagttacagggatataaaataaagtcactgttgaagccaaggcaggacctgacactaaacttgtcaaaggagagaaaacatcaagttcaacatctgtggcattctttctagctcatcctgacacattttggcagaaaacttgaactgccacagttcaattattcagaatgtcagcctataaaaatccaaacctaaaagttttattaaagccatgatctgctacaaataataatagaaacttcatttaaaaaaactttatttgctgcctagttcatttaatgatgtgacataagaaagcattgtatattgcaggacttctgacactgacacttaaaatgtctgttaaaaaaaacacaacaacttgcctcagacacaggccatgtgtttcaccaaaagttgccaggaattagagaaaataatcaaagtagggaagagaagtttttgttcactgtttttacaggagcactaagaatacttgaatgccaatgatggaaaaaaaatggaaagaacctcttctactcactgttgaaatgacctttctaaatttcagggcattaaaataaataagatatatgctacatagcacaggaaaatgtttaaagcaaaagttcactttttgtgccttcatattactttgaaaaatgccagggaagagccgtaagcaaagtgataaatgcctactaggtttgattaactagatttttttttttttttttgagatggacttttgctctgtcgcccaggctggagcgcagtggtgccatataagctcactgcagcctccacctcctgggttcaagcaattcttgtgcctcaacctcccatgtagctgagattacaggcatgtgccaccacgcccagctaatttttgtatttttagtagagacagggtttcaccatgttggccaggctggtcttgagctcctgacctcaggtgatccacccacttcggcctcccaaagtgctgggattgcagccatgagccactgtgcccagcctagatttttacacataaaaaaatatgtgtcagatttgaatatatagtaattagttagttcctgagctgatatgctaactcagtgcattagagcctggtatttctaaatttaacactaaaagctcaaactgccatcttgtaaatatgtgccactcactaccagagaaagtgtcactcactatcacagaaagagagaaggcgagctagacagggcaatacaatccagtgcgattacttcccacagcaattcagcaggcattctttgcgactactcagacacaatcatgatctctttatttaaagagcagaacgtggtagtattttaaatagcatggccccataaccaatctgtgaaggtctcttattgattataattctaaatccaagctcttggagatcagttatccaggttagaaaagtttgttgacaccaaggaaaatatcttcattttgatatctctaaaattccacttttgttgaaatttctccataggcatatataattattggcctgttccaaaagcatcttgaagtgccaacttcagaatatctttctaggttcagtcttacaatattagtaatccatttcttatggcatctatgtagactgcctacctccatatagtcttgggaatgttgatgtgttcatgaatataaaatacgtacctctcccaaccactcaccatacttataacagtaagtttccttatgggtgtgacataaaacacctcaaatcagttcataattaataaccacactacaaattagatcaccacactttaggctaagttaaaatggcaggttgtgatatgactctcctgagtctctctctcataggaatgtgacagtgggtcatcttataggtggacaagtgagctcagttctattttcagcttcagtagcataaaacagaaatttattttaagaatgacattaactgtgtacatatgatattattattgtaccattattattggggaatatccacagcactcattaactggtgaatctcattccatatttttgttcattaaaggtcctcttgtactaattttttaattcaaattcaacctgttacagtgaggttctccaagaatgccagggattggtctaattatataaatgcatactgagattgcacagaatgtcctccagccccgtagaagaatataataagatatataagcacatttaatgaaagtctgaccagtaaaaaaaggttatcaagttaataatagccagattcaggaaaaaaaaaggcactttttatctaacactgttcaagacagacacaagcaaccccatcaccagtgagattttctccactggggtctggtaatatgttattatacttcctcagcatttagtagaaacatctcagtaagccattctgttgttattaccaagaacacacctgggttatctgagtaatatgagaagaaagaagttagtctattctaacaaagcacctcaaagcaacacaaaaatatagtagcttgaatgaaatagaggtctcttactctctccccacacagtctagatgtaaataatcttggcttggcacagccaactctactgtcccctacacatgcctctcaaagttgctccaattctcaccattccccagtgagtgacaggaaaacaaaaagttgagtaggacagttttatcttcaaaattttgctacagaagagttgacttttgtaacccagtgaatccccaaatttaacctgcaggttataggcagagggactttcctttagcagatctgtatttctttccatctctgcttccaaacctaacttggctgccttcacctctcttttgcaaaaagcaacgataaagagtttataaacatcaaacttttgagtttttccatgcagttatgctagaccaacagactcagtgagcatgtgctctgctttccaagttattgtagacaaaattgtatcaaatatttttcaacagtttaagtcaacatcaccagagtctacaatatttattgctttgcaacccactagcagactgctaagcatagttctggttattgttatgggtatgaccccacttccgggtaccattttctgtattaattagatgctataattttggaaaaccccaaaacacagtgacatatatatgcatacatatatatataacatatatatgcatacatatatatataacatatatatgcatacatatatatataacatatatatgcatacatatatatataacatatatatgcatacatatatatataacatatatatgcatacatatatatataacatatatataagataacctagaaattacacgcatttctgctcaaattcaattggattaaacttatttgcatggctacacctagaaacaagtatgttcttaggtggtgaccacctgctctgctaaaaccggccagagagggattatattattcaaaaggaaaaggagaatggttaatgaagagcaataagtagtctctgtcagacagggatttcagaatcctcgcctactgttattccattgttctggttctttgtgtaagcaggtctcttaagagtctgaaaagcagggcatacaatatgaaataacaaatccaaaccctaagactcgcctttgatgagtttacatagatcacggcccttgcacatctccaatttagcttcctcaccataacatttcaaatctaataaggaggaggaaagaaggaagcctgctagcatataaatatattgcctccattttagaatgtttgtacttaaagagttcctgcattatcttttcttcatattgaatttcttagaattctgtgtcactcagcacccattagccacagcacagtttccagatggatctaggccttgccaacctttttagctcagaatactatcctccccaagttccacaaacaccaaagctgatgattcacaggaatgtggcttaatcataatacagccacacaaatatgctatacagcattctacgttaaaatggaagacaagcccccccactgattatagtacactgcccattaagccagtactgagccatttaatctttttgaaggctacttcaacccattctatttccagaaccataatccacactcatcttctcaccagtaataaactcacttctcaagtatcatgataccaggaagtgtgtatcttgcataagggactcataaaaggtctatcacccattattaattaagtataatgctattatgcatcaggcatatgtgaaattaatagcagtgagactgtcatcaagggacaataacctctggttcaactaagcaaatcttgctcctagacctgcaacagaatggtgactattctcttgtaggaaatgatgacttaatcaagatgttctcaagactcaatctgagtggttctacctacaacagaattgtccccccaatgacagcttcattggccttccctcaaactctcataagtgcatttccaattctccagtaggtcccttgtgaactataaatctaggggaatagcgaggtgttcttggcagttatttttaaaaattcacaaacggcagccaccccaacactaattaaaggaatatgatttatcttgacttcttattttctttaattaacccctgtttaggaggagaaaacacacacaccctgtgcaccagaacaccgaatactgtcaacaaaattctttgtatcatatggatgatacaaatagttatggtatgatatctatatcatatgggttgataaatatataacactctccatctacacccacaagaaatattctcaaccagtcagtaacctttctcatgaatgccagaagtagccctagaatcattctttatgcaaaactccaggcaattgtcatcaattagagctgctcctcagaacaaaacctatctaacactcttacaatttaacacacacaaatacacacccactgtggtccaaggtcacacagcaaataagtggtacatctgagactaatgtccaggactcttatttcctgagactgacgctttcttccacaaggtatcgtgatggctatttagtaaattaacaatatttgcaacagctttgaaagccttcatttgccaaagagaaaattattgaaagaaaaaggaaaatcaattcgtagctccctggataacattttagaagatctgtacttcaaaaataactgctaaaaactcttctaaatgttaagaagttaaaaaaaatagttccctgaataacctttttaaagatctgtacttcaaaaataattgctaaaaacccttctaaatgttaagaagttaagaaaaattgctattaattaaatgttcaattaatgtttattatgaatatcgtattgtaattaggcaagtttgtgacacagtagagtgtatgcatgtgtgcttcatacacgttatagtacattcatgctcccttatataatcaaagtttgtggaattcaatgccaattttatagaccttttacagtgggcataatgagcaatagtctgataaatcaggagaaatagatggaatctacccttatcttagagtatgggctagtcagtaacctctctgcacctcagttttctcatcgttcagttgaaggtatctctatggtccctgtggtatggaaaaactttcctctaaaccatgtttttcctctattctcacaccacaacaatcaacacagaagacttttgtgaccaaatgtatgggtggttttccccatacaccaaacagcagatagcagctgggagtcctccaattcagttcagacactatctacctggagatagtgtcagatcccccaagttgaaggctccatctccaagactgcccctctccacacacacacactggtcccaagtcccggcctgtggaactctgaccaactagctttaagctgggattaccataacaccctcttcaggcttgattaatttgcgaagcagctcacagaactcagggaaatacctacatacatttgtaggtttattataaagaatattgtaaaggatacagatgaagagacacataggacgaggtatggggaaggggcacagagcatccatgccctccctgggtgcatcaccctccaggaagctccacgggttccactatctgaaagctcaatgaaacctgtcctcttgcatttttatggaagtctcatgacatcgccattccttctcccaggtttagtgtgggacccactcctgggagagtcttaagacccacagtcagaaagaggggggaacgtcagagtggaaagaaggcagaggaagttcagaggcctgcccctgaggcctgacatacccaacattataacgcaaaagactgtaacagggatatgggtgttatgggccaggaactggggatgaaaatcaatgtatatcataacaccgcagtcccctaaagtactcaagagctctatcattcaaagcataattttgttgttttaaacatattatggaatattaaacttgctttataatgtacataaaatgtcaacttatttgacaccacaatttaaagaaattatacacttccttatgtttttaagttgacatctaaatttatctcaaacctaatagttacaaaagatgcaatttctagtatattgcatatcaggtataagatctaaatatattaatatacttgaagttgcagatttagcccattcaacttatgaaacatgtctgctgtatgtttatgagacatatttctgaaacaatttgtgaaacatctgctgtataaaacctcactggaaaagccagttctcgtggtcaagcatattagtcaaatcagatttattgccatacaaagccaaacttacatttttcaattcaaaaaaaagtcagtatgtactccataacacacattctacttctgaattctaattctaatttacataaacagagaaaaggttagctagagcctttccatgattttgttacctaaataaaatcaggcatttctcatatacacatgtatcttttgtatataattttattatatatacacaatacatataatttcattgcaattgcttatgtaaatatgtttttaaccaaaggctcttattcaggagctttacatattcaaacactcctctttttagcccctaacttttttataccctgggaaatgcatcataagattcaggatggatgagaggtgcacattttttttttttgtaaagtaggaggtgaccattgtgaaaagagtggtaggaatggagaaatactgactgcaggagtggttttcagatagatcagcttaaggaagagacacaatggaagctgagcatcttcagaatgatttccttaaagctgtccaagccatatacccctggaaagtcttcaaatatcctcaagggtatgcatactctgtttaaagatatctgaactgggattcctttatgactgaaaaaaatgtacagcaaattcttatgtcccttattattggaaaaaaatgagacagaaaattcaagaaagcatttacttctccaggctcttttatcctcaagtcctcaggacaaaattgcttgccataaccacaaataaaaacagcaaagaggcttcataatagaagccactcctactggcagtggcttcccagtttgcttgtgataaggtttatgaggttgagtctgtgcttttcataaaagaatgccatggctaattagcaatatctggcaggatgtggaaatgacagcctaagtgctacatcagtcctcccaccctgtcagcataacctaacaaaacaactttatttgaattttattcagtttcctatttaacctttggttcctgcaattctgagcataggtacattccaaagaatacatgtttttaaagtgggtatgcacaggtttttactttatcatatacataatatacgtaatagcatatgtaaattttccccaaataagaagaaaatgcatttattaatcaattgagaagacaatatttatccacttatttattactagatagtcttggaagagcatgaatatgctttattcactaattagaaactgctttagctttagtattcctggaaaataaagtgcaaggggataatcaatgaagagatgcctgaactgattaacagggactatgtcatgaaggaccttgtgagccacgggactgattatttaagcaatagatgttatcaaagagttttaatctgctcacatcatcagatttatactgtggaaggctccctctggtggcagtgtagggaatggatcaactaaagtaggtaagacagtaaaagctttggagagacttgaggtattctagatgaaagataatattgaggaaaaatagtagtaattgtagcaggaataacgaaaagtggaaagacttaagactgtaacagcatctcctagatttgataatctgttggaggtaggcagtagaatggatggtgatgtcactaacttggggaattaaaaatagaacaggcttggaataaaagatgacttcagatttggacatatggaattagaaatacttgtctatagctgagagcagaggtcaaagtcagaactaaaaacagaggatctgtggcatagagacgataattgaagctgtgggagtcagtgtggtgaaagtggggcacatgtgtggtgtggggtaaaaaggagggctaactgaggaacaacaacatcacagggatgttcagaaagatgccttgcaaaggagacagcggggtgactagagagtcaacaaaaaactagagcagggtgggtcacaaacagcaagggaagcaaagtcttcaaaaagagagtaatcacagtataaaatgttgacgactggaaagttaaaaaggacaaggatatgtggactggaagcatgcccaggttcatgttgttgcaaatggaagagtatgtgttagtgagaggtttttccctgacttggtaacttaagagagggtgcaacgggttgagaagcaatgagaggtgaaagaggaaaaatttgggtatgaagaggcaaagagaactgcattagttagggaggaatacagggctcaaggagaggttttttatgtacataatgaactgattaacaatactacagtcaagcaaattaacatattcatctcctcccatagttaaccatttttagtgtgtgtgataagaacacctaaaatctactctgtttgcaaatttctagtatgcaatacggtattattaactatagtcctcatgctgcccatttgatttctagatttcttcatcctacattaattacatccttgtgccttttgacaagtatctctccatttcccccacctccccaccttcagtaatcaccattctactttctgcttctatggagagtagaagtgagtttttttagaccccacatataagtgagatcatgtggtatttgtctccctgtatctggcttgtttcacttagcataatgtcttccaagttcatctatgttattgtaaatggcagaatcaaggaagatttgttgttgttgttgttttacatatgaagaatttggaagactttctaaaggtggcaacagcaagatggtagaataggaagtctatggctccactttcactacccagccaagagaaggatccactagcaactatccacaggccagaacatcttttcaaaaatcctactacttagatagaactcacatagtcccccaaactgaatgaaaaccaaattaaaacgataagaagaacagtctcactttgactgcactgctcctctccctcccccaagttgccacaatgccagacggagaggaactccttgacccaaagtttctactgggggaaaaaagaactggagacagttatccagcttccctaacaatctcatataattcccaggaaggctactccagtctcacttcatgaggaacactgtgggtaggtaatagcacagctagactgcccaggatcaggtaaaaacaaaggaaggaagcagaggtcacaatgaccagcatacagatcttggtggtacctctgcatttctgccagccatggaaccagatggaagacacaaatcaacatgaagctgacctcatggtcttcagaagcacagtaggaagttcaacctagcttgattccccagagggttagtcttcatgcccagtctcagagcccaccccagtgaccccactgaggcagggagacccccaactccacccattgcagataagcacagtggctaggcctgcatgactggagaagtcaagcagcagttccactcagaccaaaagcccactcaaccatcctgccaaggcacggaaactcctacctcagcacattttggagaagcacaggcgccagacctacttgatccaggaagtcaaacagccactcaactcagccaaaagcttgtcacacagctccactgggacaaggagggaatcctcaatcatgcatttcaaagagcgtggcctctggttctgtctatcccaagcagtatctacacctaacctcagtgcccagcctggagccctgcccaactgcagatcccaaatagcagaattatccagccagggaatacatcttattatcagcctgaccagaagctttgcagtccctagccagcagctcccccttataccagtgcccaaccagtgatattgctgggcagtggaacctagccaggagccccagctaaaaacagaattaaggcagcagcccagccaactagagagcccacaaaaagctctgcctgcctagggtcattagcagctggccctttcagaatcacagttagactaaacagtgaaggtctatccctgccaaagaacacctgtaaaggccagcagaggaggctgtctcctcaaatatacagacaacaatgcaaggacacaaaaattacaaagaatcaggaaatcataacactctcaaaataaactaataaagctccaataatcaaccctaaagatatacagatctatcaaatgactgaaaagaattcagaataatcatcttaaagatgttcagtaaactaaaagaatacacattaaaaattaaataaaatttggaaaacaatacatgaacaaagtgagaagtttgataaagaaatagacacaattgcaaaaatagaaattctagagataaaggttacaggcatgacttagagatactgtgggttcagttatagaccaccacaattttatcatgaggcacagtaatccagtcacatcttcaggctttacttacatttctggttctcgctatttctaccacatcggcaattgcttcttccactgaagtcttggacccctcaaagtcatccatgagggttgaaataaacttctttcaaacttctattaatgttgttatttgtaactcctctcatgaaacacaaatattcttaatggcatctagaatggtgaatcctttccagaaggtttttaatttactttgcccatatatctcagagaaattactatttttggcagctatagccttacaaaatgcctttcttaaataacaggacttgaaagttgaaattactccttgatctattgactgcagaatggatgttgtgctagcaagcatgaaaacactaatttccttgtacatcttcatcagcactctcaggtgactgggtgcacggtctatgagcagaagtatttttaaagaaattgtgttttctgagcaatgggtctcaatggggagttataaatattcagtaaatcatactgtaaacagatgtgctaccatccagactttgtgtttctattgatacagaccaggcagagtccatttagcataattaagggccctaggattctcaaaatggtaaatgagctttggcttaaacttaaactgaccaattgcattcactcctaaggagatagtcagtctatcctttgaaattttgaagctagactttgacttctcctctctagctgtgaaagttctacatggcatcttcttccaacataaagctgtttttgtcttcattgaaaatctcttgcttaatgtggccgtcttcatcaatgatctttgctaagtctagataacttgctgcagcttctacatcagcatttgctgcttcaccttgcacttttatgctatgaagattacttctttcctttaacctcatgaaccaagttttgctagcttccaacatttttctgcagcttccttacctctctcggccttcatagaattgaagaaaatgaaggccttgttctggcaaggctttggcttaaaggaatgttgtggctgacttgatcttctgtcaaaaccagtaaaattttttccatagcagctatatggctgttttactttgttattcatgtgttcactggagtaacacttttaatttccttctataactttccttatgcattcacaaatttggcaaaaggaatctagctttcagcctatctgagcttttgaaatatgttcctcactaagcttaaccatttttaaaaaatgcttttgattttcaatgagagatgtgtgactcttcctttcacttgaacacttagaagtcattgtcgggttactaattgacctaatttcaatattgttgtgtttcagggaataggaaaacttcaggaaagagagagagatgagggaatggccagttggtggagcagttagaacacacccaatatttattgataacatttactgtcttatatgggtgtagtttgtggctccccaaacaattatgatagtgacatcaaaaataactgaccacaggtcaccataacagatataataataataataaattgaaatattgcaagaattaccaaattttgacacagagacataaaatgagcaaatgtcattgaaaaaaaatagcagcaataaatttgcccaatgcagggtaccacaaactttcaatttgttaaaaatgcaatatctgaaaaaaaagcaaaacgcaataaaatgaggtaatcttatgcaatgaatgaacttataaaaatgcagtaaaaatgcatcaacagaagactcaaccaagcagaggaaagaattagtgagctcaaagacaggacatttaaaattatccagtcagaggggaataaaagacaaaggaatgaagaaatcctatgggaattatggaactccattaagagaccaaacccttgaataacaagagttgcagaagaaggaaaatagggaaaggtagaatttggctgtgaatccatctggtcctggactcttttttgttggtaagctattgattattgccacaatttcagatcctgttattggtctattcagagattcaacttcttcctggtttagtcttgggagagtgtatgtgtcaaggaatttatccatttcttctagattttccagtttatttgtgtagaggtgtttgtagtattctctgatggtagtttgtatttctgtgggattggtggtgatatcccctttatcattttttattgcatctatttgattcttctctcttttattctttattagtcttgctagcagtctatcaattttgttgatcctttcaaaaaaccagctcctggattcattaatttttgaagggttttttttctctctatttccttcagttctgctctgattttagttatttcttgccttctgctagcttgtgaatgtgtttgctgttgcttttctagctcttttaattgtgatgttagggtatcaattttggaactttcctgctttctcttgtgggcatttagtgctataaatttccctgtacacgctgctttgaatgtgtcccagagattctggtatgttgtgtctttgttctcattggtttcaaagaacatctttatttctgccttcatttcgttatgtacccagtagtcattaaggagcaggttgttcattttccacatacttgagcggttttgagtgagtttcttaatcctgagttctagtttgattgcactgtggtctgagacacagtttgttataatttctgttcttttacatttgctaaggagagctttacttccaactatgtggtcaattttggaataggtgtggtgtggtgctgaaaaaaaaaagtaaggaggaactggtaccattccttctgaaactattccaatcaatagaaaaacaggcaatcctccctaactcattttatgaggccagcatcatcctgataccaaagctgggcagagacacaaccaaaaaagagaattttagaccaatatccttgatgaacattgatgcaaaaatcctcaataaaatacggcaaaccgaattcagcagcacatcaaaaagcttatccaccatgatcaagtgggcttcatccctgggatgcaaggttggttcaatatatgcaaatcaataaatgtaatccagcatataaacagaaccaaagacaaaaaccacatgattatctcaatagatgcaggaaaggcctttgacaaaattcaacaacccttcatgctaaaaactctcaataaattaggtattgatgggacgtatctcaaaataataagacctatgtatgacaaacctacagccaatatcatactgaatggggaaaaactggaagcattccctttgaaaactggcacaagacagggatgccctctctcaccactcctattcaacatagtgttggaagttctggccagggcaattaggcaggagaaggaaataaagggtatccaattaggaaaagaggaagtcaaattgtccctgtttgcagatgacatgattgtatatctagaaaaccccatcatctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctgggaatccaacttacaagggatgtgaaggacctcttcaaagagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcgcatggaaccaaaaaagagcccgcatcaccaagtcaatcctaagccaaaagaacaaagccggaggcatcacgctacctgacttcaaactatactacaaggctacagtaaccaaaacagcatggtactggtaccaaaacagagatatagatcaatggaacagaacagagccctcagaaaaaacaccacatacctacaactatctgatctttgacaaacctgagaaaaacaaccaatggggaaacgattccctatttaataaatggtgctgggaaaactggctagccatatgtagaaagctgaaactggagcccttccttacaccttatacaaaaattaattcaagatggattaaagacttaaatgttagacctaaaaccataaaaaccctagaagaaaacctaggcattaccattcaggacataggcataggcaaggacttcatgtctaaaacaccaaaagctatggcaacaaaagacaaaattgacaaatgggatctaattaaactaaagagcttctgcacagcaaaagaaactaccatcagagtgaacaggcaacctacagaatgggagaaaatttttgcaacctactcatctgacaaagggctaatagccagaatctataatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactatttcaatcattgtggaagtcagtgtggcaattcctcagggatctagaactagaaataccatttgacccagccatcctattactgggtatatacccaaaggactataaatcatgctgctataaagacacatgcacacgtatgtttattgcagctgtattcacaatagcaaagacttggaaccaaccgaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaaggacaaaaaaccaaacactgcatgttctcactcatagatgggaattgagcaatgagaacacatggacacaggaaggggaacatcacactttggggactgttgtggggtgaggggagtggggagggatagcattaggagatatacctaatgctaaatgatgagttaatgggtgcagcacaccagcatggcgcatgtatacatatgtaactaacatgcacattgtgcacatgtaccctaaaacttaaagtataataataattaaaaaaagaaaaatagggaaagggaaccagaaatcatatttttaaaaataatggctgaaaacttccctaatctggaaaaaagtgtcaacatccacatactggaggtgttgaagtaattcaacccaaagagaaattcagcaatacacataataatcaaagaaatcaaaaatcaaagacaaagacaaaatgttgagagcagcaaaagataagaaacatatcacatgaaaaggagtcccaatatgactatcagcagaattctcagcaaaaaaccctcaagccaagaaagagtgggatgacatagtcaaaatggcagaagcaaaaacactacccaccaataatacccaggaaatccgtctttcagaaatcaggaagaaataaaaattttcctaaacaaaaatctaagggagttcatcaccactagacctgcctgacataaattggtaaagggagttccttaagctgaaacaaaaaaggctactaattaacatcataaaacatacaaaagaacaaaagtcaatggtataagtaaaacagagtaatattcataatagtctaggacattaatgatggtgtgtaaagcaattttattcctagcatgggggttaaaataaaagctgttgataataactataattaaaacaaattgtcaaggtgtacactttacaaaactgatgtaaatattggcatcgaaaacataaaatgggaatgcatagggagaaaaactgtaaagttgcatataatcaaagtaaagttgttatcagcttgaaatagcctgctataagatgttctatgttagcctcaggataacaaagcaaacatctgcagtagaagcacaaagtacaaatagaaggaattcaaaacatatcactacagaaaaccatcaaaccacaaaggaaaacagcaagaaagaaagacaagaactaatgattaacaaaacactcagtaaacaattaacaaagtggcattattaaattctctgctatcaataattaccctgaatgtaaatggattaaattctccaataaaaagacataacatgactatatattaatagaccaaaaaaaaaaaaaaaaaacaaggcccaattataggctgtctataagagactggcctcacttttaaggacacacatagactaacagtaaaaagatggaaaaagatatttcacacaaatagaaacaaaaagagagcagaggtagctatataatcatcctttatatctgcaaggggttggttccaggaacactatgaatgccaaaattcacaaatgctcaagtcccttatataaaatgccatagcatttgcatataacctatgtgcatccttctgcatactttaaatcatttctagattatacataatacccaatacaatgtaaatgctacataggtaacttttatactgtgttggttttttatttttattatgttttattcttgtattatttttattgtatttttaaatatttttgatttgcaattagtaaaatctataatgcaaaacccatgcctacagagggccaactgtacttatgtaagacaaaataggctttagggctttgtatagtctgagctgactacgggtagaagggatcccaaagcacaccacagcacagctgctctaccaaaatatggccagactgcttccttaagcaggttcccaatcccattcctcctcacttggtgggaactcccaagtgggctttcagccacccctgttggtgttctctggccaagagagatttgtaatttccctcaaacagagcacccagagggaggggtgggacaccatctttgctctttgagtgacagccattccatctttcgggcttcagggtgtctgaggtgactggggactgaagcagacccctaacacaacacagcttctctactgaaacacggcaagagtgcttttttaagcaggtctccaatcctattcctcctcattgggcagggcttcccaactggggtctccagccacttcctagggtgcctttgggctggcaacaggcccatatctccctaggacaaagcgtccagatggaggaacaggttgccacctttgctgttttgcagcattcactggtgaaacctccaggtactgaaatatctgaggcaactagggaccagagtgcaccccaagcacactgcagcagccctatggaaaagtggcaagacagttacatgggtgtccattcctatatcttctcaccaggcaggtcctccaggcctgggcctccagccaccccccaccagagttattgagctggtagcaactctaggggcaactgaaagcctctctgccactgcctctgccttgccaccctcagactaacaatggaacaaagaccctaagtgttttattcacacctccaacaaactgcagtcaacccaagaagaggagaatagtccatctcccatgggtctcacacaccccccactgctcatcacaagacagggaacctctggcttgggcccacagcatagaccctccatcctgggctgattgcactgggcaaatgctgacctgcatctctgtggcatagaggccccaggagacaagcaaatgaccctcagccacaactagtactaagatcccttcctctgctgcctccaagttggggagaaaacaacactgagattgccccagagctgcaatgaacagcccaggagtgccaaatcatgatctacagccagcactcaaggggagaggatcccacactttcagagtattgagcaggaacatggctgccactgtgaggaaacataggggagcaacacaaccgaacaaaagtctaccaactgacaaataagcctaagtactacctgctggatcacactctaaagcttcaaaatgaaaaatacccccctaatataccccctctgaaaccagagacaagaaggcagcttcaaagaaaaaccctgcacaaagccttggcctggtgaaaacatccagaaaagaagtctattgactgtactcaatctacactgcagttaaaggaacagccacatgcagagatgaggaagaatcaacacaagaactctggtaactctaatggccagagtgtctgatgtcctccaaacaaccacaccagttctccaacaagagctctcaatcaggccaaactggctgggatgacagagatagaattcagaaccaatggataggaagaaagattatcaagattcagagaatggcaaaacacaatccagggaaaataggaatcacaataaagtaggagctgaaagacaaaacagccactacaaaaaagaacctaatgggtctgacagagctgaacaacacagtacaagagtttcacaatgcaatcacaagtattaacagcagaataaaccaagctgaggaaaaaaaatctcagaacttgaagactggttctctaaggcagtcagacaaaaataaagaaaaaagaataaaaaggaataaacaaagcctctgcaaagtatgggattatgtgatgaggccaaatctatgaatcattggcattcctgaaagggaggaggaaaaagcaaacaacttggaaaacatatttcaggatataatccatgaaaacttcctcaaccttgctagagaagctaatgatcaaattcaggaaatacagagaattcctacaagattctacacaaaaagaccatcccaaagacatataatcatcaaattttctaccatcaaaatgtcaaaataaatgctaaatgcagctagagagaaagggcaggttacctacaaagggaatcccactaggctaacagcaagcctctcaggtgataccctgaaagccaaaagagattggagacctctattcaaccatcatagggaaaaaaatcttcaatcaagggtttcatatttggccaaactaggcttcctaagtgaagaagaaatacaatccttttcagattagcaaatgttgacggaattcattaccaccagacctgccttacaagagctcttcaaaggagtgttaaatgcagaaagactgctaccttctaatacaaaaacacacttaaacacacagagcagtgtcattgtgaagcaattacaaaaacaaactaacataataaccagctaacagcacaacgacataatcaaatccacacatatcaatattaatattcaatgtaaatgggctaaatgcctcacttaaaaggcacaaagtggaaagctggatgaaaatgcaagacccagtgatatgctgtcttcaagagacacatctcacaagtaatgacaatcctaggctcaaaataaagggatggagggaaatctaccaagcaaatggaaaacagaaaaaagcagggtttgcaatcctaatttcagataaaacagatttcaaaccaacaaagaaaaaaaaaaagacaaagcagggcattacataatggtaaagggttcaattcaacagaagacctaactatcctaaatacataggcacccatcacagaagcacccagattcataaagccagttcttagagacctacaaagagatatagactcccacacaataatggtgggagacttcaaaatgccactgatagtattagacagatcttcaaggcagaaaattaacaaagatattcaagacctaaactcatcactggacatggatctaatggacctttacagaattctccaccgaaaaacaacaaactatacattctgctcattgtcacagggcacgtactctaaaatcaaccacataattggacctaaaacaatcctcaacttatgtaaaagaaccaaaatcttatgaacacactcttggactagagctcaataaaaacagaagtcaagactaggaaaatcatgcaaaaccatgcaatgacatggaaattaaacatgctccataatgactttaagggtacataatgaaattacagcagaaataaagaagttatttgaaaataataagaaaaaagatccataacagaatctctgggacacacctaaggcaatgttaagaggtaaatccatagcactaaatccctacatcaaaaagttagaaagatctcaaattaatgacctaacttcacacctgaaggaattagagaagcaaggacaaatcaacccaaagcaagcagaagacaagaaataacaaaaaatcagagctgaactgaaggaaatcaagacatgaaaaactattcaaaagatcaaggaactaggagttggttttctgaaaaaaattaataaaataggccactagctacactaataatgaagaaaagagaaaagactcaaataaaaacaattagaaatgatgaagagaatgttactactgacatcacagaaataaaaacagccatcagaagctactacaaacccctcaatgcacagaaactagaaaaccaagaagagatgaataaacttgtggacatatacaacctcccaagactgagccaggaagaaaatgaatcccttcacagaccaataatgagctccaaaagtgaattattagtaagtaacctatcaaccaaaaaaagtctggaacctgatgaattcacagacaaattctaccagatgtacaaagaacagctggtaccattcctactaaaactattcaaaaaaactgaggagggactcctccccaactcattcaatgaagccaagatcatcttgataccaaaacttggcagagacacaacaaaaaaagaaaacttcaggccaatatctgtgatgaacatccacacaaaaatcatcaacaaaatacttacaaaacaaaatcactaacacatcaaaaagctaatccaccatgatcaagtagccttcatcctcacgatgcaagtttggttcagcatacaaaaattaataaatgtgattcatcacataaacagaactaaagacaaaaaccacgtgattatctcaataaatgcagaaaaggcttttaataaaattcaacatcccttcatgttaaaaattctcaataaactaggtattgaaggaacatacttcaaaatgatgagagctatctctgacaaacccacagccaacattttactgaatgggtaaaagctggaagcatatccattaaaaaccagcacaagacaaggatgcactatctcatcattcctattcaacataatatcagaagtcccagccagggcagtcaggcaagacaaagaaataaagtgcatccaaataggaagagagaaagttaaactacctctgtttgcagatgacatgattttatttctagaaaaccccatagtctcagcccaaaagctcctccagctgataaacacgtcagcaaagttccaggatacaaaatcaatgtacaaaaatcattagcattactatacaccaacaacagccaaacctagagccaaatcagaaaggctattttattcacaattgctacaaaaagaataaaataactagaaatacagctaaccatggaggtgaaagagttctgcaatgagaattacaaaacattcctcaaagaaattagaaagacacaaacaaatggaaacacctcccatattcatgaatagcaagaaacaatatcattaaaatggctatattacccaaagcaatttacaaattcaatgctgtttctatcaaactaccaatgacattcttcacagaactagaaaaaaactattctaaaatttatatgaaaccaaaaaaacaaaagagcctcaataggcaaggcagtaccaggcaaaaagaacaaagctggaagcctcatgttattcaacttcaaactatactacaagactacagtaaccaaaacagcatggttctgatacaaaaacaagcacatagaccaatggaagataatagagaacccagaaataagactatatatctacaatcatctgatctttgacaaacctgacaaaaactagtaattgacagaatcactattcaataaatggtgttgggataactggatagccatatgcagaagattgaagctggaccccttccttacaccatatacaaaaattaactcaggatggattaaagtcttaaatttaaaacccaaaactatgaaaaccctggaagataacttaggcaatactattctggatataggaatgggcaaaaatttcatgacagagacaccaaaagcaatcataacaaaagcaaatattgacaaatggaatctaattagatttaagagcttctgcacagccaaaaaaactatcaacagggtcaacagacaacctacagaatgggaaaaaatattaggaaactatccatctcacaaagatctaatatccagcatttgtaagaaatttaaagaaatttaaacatgaaaaaacaaccccattaaaacgtgagcaaagggcacatgcacaagggctggagccaagatgactgaataggaaaacctctgctttacagctcccagcgtgagcgacgcagaagaagagtgatttctgcatttccatcggagttaccgggttcatctcactagggaatgccagacagtgggcgcaggacagtgggtgtagtgcaccgtgcatgagctgaagctgggtgaggcattgcatcactcaggaagtgcaaggggtcagggagttccctttcctagtcaaagaaaggggtgacacacggcacctggaaaatcgggtcactcccaccccaatactgcgcttttcccacaggcttagaaaaccgcacacgacgagattatatcccgcacctggctcggagggtcctacgcccatggagtctcactgattgctagtacagcagtctgagatcaaactgcaaggctgcagtgaggctgagggaggggcgcccacaattgcccaggcttgcttaggtaaacaaagcagctgggaagctccaactgggtggagcccaccacagctcaaggaggcctgcctgcctctgtaggctccacctctggggtcagggcacagacaaacaaaaagacagcagtaacctctgcagaattaaatgtccctgtctgacagctttgaagagagcagtggttctcccagcacacagctggagatctgagaacacgcagactgcctcctcaagtgggttgctgacccctgacccccgagcagcctaactgggaggcaccccccagtaggggcagactgacacttcacaaggccgggtactcctctgagacaaaatttccagaggaacaatcagacagcagcattcgtggttcacaaaaatccgctgttctgcagccaccgctgctggtacccaggcaaacagggtctggagtggatctctagcaaattccaacagacctgcagctaagggtcctgtctgttagaaggaaaactaacaaacagaaaggaaatccacaccaaaaaccatctgtacatcaccatcatcaaagaccaaaagtagataaaaccacaaagatgaggaaaaaacagaacagaaaaactggaaactctaaaaagcagagctcctctcctcctccaaaggaacgcagctcctcatcagcaacagaacaaagctggatggagaatgactttgacgagttgagagaagaaggcttcagatgatcaaactactccgagctacaggaggaaattcaaaccaaaggcaaagaagttgaaaactttgaaaaaaatttagaggaatgtataactagaataaccaatacagagaagtgcttaaaggagctgttggagatgaaagccaaggcacaagaactacgtgaagaatgcagaagcctcaggagctgatgcgatcaactggaagaaaggctatcagtgatgaaagatgaaatgaatgaaatgaagcaagaagggaagtttagagaaaaaagaataaaaagaaatgaacaaagcctccaagaaatatgggactatttgaaaagaccaaatctaagcctgattggtgtacctgaaagtgacgggaagaatagaaacaacttggaaaactctcttcaggatgttatccaggagaacttccccaatctagcaaggcacgccaacattcagattcaggaaatacagagaacgccacaaagatactcctcgagaagagcaactccaagacacataattgtcacattcaccaaagttgaaatgaaggaaagaatgttaagggcagccagagagaaaggtcgggttatccacaaagggaagcccatcagactaacagcagatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagaacaaccggtaccagccactgcaaaatcatgccaaattgtaaagaccattgaggctaggaagaaactgcatcaactaacgagcaaaataaccagctaacatcatcatgacaggatcaaattcacacataacaatattaactttaaatgtaaatggactaaatgctccaattaaaaggcacagactggcaaactggataaagagtcaagacccatcagtgtgctgtattcaggaaacccatctcacgtgcggagacacataaaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacagaagcacccagattcataaagcaagtcctgagtgacctacaaagagacttagactcccacacaataataatgggagactttaacaccccactgtcaacattagatagatcaacgagacagaaagttaacaaggatacccaagaattcaactcagctctgcaccaagtggacctaatagacatctacagaactctccaccacaaatcaacagaatatacatttttctcagcaccataccacacctattccaaaattgaccacatagttggaagtaaagctctcctcagtaaatgtaaaagatcagaaattataacaaactctctcttagaccacagtgcaatcaaactagaactcaggattaagaaactcactcaaaactgctcaactacatcgaaactgaacaacctgctcctgaatgactactgggtacataacgaaatgaaggcagaaataaagatgttctttgaaaccaatgagaacaaaggcacaacataccagaatctctgggacacattcaaagcagtgtgtagagggaaatttatagcactgaatgcccataagagaaagcaggaaagattaaaaattgacaccctaacatcacaattaaaagaactagaaaagcaagagcaaacacattcaaaagctagcagaaggcaagaaataactaaaatcagagcacaactgaaggaaatagacacacgaaaaaccctttaaaaattaatgaatccaggagctggttttttgaaaggatcaacaaaattgacagaccactagcaagactaataaagaagtaaactatcacaagaacaaaaaaccaagcaccgcatattctcactcataggtgggaattgaacaatgagaacacatggacacaggaaggggaacatcacgctttggggactgttgtggggtgggaggagtggggagggatagctttaggagatatacctaatgctacatgacaagttaatgggtgcagcacatcaacatggcacatgtatacatatgtaactaacctgcacattgtgcacatgtaccctaaaacttaaagaataataataataaaataaaataaattaaaaaaaagaaaaaacatctggcaaattgtaaacaagcagcaaataactatttccattattattagtagtaatattattagataaatatattgctcaactgaagattgctaattagtgagtattgtagcaattaccaaacaaggaaacaaattttaagtcgttcatttaaattctagaataattaaaagtttcagcttaatttcaaatgtatattattagaagtatttaaataaactaaattgtgttggtatggagtaataaaaaaaaagagaaaacagagaacaatcaaatagatgcaataaaaaatgataaagggtatatcaacaccgatcccacagaaatacaaactaccatcagaggatactacaaacacctctacacaaataaactagaaaatctagaagaaatggataaattcctcgacacatacaccctcccaagactaaaccaggaagaagttgaatctctgaatacaccaataacaggctctgaaattgtggcaataatcaatagcttaccaacaaaaaagagtccaggaccagatggattcaaagccgaattctaccagaggtacaaggaggaactggtactattccttctgaaactattccaatcaatagaaaaagagggaatcctccctaactcattttacgaggtcagcatcatcctgataccaaagccgggcagagacacaaccaaaaaagagaattttagaccaatatccttgatgaacattgatgcaaaaatcctcaataaaatattggcaaactgaatccagcagcacatcaaaaagcttatccaccatgatcaagtgggcttcatccttgggatccaaggttggttcaatatacacaaatcaataaatgtaatccagcatataaacagaaccaaagacaaaaaccacatgattatctcaatagatgcagaaaaggcctttgacaaaattcaacaaccttcatgttaaaaactctcaataaattaggtattgatgggacatatctcaaaataataagagctatctatgacaaacccacagccaatatcatactgaatgggcaaaaactggaagcattccctttgaatactggcacaagacagggatgctctctctcaccgctcctattcaacatagtgttggaagttctggccagggcaattaggcaggagaaggaaataaagggtattcaattaggaaaagaggaagtcaaattgtccctgtttgcagatgacatgattgtatgtctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaattcccattcgcaattgcttcaaagataataaaatacctgggaatccaatttacaagggacatgaaggacctcttcaaggagaactagaaaccactgctcaatgaaataaaagaggatacaaagaaatggaagaacattccatgctcatgggtaggaagaatcaatattatgaaaatggccaactgcccaaggtaatttacagattcaatgccatccccatcaagctaccaatgactttcttcacagaattggaaaaaactactttaaagttcacatggaaccaaaaaagagcctgcatcaccaagtcaatcctaagccaaaagaacaaagccagaggcatcacgctacctgacttcaaactatactacaaggctacagtaaccaaaacagcatggtactggtaccaaaacagagatatagatcaatggaacagaatggagccctcagaaataatgccacatatctacaactatctgatctttgacaaacctgagaaaaacaagcaatgtggaaaggattccctatttaataaatggtgctgggaaaactggctagccatatgtagaaagctgaaactggagcccttccttacaccttataccagaattaattcaagatggaataaagacttaaacattagacctaaaaccataaaaaccctagaagaaaacctaggcattaccattcaggacataggcatgggcaaggacttcatgtctaaaacaccaaaagctatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatagccagaatctataatgaactcaaacaaatttacaagaaaaaaacaaacaaccccatcaaaaagtgggtgaaggatatgaccagacacttctcaaaagaagacatttatgcagccaaaaaacacgtgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggaatgtaaactagttcaaccattgtggaagtcagtgtggcgattcctcagggatctagaactagaaataccatttgacccagccatcctattactgggtatatacccaaaggactataaatcatgctgctataaagacacatgcacacgtatgtttattgcagctgtattcacaatagcaaagacttggaaccaacccaaatgttcaacaatgatagactggattaagaaaatgtggcacatatacaccatggaatactatgcagccataaaaaatgatgagttcatatcctttgtagggacatggatgaaattggaaatcatcattctcagtaaactattgcaaggacaaaaaaccaaacactgcatgttctcactcatagatgggaattgaacaatgagaacacatggacacaggaaggggaacatcacattctggggactgttgtggggtgtgggcatgggggagggatagcattaggatatatacctaaggctaaatgatgagttaatgggtgcagcacaccagcatggcgcatgtatacatatgtaactaacctgcacattatgcacatgtaccctaaaacttaaagtataataataataaaataaaataaaataaataagaatgagatcatgtcttttgtgggaacacagatggagctggaggctattattcttagcaaactaatgcaggaacagaaaaccaaatactgcatgctcttcttataagtggggttaaatgataagaatttaggaacacaaagaaggaaacaacagacaaaagggtctgcttgctaggaaaggttgggaagagggagaggagcagaaaggacaaccactgggtactgggattaatacctggatgatgaaataatatgcacaggaaacccccatgacatgtgtttacctatgtaacaaacattcacatgtacccccaaatctaaaataagaatgaaaaaaaattaaaacatagaccttaagtcaaaaactataaaaagagataaagaaagacattatataatgataaaggggtcaattcctccaaagcatacaacaattatatgcagccaatatcagagcacctaaatgtataaaacaaatattaaagaacctaaagggagagatagattgcaatacaatatttgtatgggaatttaatacctcactttcaacaatggacaaatcatccaggcagaaaattaatagcaacacattggacttgaacaacactttataccaaatgaacctaacagacacacatagaacattccatctaacaacaagagaacgtacattctcctcagtgaacaaggaattctccagagtagatcacatgttagaaaacaaaatgatccttagcaaatttaagaagattgaaatcatatcaagtatcttttcagattacaatggtataaaactaggaatcaataataggagaaacttcacaaaattcacaaatataggaaattaaacaacatgctcctgcaaaatcaatgatccaatgaagaaattgaaagggaaatcaaaactatcctgagaaaagcaaaaatggaaacccaacataccataacttatgggatatagcaaaagcagttctaagagaaaagcttataacaataaatgcctacatgaaaaagaaaaaaagatctaaaataaacaacttgatgttactcctcaaggagctaggaaaagaaggacaaactaagcccagggttaacagaaagaagaaaacagtaatagagcagaaataactaatatagagacaagaaatcaatacaaaagatcaacaaaactgaaagttggatttttgaaaagaaaagcaaaatcaacaaacctttagctagaccaagaaaaaagagagaagactcaaataaaatcacaaatgaaaacagaaacattacaatggataccacagaaatacaaaagattataaaagcctactattaaaaattatatgccaacaaattagataacatggaaataataaattctttttttattatacttcaagtgctgggatacatgtgcagaatatgaacatttgttacataggtatacatgtgccatggtggtttgctgcacccatcaacccatcatctaggttttaagccctgcatgcattaggtgtttatctaatgctctccccctccttgctccccataccccaacaggccctggcatgtgatgtttccctccctgtgttcatgtattccatgggtcaactcccacttataagtgagaacatgcggtgtttgcttttctgtttctgtgttagtttgctgagaatgatggcttccagctttatccacgtccctgcaaaggacattaactcatctgatttatggctgcatagtattccatgttgtatatgtgccacattttctgtatccaatctgttgttgatgggcatttgggttggttccaagtccttgctactgtgaatagtcctggaataaacatatgtgtgcatgtgtctttatagtagaatgatttataatcctttgggtatatacccagtaatgggattgctgggtcaaatggtatttctggttctagatccttgaggaatcaccacactgtcttccacaatggttgaaataatttatactcccaccaacagtgcaaaagcattcctatttctccacattctctccaacatctgttgtttcctgactttttaacaatctccattctaactggcatgaaatagtatctcattgtggttttgatttgtatttctctaatgacaagtgataatgagctttttttcaaatgtttgttggccacataaatgtcttcttttgagaagtgtctgttcatatcctttgcccactttttcatggggttgttttttttttcttataaatttgttaagttccttgtagattctggatattagacctttgtcagatgaatagactgcaaaaattttctcccattttttaggttgcctgttcactctgatgatagtttattttgctgtgcagaagctctttagtttaattagatcccatttgtcaattatggggggttttgcaattagttttggtgttttagtcatgaagtctttgcccatgcttaggtcctgactggtactgcctaggttttcttctagggtttttaggggtttaggttttatgtttaagtatttaatccatcttgagttaatttttgtataaggagtaaggaaggggtccagtttccgttttctgcatatggctagccagttttcccaacgccatttattaaatagggaatcctttccccattgcttgtttttgtcaggtttgtcaaagatcagatggttgtagatgtgatgggttatttctgaggcctctgttctgttccattcatcaatatatctgttttggtaccagtaccatgctgtttgggttactgtagtcttgtagcatagtttgaagtcaagtacaatgatgtctccgggtttgctctttttgcttaggattgtcttggctatacgaactcttttttggttccatatgaaatttaaagtacctttttctagctctgtaaagaaagtcaatggtagcttgatgggaatagcattgaatctataaattacttgggcagtatggccattttcatgatactgattcttcctatccatgagcatggaatgtttttccatttgtttgtgccctctcttatttccttgagcaggtttgtagttctccttgaagaggttctgcatatcccttgttaagttggattcctgggtattttattttctttgtagcaattgtgaatggtagttcattcatgatttggctctcttttttactattattggtatgtaggaatgcttgtgatttttgcacattgattttgtatccagactttgctgaagttgcttatcagcttaaggagttttggggctgagacattggagttttctaaatgtacaatcatgtcatctgcaaacagagacaatttgactgcctctcttcctatttgaataccctttacttctttctcttgacagattgtccttgctgcacttccaatactatgttgaataagagtggtgagaaagggcatccttgttttgtgatggttttcaaagggaatgtttccagcatttgtccattcagtatgatattgactatgggtttgtcataaatagctcttattattttgagatatgttcaatcagtacctagtttgttgagtgtttttaggatgaaagggtgttaaattttatcaaagaatttttatgcatctattgagataatcgtggtttttgtcattggttcagtttatgtgatggattacatctatcaatttgcaaatgttgaaccagccttgcgtcccagggatgaagccaacttgatcgtggtggatcatcttttgatgtgctgctagatttggtttgccagtattttactgaggattttcacatcaatgttcatcagggatattgaactgaaattttgttttttgctgtgtctctgtcaggtttgggtatcaggatgatgctggcctcataaaatgaggtagggaggagtccctctttttctattgtttggaatagtttcaggaagaatggtaccagctcttctttgtacatctagtggaattcagctgtgaatttgtctggtcctgggctttttttggttggtaggcttttaattattacatcaatttcagaacttgttactggtctattcagggattcaacttcttcctggtttagtcttggtaaggtgtatgtgtccaggaatttatccatttgttctagcttttctagtttatttgtgtagaaatgtttatagtattctctgatgctagttttatttatataggatcagtggtgaatcccctttatcattttttattgtatctatttgattcttctctcttttcatctttattagtctggctagcagtctatctattttgttaatctttttgaaaaaccagctcatggatttattgattttttgaagggtttttcatgtttctctccttcagttctgctctgatcttagttatttcttgtcttctgctagcttttgaatttgtttgctcttgcttctctagttcttttacttttgatgctagggtgtcaattttagatcattcctgctttccaatgtgggcatttagtgctataaatttccctcttaacactgctttagctgtgtcccagagattccaatatgttctgtcttttttctcaatggtttcaaagaacttatttatttaattttgttatttagccagtagtcattcaggagcaggttgttcagtttccaagtagatatgcagctttgagtgagtttcttaatcctgagttctaatttgattgcactgtcgtgtgagagactgtttgttacgatttccattttttgcatttgctgaggagtgttttacttccaattatgtggtcaattttagaataagtgtgatgtggtgctgagaagaatgaatattctattaattttgggtggaaagttctgtagatgtccattaggtctgcttggtccagagctgagctcaagtcctcaatatccttgttaattttctgttttgttgatttgtctaatattgacagtggggtgttaaagtctcccactattattgtgtgggagtctaagtctctttgtaagtctctaagaacttgttttatgaatctgggtgctcctgtattaggtgcatatatatttaggatagttagctcttcttgttgaattgagccctttaccattatgtaatgccattctttatctttttaaatttttgttggtttaaagttggtttgttttatcagagactaggattgcaagccctgctcttttttgcttttcatttgcttggtaaatattcctctattcctttattttgagactatgtgtgtctttgcatgtgaggtgggtctcctgaatacagcacacagataggtcttgactctttatccaatttgccagtctgtgtcttttaattggggcatttagccctttttcattcaaggttaatattgttatgtgtgaatttgatcatgtcatcctgattctagctggttatttttcacattagttgatacagtttcttcatagtgtcattggtctttatattttggtatgtttttgtggtggctgataccagtttttcctttccatatttagtgcttccttcaggagctcttgcaaggcaggcctggtggtgacaaaatccctcagcatttgcttgtcttggaagtattttatttcttcttcactaatgaagcttagtttggctggatatgaaattctgggttgaaaattattttatttaagaatgtcaaatattggcccacactctcttctgacttgtaaggtttctgcagagagatccactattagtctagtggccttccctttgtaggtaacttgacccttctctctggctgtccttaagtttttcttttgtttcaaccttggagaatatgacaattatgtgtcttggggttgttcttcttgaggagtatctcagtggtgttctctgtatttcctgaatttgcattcattttgctttggattgctttggttattcaggctcttttttggctctaagtgaattttagaatagctttttgctagttctgtgaaaaataacattagtagttttataggaatggcattgaatctgtagattgctttgagcagtatggccatttcaatgatattgaattttccaatccatgagcatggaatatttttccatttgtttttgtcattcatgatgtcttttagccatgttttgtagttcttcttacagagacctttcacctccttggttagacgtcttcctaagtattttattttttgtgtgactattataaatgagattgcattcttgatttggctctcagcttgaatgttattggtgtatagaaaggtcactgatctttgtacattgatttcatatcctgaaacttcattgaagccatttatcagttccaggagctttttggcagtcattagggttttctaaatagagaatcatgttgtacacaaaaagagatagcttgacttcttcttttcctatttggatgccttttatttctttctcttgcctaattgctctggctaggactttttggtggtggtgttgttgtttgctttcatttttgtttctgttttgagacagggtctcattttgtcatccaggctggagtgcagtggtacgatcatgccttactgcagcctcaacctcaagtgatcctcccaccaaatcttgagtacaggcatatgccaacatacagagctaatttttaaaaaaattttgtagagatagggtctccctatgttgcccaggctggtcttgaattcctgggctcaagaaattttcccttctgggcctcccaaagcactggaattacagacatgaaccaccatgtccagtctatttctgtcatacatctaatttagccatgcagttagcccatttaacttttgtctctttaagataatacttaaattttcactcagtgtgtttcaagtatatgtccttattttacatgtgctattatctataagtataattgataattaaagaatttctacataattattctagtgcaactgagatatatatatcttcaaatttcaaaaatattcagttatgttatttcactggaaaatgtaacatattctttaaagctgtgggctacttggtacactaaacactgctccaaagtatagtgtcagttcaaattcagaagtgagtattttttaagtttatatttatatgcctctaaactgtctaatgataattcaggtcatgctttttcattggttggcattaaaaatctattattttatctctattgaacttaattaaatgctagtttgctcaaagtaccatgaccagtaataaattaaatatattcctggcaagtctattcaaaaataatatatctctcattcccattaaatgacactcatattataattataattccaaaggtaaagagggacattttctaaatatattttgatgatcaatttttttatattcacatatcacatctccagcacaaatacctaattagaaattttccttatcttaatctttgataatcatcacttttctcacgaagtaaaaatatacaactacagtctttagccacatgatagtttattgtgattagagcccttgtcaccaagtaaccctgcctatagttagaataattcttcacttacagacttattttcaggccacctaactagctatgtggacatataatgacatatatcgaccacataagacattaaattttaagaaaagaacacaaaaatgctcaagaaccattacactacaaggaaaacagcattatgtactagaagaaaacacagacctaaagcaaataaatactctcaggtaatatcattgttgtcatagtaagcgtgtaggaggcacagaacttcacagaggatgaaaaaagatactgagcttgtgtgtctcatggcttcctagagaagtcatcctatccagagtttcataggctgtatagggaattgctacatagatgagggggcattgtgagcctgtgctgggctcaggggccagacacatcatggtggtcttgggaaaccacaagtagtctggtactgttgcttccaaaagtgtgaaagcctgggggaggtaaacaggggccagaccacacatggcctcacagatcatgctaagaagcttgaatttaattatgtgggaaaggggaattactaaaaggttttcacaaaggaggccagtcaggagctctttgtttagtccaggtaagaaacgacagaattttatcaaatgacaccagcaaaacaaatggaaagatggaattcatacaggtgtagggtataaaatggacagatcttggtgtctggttagaagttcaacctgaggtgtggcaggaaagggagagacaagcagagcaggagtcccaggtagaacctgactcagtaagaacccagtccaacctctgccatgcattgtgcacctcagtgtccccacctctcagagaaggagtgagacaagattatctctaaggtcccttccaatacaaacatgttgtaatcctaccttatgaatctagcctttctgtagcacagagacaggaccagctccagtgttaggcagaaggctggagggacaaatatcactcaaaaaaaaaaaaaaaaagctcaggcttgccattaaaggcattgaatgcaaatagacacaaattattaaacatctttaaatgtgaacctatttgataagtgtgaggtcttatcatctaaccatctcatgtctgaaaggaaataagattgtaagttctttaagaaagacatcaatttcttgtggtattcattatctaatacactgtgcctgcttcaccctaaaaaaaaaaaaaaaaaaatcaaatgtgattgcttgattataatgttccgggcatttggaatattgttctacattggaaacgaattttatttatatcatcatctgagagaccatgtagtaatacataacatattcaaattgcctgccatacagactgcaaaagcctgagttttctctctccctctacaaaaggcaaacaacaaatcctcaagggtcttgtaaatgttacaggaagtttgtaagctaagtagatttttgcaatgctaacgatttttctttcttgccgagactcatttacttactcaaaatagcaacattccttttccttatatatatttcattttccttctccaaagccagagtttaagtacacaattctgaaaattgtcaatcagcctgattctccctgtggctaagctactccataattataagctagacatcctcttaggtcactagggtctcaagtctgtgaatatttataaaatagtctccccagtgagcaaataaatgttaatgcttctaccaaacgtgattaacaaaaaaacttattctcatgaagaagtgcataattgtaataagatcagaaattaactcaaactccaataacaattaacttagaattgtttttagtgtaggaaatattattgcaagctttaatctgtaagttatagtgtttctaagacaaaaacctcaaaaagcattaacacgcggttctcgaaggtttctgccggaactccatttatgcatacaactaattcacttatcctaccacatgtattcattcaaaacacatgttgaattccttttataagcaaagaatccagtatacagaagtaaataccactggcatggtccctagcctcatagaaattaaagtcaccaagtcgcctcctggcagagacagatagtcaacaagaagtattacaaatattgtttctccccaaggctgagccccagcctcactcccagcagcttccgcctgctgagttgaaggtacccatgttgtctgagcagctattcaactttttattacactgatggaggtactgggcaaggtagtagaaagaaaaagaaaagccagaaaatctagaaatgttaatgatatttagagtagaaataacagagctacttctgggaggaaaagagctgctactataagacaggaaacagctctatatactctgggttttgaccaatgttgctgaccacgatggaaaaacaaggactactgaatttatccccctgccatgaacaactagaaaaatggaaaaaacatgaaacaatggctttgtgttttctcaagggcaggcagtcaaaattttggggtttttttgaataaaatgccagatttcctcgaatgtgagctttaatggttggccttgtttgtgttatagttggacagctactagccatcagagatttagagccaaagtgcaatactcaccttgcctcagacaaaatattcactgcatatttgtgcaaaaggaacacctttactctggcagaaggaatattgcaattacagggtacagagatacaaagtggccattcttagacatttacacagagccagagagaaataatgaatactactctaagaattcttgatgggttcactaaactgaagaagctgaagaaatgaagccttctagcaactcagcttccatggatatcatatttcttaagaaattaggatctctggatgaagaaggtgatcaatggcagacaagttgggactacttcaaggcctttggtgcatttcaacatctgagatcagactgctgaagattcagctgccaccatgagtcaattgggtaagcacacataggaaaaagaatgctacttgaaatttgggaaaggtaggtaagtttcctagcaggcattgggactgagaaaacaagaggctgagtcatttttagagcatgccacagaaatgatgcccatgtgaatgacaaacataagagagaaatgctgctctctaagcaggagggactgggctgtactaggtattatgcatgtcatcaaaatgctcaggatctctgtatctgtggcagacaacttcacagttccacaaagagtatacagcagagtagagaacacctgggattcacagtctgatctcataaacctgagcctaagtgacctaaatcaaaggtcacgacctggttgtacttgacaggtagaatattttatttgatctgcacaatgttttagaaatcggaaaatttctcacagaaatctatactgttgcattctctgaaaagattagaaaaactagaacactaaataatggcagccagacttttctaaatggagcatggacccaccagtcccctcagtctctctcttctctatgctggttcatccaatatggcagacattacttctctgcttcttccttggaaatagctggctttctttaaggcagcaatgatgccagcatccagaaaaatacttactttggaaaacatccttttgcagcaaatggtggccatgtgacaatgttctggccagtaaaacatcaggaagttataggaaggccttacttttccttcttaaaagatgtgccgtgtgtgtgtgtgtgtgtgcgtgtgtgtgtgtgtgtgtgcgcgcaaagtggcagatggaggcattgcaagcatacttctcccacttggaaggacaaagtagcatgtagagattcacactgtgaactgtttttttcaagaagcaatgcaggaactaaacaggaaaaccaaaggaatccacagatcctttgaaggaaacgataggctacagcctatactgtaattcaagtgaaggattgtgagtccccagagtgtgaaagggggagagactgcctccagactatacacccctatgggggagcctgaaagtccaagccatgggggaagaccttaaccctatagagcacagaaactgacttaaggagagtcctggaatataaaagtaagagaaccagtgggaagaaccttgagggtactctcaatctccagcacagaccaagggaagccattcctaattggtcatcataggagacccttcagaagtcagccaaatatttcaggtagtggtcacaggttgaaagaagcccccacctgggtttcatgatataacctcaggtggggacaaactcctttggccagggatgggtgggggctgggggaagaggggacacaagtgaaaagtggactgcagctgtgagtgcagaagctgggcaccagtctttgcaggtggattgggaagtatgtggcctgaaatctgtggttgctgtctttacagggagaggttttgacctggggcagttgcgagttctgtgtgcaggctgcctagaacgtagctcactgctgccagtggaacactgaaggagatgatctgccttgccaagtgtatgggatccgtgtggggctgactgccacctgctactccccactctctgtgtgagcttgtctgtgcaggagaggcagcaacactcccctctagaacatcaacccagtggcctgagaaccacccctatcccccaaaacccacagaggctgctgcttgccctgcacatggagactcagaaagcaaacccacctgacccagcccctacctggctttgccctgccacccacccttgtagcttaacacaaaggacagaaacttttgggagctctatggccttacccactgcctgaggaaataaagtacccacccagggcaacgcaggcaagcaaaaatcccactgctactaccccagctggtgctctttagcaagtgccacctactggctggatgacaaccaacaaagaccattatagcatctcctagtagaataacactgtgcccaggaaggagaaaacagctgcatgacctcagctatcaccactgcctgtaccacttggactaaccaggaggtcctgagtctgtccacatgaccagttcattactactataaccagcacttgagaaagccaacacactaagattatcaatgagacttgaggagaagtcacatcagtggatcccttgcaacaccaacctggagtgtggcaacttcactgggtggctagatccagaggagcaacaacactcacagtagtctggctcccagggactcccactcctatggaagggggagtacaccacatcatgaaaacaccctgtaggacaaaagaatctacagagcaggccttcagcaccagttctttctgcttgtgggaagtttcagcagaagcacaattgcagtgctgtgttcagcagggaaactttgcagctctaatccaacagtcagacagccctagcacacatgaagggacttggagaagtggatgtctttcctccctggtgcgcaaccacaagcacagttggggcttctatcacaggagcttagtgtgggtgcaactatagacagcctttctggaacatatcagggtgaccgcatacctacaggaggagcatcctccaggttcaggcttgcacgagaaatagagtcacaattgctctctacttgaaacatcaacattcctacagacaaaaagaggtgcctgtctgatatgaatagccagagcactgggacaggagtgtgcctgagaggtagatagctttcctgctgatctggcagtggaactgagttggagttggatccaacccttccccctgataagaccaggtcagcaagaaagctctctgcctctcaggcacaaatgggtttaacagatgtttacagaaaattctacctaacacctgcagaatatacatgctcatcagcatatggaacattctccaagatagaccatatgatagaccacaaaacaaatctcaataaatttttaaaaattgaagtcatatcaagtattttctcagaccacagcagaataaaattaaaaatcaactccaaaagtaacccttagaactatacaaataatctgctcctgaattattttggggttaacaatgaaatcaagatggacatttaaaaattctttgaattaataataatgatgacacaagttatcaaaacctctgggatacagcaaaaagcagtgctaagatgaaagtttatagtgctaaatgcctacctcaaaaagtcaagtctgaaagagcacaaggtgacaactcctaaaagagctcctgaaggaagcactaaacatggaaaggaacaactggtaccagccactgcaaaatcatgccaaaatgtaaagaccatcgagactaggaagaaactgcatcaactaacgagcaaaataaccagctaacatcatcatgacaggatcaaattcacacataacaatattaactttaaatgtaaatggactaaatgctccaattaaaagacacagactggcaaattggataaacagtcaagacccatcagtgtgctgtattcaggaaacccatctcacatgcagagacacacataggctcaaaataaaaggatggaggaagatctaccaagcaaatggaaaacaaataaggcaggggttgcaatcctagtctctgataaaacagactttaaaccaacaaagatcaaaagagacaaagaaggccattacataatggtaaagggatcaattcaacaacaagagctaactatcctaaatatatatgcacccaatagaggagcaacaagattcataaagcaagtcctgagtgacctacaaagagacttagactcccacacattaataatgggagactttaacaccccactgtcaacattagatagatcaacgagacagaaagtcaacaaggacacccaggaattgaactcagctctgcaccaagcggacctaatagacatctacagaactctccaccccaaatcaacagaatatacatttttttcagcaccacaccacacctattccaaaactgaccacatacatggacactcttatagacatgcaaaatgctctggaaagtctcagcaatagaattgaacaagcggaagaaagaaattcagagctctaagacaaggtctttgaattaacccaatccaacacagacaaagaaaaaagaataagaaaatatgaacaaagcttccaagaagtctgggattatgttaaacaaccaaacctaagaataattggtgttcctgaggaagaagagaaatctaaaagtctgggaaacatatttggggaaataatcaaggaaaacttccccagctttgctagagacctagacactgaaatacaggaagcacaaagaacacctgggaagttcaacgcaaaaagatcatcacctaggcacattattgtcaggttatctaaagttaagacaaaggaaatcatcttaagagctttgagacaaaagcaccaggtaacctaaagaagaaaacctatcagattaacagcagatttctcagcagaaatcctacaagctagaagggattggggccctatcttcagcctcctcaaacaaaagaattttgtatccagcaaaactaagcttcatatatgagggaaagatacagtctttttcagacaaacaaatgctgagagaattcaccactaccaagccaccagtataaaaactgctaaaagtagctctaaatcttgaaacaaatactgaaaacacatcaaaacagaacctctttaaagtataaatcgtacaggacctataaaacaaaaatacaagttaaaaaacaaaaacaaaaaatcaaggtacacaggcaacaaatagcacaatgaatggaatgttacctcacatctcaatactaacattgaatgtgaatggcctaaatgatccacttaaaagatacagaattggagaatggaaaagaattcacccaccaactatctgctgcctacaagtgactcacctaacacataaggactcacagaaacttaaggtaaagggatggaaaaagacattttatgcaaatggataccaaaagtaagcaggagtggctcttatatcagacaaaataaaatttaaagcaacagcagttaaaaaggcaaagagggacactatataataataaaaggccttgtacaacaggaaaataccacaatcctaaacatatatgcacctaacactagaggtcccaaatttataaaacaattactaatagatctaagaaatcagacagcaacacaataataatggcggatttcaacactccactgacagcactgaacaggtcatcaggacagaaagtcaacaaaaaaaaacaatggatttaaactatgtctgggaacaaatggacttaacagatatatacagaacattccatccaacaactgcagaacacacattctattcaacagcatgtggaactttctccaagacagaccatatgataggccacaaaacaagcctcaataaatttaagaaaattgaaattatggcaagcactctctcagaccacagtggaataaaactggaaatcaactccaaaaggagtcttcaaaaccatgcaaatatgtggaaattaaataacctgctcctgaatgatcactgggtcaaaaaccaaatcaagatggaaatttaaaaaattcttcaaactgaatgacaatagtgacacaacctatcaaaacctctgggacacagcaaaggtggtactaagaggaaagttcatatccctaaatgcctacatcaaaaagtctgaaagagtgcaaacaatctaaggtcacacctcaaggaactagagaaataagaacaaaccaaacccaaacccagcagaagaaaggaaataaccaagaccagagcagatccaaatgaaattgaaacaaaaaaaaataccaaaagataaatgaaacaaaaagctggttctttgacaagataaataaaattgataaaattatgaagattaaccaagaaaagaaaagacaaaatccaaataagctcaataagaaacaaagtgggagatattacaactgacaccacagaaacacaaaagatcattcacggctactaaacatctttatgcataaaaactagaaaatctagaagagacggataaattcctgaaaaaaaatacaactctcctagcttaaatcaggaagaattagataccctgaacagaccaataacaagcagagagattgaaatggtaatttaaaaattacgaacataaaaagtccaggaccagatggattcacagcagaattctaccagatgttcaaagaattggtaccaatccttttgacactattccacaagatagagaaagagtgatccctccctaattcattctatgaagccagcatcaccctaataccaaaaccaggaaaggacataaccaaaaaagaaaactacagaccaaaatccctgataaacatagatgctaaaatccttaacaaaatactagctaaccgaatccaacaacatatcaaaaagataatccgccatgatcaagtgggtttcgtactagggatgcagggatggtttaacatatgcaagtcaataaacgtgatacgccacgtaaacagaactttttaaaaatcacatgatcatctcaataaatacagaaaaagcattcaacaaaatccagcatcccttatgattaaaactctcagcaaaatcggcatacaagaaacacctcaacataataaaagccatctatgacaaacccacagccaacattatactgaatggggaaaagttgaaagcatttcctctgatacctggaacaagataaggatgcctactctcaccactcctcttcaacctagtactagaagccctagccagagcaatcagacaacagaaagaaacaaagggcatccagagctgcccccttctgcgcggtcacgctgagccagcacctgggcctggaaccaggccacagccccccagctttgcccaccacctccctaccatggacgcccgcaaagtgaacgagcttcgggcctttgtgaaaatgtgtaagcaggatccgagcattctgcacaccgaggaaatgcacttcctgagggagtgggtggagagcatgggaggtaaagtaccacctgctactcagaaagctaaatcagaagaaaataccaaggaagaaaaacctgacagtaagaaggtggaggaagacttaaaggcagacgaaccatcaagtgaggaaagtgatctagaaattgataaagaaggtgtgattgaaccagacactgatgctcctcaagaaatgggagatgggcgcaaggctccggactccacggtgcagactgcacctcgcagtctccccaggtccgcgcagcagccacgcttcagccagaatactgggatcttcagtggcaggaggagtaatcagaagatggagatgaattttaacattattttggaagagattcttattaaaaggtcacagcagaaaaagaagacatcacccttaaactacaaagagagactttttgtacttacaaagcccatgctaacctactatgagggtcgagcagagcaatttttagtgatatcaaaaagtctagttttgaagatggccgaataggaacagctctggtctacagctcccagcgtgagcgacgcagaagaagggtgatttctgcatttccatctgaggtaccgggttcatctcactagggagtgccagacagtgggcgcaggtcagtgggtgtgggcactgtgcgtgagccaaagcagggcaaggcattgcctcacttgggaagtgcaaggggtcagggagttccctttccgagtgaaagaaaggggtgactgacgcacctggaaaatcgggtcactcccacccgaatactgcgcttttcagaccggcttaaaaaacggcgcatcacgagattatatcccgcacctggctcggagtgtcctacgcccacggagtctggctgattgctagcacagcagtctgagatcaaactgcaaggtggcagtgaggctgggggaggggcgcccacaatagcccaggcttgcttaggtaaacaaagcagctgggaagctctaactgggtggagcccaccacagctcaaggaggcctgcctgcctctgtaggctccacctctggaggcagggcgcagacaaacaaaaagaaagcagtaacctctgcagacttaaatgtccctgtctgacagctttgaagagagcagtggttctcccagcacgcagctggagatctgagaacgggcagactgcctcctcaagtgggtctctgacccctgaccccctagcagcctaactgggaggcaccccccagcaggggcacactgacccctcacacggcagggtattccaacagacctgcagctgacggtcctgtctgttagaaggaaaactaactaacggaaaggacatccacaccaaaaacccatctgtacatcaccatcatcaaagaccaaaagtagataaaaccacaaagatggggaaaaaacagaacagaaaaactggaaactctaaaaagcagagtgcctctcctcctctaaaagaacgcagttcctcaccagcaacacaacaaagctggatggagaatgactttgacgagctgagaggagaaggcttcagacgatcaaattactctgagctatgggaggacattcagaccaaaggcaaagaagttgaaaactttgaaaaaaatttagaagaatgtataactagaataaccaatacagagaagtgcttaaaggagctgatggagctgaaaaccaaggctcgaaaactacatgaagaatgcagaagcctcaggagctgatgcgatcaactggaggaaactgtatcagcaacggaagatgaaatgaatgaaatgaagcaagaagggaagtttagagaaaaaaggataaaaagaaatgagcaaagcctccaagaaatatgggactatgtgaaaagaccaaatctacgtctgattggtgtacctgaaagtgatggggagaatggaaccaagatggaaaacactctgcaggatattatccaggagaacttccccaatctagcaaggcaggccaacgttcagattcaggaaatacagagaacgtcacaaagatactcctcaagaagagcaactccaagacacataactgtcagattcaccaaagttgaaatgaaggaaaaaatgttaagggcagccagagagaaaggtcaggttaccctcaaagggaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactctacagacaagcaaatgctgagagattttgtcaccaccaggcctgccctaaaagagctcctgaaggaagtgctaaacatggaaaggaacaaccagtaccagccgctgcaaaatcatgccaaaatgtaaagaccatcgagactaggaagaaactgcatcaactaacgagcaaaataaccggctaacatcatcgtgacaggatcagattcacacataacagtattaactttaaatgtaaatggactaaatgctccaattaaaagacacagactggcaaattggataaacagtcaagacccatcagtgtgctgtattcaggaaacccatctcacatacagagacacacataggctcaaaatgaaaggatggaggaagatctaccaagcaaatggaaaacaaaaaaaggcaggggtcgcaatcctagtctctgataaaacagactttaaaccaacaaagatcaaaagagacaaagaaggccattacataatggtaaagggatcaattcaacaacaagcgctaactatcctaaatatatatgtacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatacttggaattaaagctctcctcagcaaatgtaaaagaacagagattataacaaactatctctcagaccacagtgcaatcaaactagaactcaggattaagaaactcactcaaaaccgctcaactacatggaaactgaacaacctgctcctgaatgactactgagtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaatttacaccctaacatcacaattaagagaactagaaaagcaagagcaaacacattcaaaagctagcagaaggcaagaaataactaaaatcagagcagaactgaaggaaatagagacacaaaaaaaccttcaaaaaattaatgaatccaggagctggttttttgaaaggatcaacaaaattgatagaccgctagcaagactaataaagaaaaaaagagagaagaatcaaatagacacagtaaaaaatgataaaggggatatcaccaccgatcccacagaaatacaaactaccatcagagaatactacaaacacctctacgcaaataaactagaaaatctagcagaaatggataaattcctcgacacgtatgtgtctctcccaagactaaaccaggaagaagttgaatctttgaatagaccaataacaggatctgaaattgtggcaataatcaatagtttaccaaccaaaaagggtccaggaccagatggattcacagccgaattctgccagaggtacaaggaggaactggtaccattccttctgaaactattccaatcaatagaaaaagaaggaatcctccctaactcattttatgaggccagcatcattctgataacaaagccgggcagagaaacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaataaacgcaaatcaataaatgtaatccagcatataaacagagccaaagacaaaaaacacatgattatctcaatagatgcagaaaaagcctttgacaaaattcaacaatgcttcatgctaaaaactctcaataaattaggtattgatgggacctatttcaaagtaataagagctatctatgacaaccccacagccaatatcatactgaatgggcaaaaactggaagcattccctttgaaaactggcacaagacaggggtgtcctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaagtacaaaaatcacaagcattcttatacaccaacaacagacaaacagagagccaaatcatgagtgaactcccattcacaattgcttcaaagagaataaaatacctaggaatccaacttacaagggatgtgaaggaccccttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaaggcctttcttcacagaattggaaaaaactacttaaaagttcatatggaaccgaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaattatctgatctttgacaaacctgacaaaaacaagaaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaactccaaaagcaatggcaacaaaagacaaaattgacaaatgggatctaattaaactaaagagcttctgcacagcaaaagaaaccaccatcagagtgaacaggcaacctacaaaatgggagaaaattttcgcaacctactcatctgacaaagggctaatatccagaatctacaatgaactcaaacagatttacaagaaaaaaacaaacaaccccatcaaaaagtgggcgaaggatatgaacagacacttctcaaaagaagacatttatgcagctaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaatagaaacacttttacactgttggtgtgactgtaaactagttcaaccattgtggaagtcagtgtggtgattcctcagggatctagaactagaaataccatttgacccagccatcccattactgggtatatacccaaaggactataaatcatgctgctataaagacacatgaactcgtatgtttattgcggcattattcacaatagcaaagacttggaaccaacccaaatgcccaacaatgatagactgggttaagaaaatgtggcacatatacagcatggaatactatgcagccataaaaaatgatgagttcatgtcctttgtagggacatggatgaaattggaaagcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtcacatgtaccctaaaacttaaagtataataaaaaaaaaaaaacagaactttaccattgttatgatagcgtaggaatcacaatgaagtattcttatgtgagaaatttgtttatgacaatctgtattacacattatatcatgtatcactattttatttaattaaaatttattttaaaaaaagatagtaatatctaggaccatatagaaaaccaacagatttctttatatggtccttagcacatgaagctagtaaaaatgaaattatttgtaatgggtatatgtagtcactcatttattcttattagctatataatagtacatatatacatacatacatactattctctaataacaatgtagaagacagtctgtatatataatgtatatagcataatgtatattgtatgatatagaaatatatttgagtgtattagaatgattgtaagtacaccaaatatctcactaaatgagaataattgagtcagcctgctttattatagatttgaataatatatcttaaagaaatttcaaatgaattaattagaactacctgaattatgacaaagatcatattgtaagacccagaagttgcacaaatcattgctgctctcatcctgttgtccagaatatagttgctctgccacagctatctgcaagagagtctgtgaaatatgtgaaatgttatatctaactgagcagccatgtgcccaactaagactcaagaggtctgttattaaaatattattaaaagtaagagagggggaccaggtagagtggaccctccatctctgacatatctagtcaatatattagacagatgtcaaatgaataaggcaaataacatttactgcagaaaattagatactgagcatatacagcatctgtcatataaattcataaatgattattaattgaaagtttttttgtccttaatctactgttatttcaagaaagttagagattttgtcctgtaacactgtttatctatatctggaaaatacccaaatttggttgctaagttaccagttgattttacagttgaaacctaattgaattaagtaatctttaataatagaagagaaactgcataagtaaatttaaaggaccctaagttaattccaattaatgattgtgcatagttctaaacaaaccagttaattatacagtacataagaactaaaaattaataaaagaataaatataaatcagcatttttcctgaatacattttatttcctttttctgctcattctcataaacgtagtcatcttttttgacacacctcatattaagatctatgtgtaacaagtatggattcatcagcattttcatgttgaataacaactaaaaaagaaaacataatagaattagaagatcagatatgtagactcccagtgatcagaaagcagagaaatgtccttcctagccttatgttctccagttactcaacaaacatctggccgggcatggtggctcacacctgtagtcccagcactttgggaggctgaggcgggcagatcacttgaggtcaggattctgagacccataggaggctgggactacagatgtgcaccaccacacctggccaatttttgtatttttgtatagatgagtttttactacagctcaccagcactctcaggcacagtgccatcctcatatacttctggagaggagaaggggtcactgttcccacatttaattccttcagctttttcctacacccatttttttcctccacattcctaggagatacaatcatttcaccatgaaagagtttccttattactgtgtctaagatggatgcaaatcagtggtttttaaaattaaaatataatttgaaatgatttgaatatacaatatattgatatttgccatttttgcagtgatatgatcgtggaaaagacatttattaaacaagctcaaaaagtaagttgtaatctcagaaacaagataataataggtgttcagtgtctgtcaaggaattagcattaaatcaatcacatatatgactaaatgcctataattaagggacagggctgatgcaagatattgcctgccccattttctttctgcattgcgtgattgagcttctcaagccagccttttctttattaatgtttactaatagaattccagcactttgccttgaaactataggtcatttgaattcctaataaaaataattcaaatgataataagaaaataacatttcctctccactacagttgcagaaaagcagatttagttttgtgacataaaatttaacatagaaacataattactaacaaataaatcttgtaaaacacttaggcttcaaagataattgctatgccctgtaaaagtaacttctagcaactaaacaatctatcgtaattgattgccttaaaaagttgttttcctagttaatatttgtacaaactcttccctatttgcccaggacctttctagttttagcactgaaagtcccacaacccaggaaaacccttactcctagataagctcaaagggttggttaccctgacaccattatgttctagaaggtacaaatgcatgtaaattttctttgtaaagtcagaacagaattattgctacttagctcttttcccttaagcaggaaggtagtaaaacctacaactgcaatattccttgcttaaacaaagagattaaggatctgtgcctcacttaaattaacaatgcaaacaactgtaaactacaaattttcataataattttaaataagtcaaagtgccctgagtcccataaaatagacatacatttttggtttgttaagtactcaaaataaaaagaaacatgttaaatagttctaacatgtaataaaatagatttataattaatttcaaactgacaacaataattttggtgttctcttaaaacttagagaggctttgagtagaatggtttaatgagctcagcactatttaaaaactgccctgactagaatgaatcttgcagtgctggattagaattagtgatatcagtatgaactcatttttagcttaatataaaaacagatggatagacataataacaattataaatatgtgtacatacatctatatagatacgagggttagtgcctatgtgtgttacctagctctgtcctcagagaaggcctagaagcaaagacaacctagtagcaattagcacacccaatgactgatcttggacataggagccaacatgaaagagtttccaatggccacagctgaaaaaagttaaacaacaaaataagtaacataacatagaattacaactcaaaatataatatatgtataagattccactaaatttgtaataaagaaaaaaataagggcaataaaaacaagaaatgaaaggttataagagacaagaaagtggatattggcaaaaaatatatttcagaatacatttggaagaaggaaaggagttggaaggttctggaaactgattaatcaaaatggagaaaaacatgaacaaaactgcttacagagggacaattttcctcatcaaatcttgtgaatgctcagccagattcaaagtaaggtagagttgaggcacagggctggagcaggggctttggttaaaagttcatatgtgaaacattcgtgttcccccttaccttctacacgctaggtataaaatcctgggagccaggtgtccattctcaagagggcaccttctcaaggaaaattgagaggctcaagagaaaagatgctctctgataccatagattaaatcttcggaggtagtcaatatatggcatctatgaaacaaggatggaatgttgattctttcagctaaaaggggtatcagaagcaaaaaaacaattggaagaggcaaattatcagagaaataatactagagaaattctcagagatagaaaagtcactagactgaaaattcccactgagtctccaaaatactgatttaaaaaaactgagttaaaaagaaagacctgaggcacattattagaaattttataatgtatataatgccagatttgaatacaacaaatgagaaaatataggttacttgacaaagaatgagaatgacctggggtttctcattagtaacactggatgttgctagaggacaggcaagcagaaccttcagaaatatgagagaaaattattttcagcaattaatcttctactctgcaaaattatcagtcaaatgtaagataaaataaatatatatttgtaaatgtacaaatttaaataaattctgcttaggttaatttaagaatttctaaacaacatacttcaagaaaataatagagctaaccataaagagaaaagtaaggaaacttgaaatggttcaatctaacaaaatggctaagggaagtccccatatgcagctgaacaacaaatctagagaacaatcaggccaacagtcaagagcaaaagaaaacaggccttcagggaaaaaaggagaggaggtcaaataagttttcatacaaaatgtagaaaatttagaaaaatgtaaaggtacatggatggaaattggacaaaacaagaaggaacacttagaaacattaggaaaaattttaaactatataataaatgaatgtatttaagaaaatattgatttttgataacttaaagtagatgtatcttgaagtagctatatctatacctactttaagtgacatatatacatatatgtatatatacatttatgtgtgtatatatatctacatatatgtacacatatatgtatatatatgtggaaggctatgggaggggagggaggtgtccctaaacagataaatctttaccagtgaaaacaggaagtcaataagtcatctctctcaatttgaaaaataagaatataatagcataagcatatcattgtaaataagaacataaccactgaaaataaagcaaataaaggagttaaaaattattgcttcttcatggaggtggcaatggatagtggattgctgcctttacatgttctatcactaagtaatgtttttaatatgtatatttttatgttaaatttttatatttaaaagtaaaatattaaagaccttacattttaaaaatcagagaaataataccagagaagtactcaaaataaggggtagaagtgtttagcgcatggcccaattatattattttgaattattaaagattaaagaaaagattcagagatagaaagaaccttgtgttaattccagtttattttcttgcctgtattttctttctttttattttactcaatagatatttttcttgagcatctaacagtgccaggtaccattcaaggaactgggggatattagtagctgaaaatcaaaattattgctccacagagctcattcctagctgggggaacagataatttaacaataaaacatagcggatattaagacatgatcaattcttagggaaaaaagagcagcagttaaacatagtcatttcacagaaaattctgagtgaattaagcatttttaatagtttcctgctttctgtcaacctgctaatatttcctaaatcttagattacagctatttttcaaaggtacttaaaagttgaaagaataagccaataatcaaccacatacccttcacctaaattaatcaattcttaacaatttgctacattggcttcctcttattctcagaaagatagatagcagatagatagaaagacagactattttatagattgatagatgatagaccaatagataaatagatgaccatgttacagtatttaactttttactcagctgcttcaagataaattataagcatcattactttacctctacttcactgtgcatctcctaaaaataagagtattttctcaaaaactacaggccaatgtccccagtaaacactgacacaaaaatcctcaacaaaatactggcaaacagaatttaacagcacatcaaaaaattaatttaccacaatcaagtagactttttacctgggatacaaggttagttcaacatatgcaagccaatcaattagacacaaacaaatggaaaaatattccatgctcatggactagaagaatcaatagcattaaaatggtcatacagcccaaagcaatctacagattcaatgctatttctatcaaactgccaacatcatttttcacagaactaggaaaacttaatataaaatcaaaataaagcatgaatagacaaagcaattcaaagcaaaaagaataaagctggagacaccacattaactgacttcaaactatgctataagtctacagtaaccaaaacagcatggtactggtagaaaagcaggcatatagatcaatgaaacagaataaagaatccagaaataaaaccacatacctacagccatctgaccttcaagaaagtcaacaaaaataatagctattcaacaaatggtgctgggatagctggttagccatatgcagaagaaaaaaaaactagaccccatcctttcaccatatacaaaaattaactcaagatgaattaaagctctaaatgtaagacctcaaactataagaattctagaaaaaaagctttgaaaacaccatctggacattatccttggaaaagaatttatgagtaagtcctcaaaagcaattacaacaaaaacaaaaattgacaagtgggacctaattcaattaaacggtttctgcacagcaaaagaaactaccaacagaataagtagacgacctacagaatgggagaaaatattagcaaactatgcatccaacaaaggtctaatatccagaatctataaggaacttaaactgaatgagaaaaaaaaaaaaaaaaaaacagaaaaaggtctggcgcagtggctcacgcctataatcccagcactttgggaggccaaggcgggcggatcacgaggtcaggagatcgagaccatcctggctaacacggtgaaaccccgtctctactaaaaatacaacaacaaaaaaattagccaggcgtggtggtgggcgcctgtagtcccagctactcaggaggctgaggcaggagaatggcgcgaacccaggaggcggagcttgcagtgagccaagatcgcaccactgcactccagcctgggcgacagagcgagactccatctcaaaaaaaacaaacaggaaaaaaaattaaaaaacaggcaaaagacatgaacaggtgcttctcaaaagaagacatgcaagtgggcaacaaacgtacaaaaagatgttccacatcactaatcatcagagaaatgcaaatcaaaaccacagtgagatactatctcacactagacagaatggctattattaaaaagtcaacaaataacagatgttggtgaggttgcagagaaaaggggatgcctgtacattgctggtgggactgtaaattagttcacccattgtggaaatcagttgggcaatttctcatagaaatcaaagctgaattaccactcaacctagcaatctcattagtgggtctatagccacaggaaaataagtcattctactgtaaagacacatgcacatgtatgttcattatagcactatccgcaatagcaaagacatagaatcaacctaaatgtccatcagtggtaggctggataaagaaaatttggtacatatgccacatggaatactgcacagctataaaaaaagaatgaaatcatgtcttttgcagcaacattagagctggaggccattatcctaagtaaagtaacataggaacagaaaaccaaataccacgtgtcctcacttataagtaggagctaaatattgtgtacatgtgggaggaagggaaccgcagacaccagagtctgccttagggtgaagggagggaggagagtgaggatcgaaaacctacctatcaggtgctatgcttattacctgggtggtgaaataatctgtacacaaaaccaccataacacataatttacctatataacaaatctgcatgtgtacccctgaacctaaaaaaaaaaactgtttttttaaaaaagtttaaaaaaaaacagttgctagcaaggctgtgaagaaaagggaatatttatacactgtcagtggggacgtaaattagttctgccacagaggaaagcagtttggagatttctcaaagaacttagaactgccattttacccagaaatcccgttactaagtatatatccaaaaaaaagtaaatcattctaccaaaaggacatatgcattcacatgttcatcatagcactatgcacaatagcaaataaatggaatcaacccaggtacccatcggtggtggaatgaataaagaaaatgtacatacacaccatggaatactatgaagccataaaaaaagaatgaaattgtgtcctttgcaggaacatgaatgcagctgagggcctttatgttaagcaaatttacacaagaacagaaaactgaaaccacaggttctcacctataagtgggagctaaacataaagatcaacatagtagtcatggacataaatatggcaacaatagaaattgggactattagaatggggaggtggtgagaggggcaaggattgaaaaactattgtgcactatgctcagtaactgagcaatgggatcattcataccccaaacctcaacatcatgcaatatacccaaataataatactacacatgtaccccctgaatctaaaataaaagttgaaaagaaaaagcatcacagctaggcagaggcaaacaagctcaaaagctggtgacctttataatggaatagcacaatactgggtcaatactgcctctgctttttggaagaatgtccatgtactacgaatagaggctctagtgtcagggaaaatagcatattaataatggtcaatttcttggctctttcttgtcacttttagcaaaatctgtgagggagaaataaacttaataattatcaagtctgcaaactgaaattaaagagaacacagctttaaatctgttctctgcctgtgggctgcaatcaaagttgaaagagagaaccattttgaagcctccaaattacaacagcaaccattgttttcatactttggacaaaagcagtaataagaggtgtctgtaaaacgaccagatcgagattatgacttcccactggaaccattatttcaagtgtcctcaagagatcagccttgaagctgaattaaaccattggagagaacaccaaagccaaaacttttttaaaaatgagacttttcaggctttagaattatgtatctatagaaaagccagagtactatcatcgtttttgaaatgcatataaagctactgcagcagcccaagactacaaccttgaaaaatgtccctgcccccttgacttctatcttagagagaaaaaaccagctgctcactagcactcaatagtctaccctaaagcagttatatcagaagtgctgaaagggaggaaatctgttgttggttttctttctccttaggaggtctagctgctgttggctagactaatgacaagttaattcaatcagaagcagtcttctgggttacccttctgaccaacataatgttacctcataacctttaatactttctgagtcaaaatattttaatgctggtctttgatacttgtcaagggaagaaaaaaatgtaaaatacgtctatgtcttttcaaataaattacttaggttagataatcacaaagctagaattcagagatagctcttacatacctcatgaaggaggtgaagcttgagggataggtagaatttaaattaactgaagattatttcaagcagtataaacagcatacacaaaaggctgtgagaagtcctgtggcctgtgcatagaaagctggactggtttcactgaagcttcaggcataaatgaagggacatgttgggtagggacttgagtacaaagtaaaaacattctaactttgtcctataagtaacaagggttcttagagaacaatgggtgatgtttgaaaacactgttttagtaagagttatatagcaatgccccaaactaaaccagggagtcagccaggactcaagaaacagcacaagttcaactaaggagagtgaataagcaaaatgcagtaagttgatgactaaactagcaagcccctttagtgctcaccagcagtcagggatggcaggggtaaaacggagtcaactctgcttgtttggaaaaactcttctatttgtatttctacagaattagactaataccaatttgaagacttaggtcacatatgatggattatccttgccacttgagaactttttaaacctttcctttttcctttccctaattgtttcatggtagatcatgaatgcatcaaggagcaacaagagtcagatctgtgactcatccatcgagattaaaatctgcccaaatacataattaagtgactatgaatgtgttgaaaatgccaaaataaacacagacagaggctcttctaagcttcctaagcaactttgaatttttttcatcaatttgtataatatactctctgcaagctttaatagagacaggacacaaaacattgtctttactcattctcatttatgtccatcagattgcgttaccttgcctggtaatgtactagaatttcctctgaattttagacaaggtgatcgtgaaatgtggtacagtctcaggtggtttagcaaacaaccttccacatcagtgcagttatctcagcctttaaaccatcagctctggattataaatttgatctgccagcttatgaacttgagtcaaagacaaagaacattatgccttgctttgaaaggggattagaagcaaaaatgaactcaagtgttaaaaaaagtactaaaaaataatgaaacaaaaaatatattatcagtacctctctaagcaacaggatatactaacatgaatacaacagcaatgttactatttgctaggatttctctctctctctctctctctctctctctctctctctctcattctctctgtttatctcttacctttcttttctttggtacactatatccttttaaactatgtttgcccaaaggcaaagatagtttttgctggtatttttctacctctgaagagaaaacaagggtgagtgtcatttgaagatggacagtatcttatttgttctgttggaactcctgcacactgcagagacttggtaaaagcttaaaaataaggaggaaacctttcagtggtaccatcaagatcaatgtccaaggttatactaagaacaagaattttaactccacaattcctgcatttgtattctcatagatatagaaaaacccttctgaactcaggcacttaaccaacctggtcctagcttataaagaagatgataattctgattatcatttttcctcctttttcctactcctaaaaaaaaaaagcatagccctcaagcagaaattaactggacattttcttttttagtttaaagatttatttgactaataacgttgtctaaattatgggaccgttttcttagcaggttaccatgctgtgttaacaaggagacaaagacgattgtctggtgcagaaccctaggagctcttcctgggttgccaagtgttattgattgaattgtgtcccctacaaagatatgttaaagtcacagtgtctagcgcctgtgagtgtgatctcattcagaaataagttatttgctcatgtaatcaaattaagatgaggtcattagagtggtccctaatccaatatgactagtgatcctacaagatgagaaaaatgccgtgtgaagacagagatacatagggagaatgtcatgtgacaacagaggcagagattggaatgacacagctgcaaatcaaagaatgtcaaggatttttggccaccctacaagctaggaaaaggcaaggaagcttctgcccaaagtctcggaggaagcatcatatgaaaatgccttgatttgaacttctggccttcagaactgtgagagaatgaatttctgttgttttaagccacccattgtgttgctttgttatagcaccctgggaaactaatacagtcagcaatgagctagttgaaaccaatagctttccctttttccagtcagaggaactgcaccagaacttgacttctcatgggacagatacccccaatagtctctaggttctgggcagctgacaattcccaacatgccttaaacagccatttttctcctattttaccaggcatctcatactctgtccccattaaaacgtagagcaatgggaagtagagatcccctgcagaagcataggccaagcacagaatactagaaaaataagaggagtgtcacaactgctgacttgccactcattagtgccacctgcaccgagtgacacactggaacttgccccatgccctttgcagcacatataatgcactcaataaaatctgacattccatttacatattaaatgacatttggaatatgcatagagctcgtattctagagtcatgatgtctggctttgaaagctgtctcctgcacttactagcaatatgaccttgagcaatgtattaccctttttggccttggtttccttatcataaaatgaagttaataaaagataacaagaatttcctctgggtgtccttggaaaagttaaatggaaaaaaaatccatgtgaagtggtgcacacacttagaatacaagttctatataagttgctttggttggtacttcttttgcctgctgtaagcctaaagtaacagaaaatttatttctcatgactgatgaagcattaccagtctcctagagtgccaggcctctatcttcttacaactatcacactgacaaatttcactggctcatcattttctctttcatgaagtcattcttgggtttcacgtccttaaagacagctatgattcctgtttcgattattactttccctaaatcaataagcaaaacaactacttaaatttttgtacttaagaacagatctgtctgaaggcctccaggccctatcagatgcatacaaatggtgattgatgaatgtcaggtatgaccatcacagtcattctgttgctttcttactgaactgaaaacaactagccaccatatcccaagagagttttaaattgtctttaagttttttcagatgcatagtttgcactcatctagccatcaaaatgtctataatgtagcaaaagctaatgtttgaacaagaaaatattgtgatattaaattcattttgatccctcacttattgggaataaccactctcacagcattgagttatttgcagagaaaagcgttgcacataacagcctaaacctttctttctatctcattattaagatgcaaaacgcccccgtccacacacacacacacacacacacacacacacacacacacacatgcatgcacaaaaatataagggagtttttttttaatacaaatgcaagaattccaacatcaatcatgaaagcctttgggatccatttttaggtcacaacatatagttaaattttagtcaatattttaaaccaagcataacataatatgtcattataaaatccatttcaacaaatcatgctttctttacataattaacttaaagaattaagtggtgactcactagctaaaagaaaacaagtcacaacttgtccttataatgtaaacctatgttacgcatttaatagcgaaagagagtggaggtctcattcaataacctaaataaatacatacatgcataataaacaataaataaagcaaaagaagtccagaagaacagtcctttacttttgtgttcccactcgaggtcccagggagtatttgggaggcatgcctccaaattactcaacttctccattggaagcttctccatagacctggtaggaagagggagctttcagtttagagcctctaagccacttcaaatagccaacttcttctcctcagtaagacaacccatctgtttttgaacttctcattcttttcctctcctttaaatctcaaagtccatttacccccttttgcttaccaactgtaccaggtcaagcctatttatactcttcttagttttcaaagcagttttgcccatctcttttctcatctgcatctccagatatgagagaggtggggtgggatagggtgggaagagctccatttagggtctggcccagactgggttatctatgagataagatgaaccttcaaactattcaagcagaccttctcttgacatatcccatttataattatgcttcaaaacaaaaggaagcctctgtctctttttttagcaccttttaaattgcttttaaaaggcctccttagttacccataatttggtatattttaagctcctgaaattgggtgaggcacgagaaggaggaacccaaccctatgacatgtatattacggttattattaaaaagaaattcataaaataatctttaattatatgctaattttaaaacattttacttgaattacaaaatgacaactttaattactaaacaaattataaaagtatataggtctgtgaaactgtccaagagtcaaaaggcagtcgatctactccattattctagactactaggacttctctgatatgtcctgctcaacaattgattgtatcactttgacactttttaaagaccactgattcttgatgttattgatttttaaattttccctttgaaaactttaaaacaatactaagaaaagaacaaagtaatgaagaaaacagtaatgaaaaaaagctagaaaacactctatgtgtatgtgtgtgtcttattgttattgttgtcgacaatctcatttgttgacagcaagattggctttggagaccaccgttatagactgaattgtgcatgccccccaccccaaaattcatatggtgaagccctaagctccatgtgactatattggagataaggcctttaaggaggtgactaaggttaaatgaggccataaaagtggatccctgttccaataaaactagcatccttataacagaggaagagataccagtgagctcactctctgccatgtgaggacacagtgaaatggcagctatctaaaagctaggaagagaagccctcaccagaaactaaagcctcctggaaccttaatcttggacttcccagcctccagaattgtgagaaaataaatttcttttgttgaagccactcattcaatgatattttgctatggcagcccgagcacattaacacaaccactgaatgtttgacagagtaaaggaagggctgcataatatgaacggtttgagaaaacctgtcctaagacaaaatcaccattttgaaaacacattgcatgtgagtcttcagcaatcttttgattttctttttaacagattaaggaattatttgggcgagcttcaaaaactacaaattcctgggccacagtctcaggaattttgattcagtaagtttagggtgggctctgattctgttttgtctcatttcattgtttcatattccccagatgattctgatgcctagccaggtttagaaaccactgctccagggtatccagaaataatagagggtagtaaatgaaatcccctcctcaagtgttttctcctcctcctcccaaagctgcctgttccctatccaccctttttcttacaagtaaaataaatttaaagtagtcaggctgttgaattgaaatcagtgtgtggaaattttctgttgaagaacaagaaactcccccccaccaccctccagtcaatcaggtgatatgcacgagagcaagacaaaacccttggtaagtcactgcatccattctcaacaggtctgttatagatcttcaggtatttgtattcaaactttctttctggattaatctatttactttttttttaccttcacatttgaaacccatagttttcatgagtaacccaagtctctgaataggcctttccttcataagaaaagaatatgggaaggtcacagcaatcccattactgggtatatacccaaaggattataaatcattctactataaagacacatgtacgtgtatgtttattgcagcactatttacaatagcaaagacttggaaccaacccaaatgcccatcaatgatagactggataaagaaaatgtggccacagaatactatgtagccataaaaaagaataagatcatgtcctttgcagggacatggatgaagctgtaagccatcatcctcagcaaactaacacaggaacagaaaaccaaacactgcacgttctcactcataattgagagttgaacaatgagaacacatggacacaggcaggggaacatcacacactggagcctgtcgggggtgggggcaaggaggggagagcattaggacaaatacctaatccatgcagggcttaaaacctagatgatgggttgacgggtgcagcaaaccaccatggcacatgtatacctatgtaacaaacctgtgcattctgcatgtgtatcctggaacttaaagtataatttttaaaaaatatttttaaaatggaatatgagaaggtcaaaaccaagccttgaatttatgtctctggagcctgggatgtcaagcaatcggctgaagctggggtgtatgtggagcctggagtttggggagaggcagctctgcagcctttgttccctaccagcaatctctcccaatcctgggtggtgtacacacctccctccatatgcaacacagccctgaggcttaaaccatatcccaaggctgggaccatttcagctataacaccagggacccttcttcacaaggtgaggagagaggaaggagtcattaattcaaagagaaaggtaaaatactgcaggattccacaaacagcactgcaattatgatcactgaagttcctagagctaaaattttgagagaagctctcatgggaaactcacttgatccattttccttccagagactcacttgaggaagtacttgttgataatcgttttcaaaagctgaaacagctaaatttaaaaacctctttttttttttttcaatgccaagcctttttggaaagattgtggccaattccctctgtacagacacagaatctatgtggaattctcatactggcccagtcacctgtgaatccaaggatttgttgcaacagaagaaagtttgggccctgtcacacatgcattttttgcacaccaagctcagaaaaagcaagtatatgtctttcatgcttcttcccatttcagtgccctcccctcaatacaggctcatcccttttctctctcccaggatcctaaatatgcccattatatttggtataaatctttgtacaaggttttgcataaatctttaagaagcaagctaatgacaaaagtactaactttggagacagcagaactggattctaatccaggccctatcaatgaccaggcatgtgactctggaccatgcttttctcagtccatatctgttcataaagaagtacactgtacattaaccctcatctgtacataaaaaagctctcatccttcatctgtacataaagaagtacattgtacactaatgtctatggtgtctaatttctctaaaattttctgggatctgatgaataaatttagaaatttcatttagggagggagccaagatggccaaataggaagagctccggtctacagctcccagggtgagcgacacagaagacgggtgatttctgcatttccatctgaggtaccgggttcatctcactagggagtgccagacagtgggtgcagaacagtgggtgcagcgcaccatacacaagccaaagcagggcgaggcattgcctcactcgggaactgcaaggggtcagggagttccctttcctagtcaaagaaaggggtgacacacggcacctggaaaattgggccactcccaccccaatactgcgcttttccaatgggcttaaaaaacggcgcaccacgagattatatcccacacctggctcggagggtcctacgcccatggagtctcgctgattgctagcagagcagtctgagatcaaactgcaaggcggcagccaggctgggggaggggggcccgccattgcccaggcttgcttaggttaacaaagcagccgggaagctccaactgggtggagcccaccacagctcaaggaggcctgcctgcctctgtaggctccacctctgggggcagggcacagacaaacaaaaagacagcagtaacctctgcagacttaaatgtctctgtctaacagctttgaagagagcagtggttctcccagtacgcagctggagatctgagaacgggcagactgcatcctcaagtgggtccctgacccctgaccccggagcagcctaactgggaggcaccccccagtaggggcagactgacacctcacacggccgggtactcctctgagacaaatattccagaggaacgatcagacagcagcattcgtggttcacaaaaatccgctgtcctgcagccactgctgctggtacccaggcaaacagggtctggagtggacctctagcaaactccaacagacctgcagctgagggtcctgtctgttagaaggaaaacaaacaaacagaaaggacatccacaccaagaacccatctgtacatcaccatcatcaaagaccaaaagtagataaaaccacaaagatgaggaaaaaacagaacagaaaaactggaaactctaaaaagcagagcgcctctcctcctccaaagatacgcagctcctctccagcaacggaacaaagctggacggagaatgactttgacgagttgagagaagaaggcttcagaagatcaaactactccaagctacaggaggaaattcaaaccaaaggcaaagaagttgaaaactttgaaaaaaatttagacgaaggtataactagaataaccaatacagagaagtgcctaaaggagctgatggagctgaaagccaaggctcgagagctacgtgaagaatgcagaagactcaggagccgatgagatcaactggaagaaagggtatcagtgatgaaagatgaaatgaatgaaatgaagcaagaagggaagtttagagaaaaaagaataaaaagaaacgaacaaagcctccaagaaatatgggactatgtgaaaagatcaaatctaagtctgattggtgtacatgaaagtgacggggagaccggaaccaagttggaaaacactctgcaggatattatccaggagaacttccccaatctagcaaggtaggccaacgttcagattcaggaaatacagagaacaccacaaagatactcctcaagaagagcaactccaagacacataattgtcagattcaccaaagttgaaatgaaggaaaaaatgttaagggcagccagagagaaaggtcgggttaccctcaaagggaagcacatcagactaacagcagatctcttggcagaaactctacaagccagaagagagtgggggtcaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaaaaaccggtaccagccactgcaaaatcatgtcaaattgtaaagaccatcaaggctaggaagaaactgcatcaactaatgagcaaaataaccagctaacatcataatgacaggatcaaattcacacataacaatattaactttaatgtaagtggactacacactccaattaaaagacacagactggcaaattggataaacagtcaagacccatcaatgtgctgtattcaggaaacccatcttacatgcagagacaaacataggctcaaaataaaaggatggaggaagatctaccaagcaaatggaaaacaaaaaaggcaggggttgcaatcctagtctctgataaaacagactttaaaccaacaaagatcaaaagagacaaagaaggccattacataatggtaaagggatcaattcaccaagaagagctaactatcctgaatatatatgcacccaatacaggagcacccagattcattaagcaagtcctgagtgacctacaaagagacttagactcccacaccataataatgggagactttaacaccccactgtcaacattagacagatcaatgagacagaaagttaacaaggatacccaagaattcaactcagctctgcaccaagcggacctaatagacatctacagaactctccaccccaaatcaacagaatatacatttttttcagcaccataccacacctattccaaaattgaccacatagttcaaagtaaagctctcctcagcaaatgtaaaagatcagaaattataacaaactgtctctcagaccacagtgcaatcaaactagacctcaggattaagaaactcactcaaaaccactcaactacgtggaaactgaacaacctgctcctgaataactactgggtacataacgaaatgaaggcagaaataaagatgttctttgaaaccaacgagaacaaagacacaacataccagaatctctgggacacattcaaagcagtgtgtagagggatatttatagcactaaatgcccacaagagaaagcaggagacatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaacattaatgaatccaggagctggttttttgaaaggatcaacaaaattgacagaccgctagcaagactaataaagaagaaaagagaaaagaagcaaatagacacaataaaaaatgataaaggggatatcaccactgatcccacagaaatacaaactaccatcagagaatactacaaacacctctacacaaataaactaaaaaatctagaagaaatggataaattcctcgacacatacaccctcccaagactaaaccaggaagaagttgaatctctgaatacaccaataacaggctctgaaattgtggcaataatcaatagcttaccaacaaaaaagagtccaggaccagatggattcacagccgaattctaccagaggtacaaggaggaactggtaccattccttctgaaactattctaatcaatagaaaaagagtaaatcctccctaactcattttatgaggccagcatcatcctgatatcaaagccaggcagagacacaaccaaaaaagagaattttagaccaatatccttgatgaacattgatgcaaaaatcctcaataaaatactggcaaaccaaatccggcagcacatcaaaaagcttatccaccatgatcaagtgggcttcatccctgggatgcaaggctggttgaatatacacaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaagactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctcaagctgataagcaacttcagcaaagtctcaggatacaaaatcaatgtacaaaaatcacaagcattcttatacaccaataacagacaaacagagagccaaatcatgagtgaactgccattcacaattgcttcaaaaagaataaaatacctaggaatccaacttacaagggacgggaaggacctcttcaaggagaactacaaaccactgctcaatgaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttcaagttcatatggaaccaaaaaagagcccacattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacgtacctacaactatctgatctttgacaaacctgagaaaaacaagcaatggggaaaggattccctatttaataaatggtgctgggaaaactggctagccatatgtagaaagctgaaactggagcccttccttacaccttataaaaaattaattcaaaatggattaaagacttaaacgttagacctaaaaccataaaaatcctagaagaaaacctaggtattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaattttcgcaacctactcatccgacaaagggctaatatccagaatctacaatgaactccaacaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaactttgtggaagtcagtgtggagattcctcagggatctagacctagaaataccatttgacccagccatcccattactgggtatatacccaaaggactataaatcatgctgctataaagacacatgcacacgtatgtttattgcggcactattcacaatagcaaagacttggaaccaacccaaatgtccaacaatggtagactggattaagaaaacgtggcacatatacaccatggaatactatgcagccataaaaaatgatgagttcatgtcctttgtagggacatggatgaaattggaaatcatcattctcagtaaactatcgcaagaacaaaaaaccaaacaccgcatattcttactcataggtgggaattgaacaatgagaacacatggacacaggagggggaacattacactctggggactgttgtggggtagagggagtggggagggatagctttaggagatatacctaatgctacatgacgagttaatgggtgcagcacaccagcatggcacatgtatacatatgtaactaacctgcacattgtgcacatgtaccctaaaacttaaagtataataataataaaataaaaataaaaataaataaaataaaaataaaaaaataaaataaattaaaaaataaatttcatttacttatgtatgaagagaaaaagaaaataaaaccacttaaaagggcttcaacatgtcatcttctaacttctctaggcctcgatgctggttccagattgcctggtttcaaaccccagtttgccacatactggctgcagatttgggaaagttacttaacctcttcataacagcctaccaatataaaagatgatgacaataatagccttttccccacaaggatgatgcagggactaaatgagccaatacatgaaacatgtttatagcagtgctgcaaatagaaagagttcaataaatgccaggctctattatcatcctattgtcataacgtgagaataacaacctgtcttcacttcttcccatggttcgtgaggatcaactaatataatgaatgtcaaagtgatatgtaaattacaaagtactatttaaagggaaagaattatacaaatgttcacaagcagatgaatgatttttaaaagtatggcatatccataaatggaaaacattttggcaattgaaaaaaaggaactactgatacatggttcatatggatgaatccaaagacatttcactgagtaaaagaagctagacgcaaagactgaatatttatatgaaatgcctagaaaaggcaaatttataaaacagaaaacaggtggggcgcggtggctcacacctataatcccagcactatgggaagccaagacaggcggatcacctgaggtcgggagtctgagaccagcctgaccaacacagagaaaccccatctctactaaaaacacaaaattagccgagcgtggtggtacatgcctgtaatcccagctactcgggaggctgagacgggagaatcgcttgaacccgggaggcagaggttgtggtgagctgagatcgtgccattacactccagcctgggcaacaagagcaaaattctgtctcaaaataaataaacaaacaaacaaataaataaataaaacataccagtggttgcctaggatggttttgggagtagagagtcaccaaaaatgggcatgaggaaactttttagagtgatagagacattctacaactagactgtggtgatggctgcacaattctagaaatgtactaaaatcattgaattgtacatgcataatgagtgaattttatgttatataaattatccctcaataaattattaaaataaataataaataactataaagtaacagtgttatcatcacctgatatgttatttcataaacagtatgtttcttagaaaatgatttggaattgccagattttatgaagatagggaaagtgctttgaaaattctaagtttctatacaaactaacaatattattaataaaaacaaataataaacccattttaaagaactctgtgatttgtctaccccacatgtactcaccctgccaaatactcccaggtcaggaagctgctcctttagtgaccctgagttcttccttcctcccacgtgcagtccactcactcccataacccagctttccctggagctctattagcccatcctggaacacactgcaatgggatggaaaagaacaggccttagtacagacacaggttcaagcctcagctaagccacattctacctgtgtgacatcaggcgaagtatttacacctgcactcctcctttcctctgtctgtaaaatggaaatgataatgtccatctcctaaacttgttttgattgtgatgattaaatataacatatgtaaagtacctagtatttgctcaacatgtttttttctcctgtaggaaaaaaaaactctaccatgttttgttaattcttcaatatttattgtgtaccaaatgtgttggggaagtttaaaagaaacaaaggtttaaataattctccagcagaagccaagtctgacagatagcagatgtttttctggggctttggtaagaaagtgcactgcacatggtcattacagctgctaaatgacaaggcctaaagagccaggccagtgggagcagtgtcttggcaataccgaagtctcctttttcatacaagagggaaaacttccaaggccaagaaaaagagtggagcatctttttccctcatacaggtcagctagaaaaagccacaagggattaaagatcaaaggaacatttttctttctctgagttgtgaatagctttgggtgagtaataaattgaaaagatttaagggcaaacaaggcccaaaaagaaaaattaaaaatatgttaaagaacaacaaaactcagagagatgaataaaagaatatcctggggataatcatgctgatatgcagcttgaggagctagaccacaaaatgcacataagggccaattcctagggacccccccccccgccaaaaaaagttatctctagctccagctgctgaccagatactatgctgggtggcctgcagcatcctcaaatttaagaggttcaaaatttaactctagtacttcttctatctagttgtctaaatcaggaattatacttaacctttttcatgatctctgctaccattactttaatgcagctctccattacttcatgaataaaagaatgaacaaaagaatagctaaagaataatacttgaaagcccattttttggcaggtggttaattttattttttaatcaacaaataatacttgtacatatttatggggtacataatgatgttttgatacaaacaatgcatagtggtcatatcagggtaattagtatatccatcatctcaaatatttatcatttatttgtggttggaaatattcagtatcctctttctagctatttaaaacgatataatatattattgttacctctactcaaaggccaattttttaaaaaatgattttaaaatatggttggaaaattctcattcaataagtatttattgagcacctcctgtataccaagcacactgccaaacagtaaagtgtataatatagtgcagcctattgtagcatatgaatggagggaaaagttagaggtgacaatgaataggtattttagggctgaaagtaatcagagaagagaaatctccagaataagaatcaagaaaagggaagtgatgtggctagcagaagagaaacagcattttctactttgccatcctagagagacaagggaaacaaatacaagctacactggagctttggaggaagaacttgagactagtataaaataacaaagtattctcgtgtgttttgccttgagattatgatgaatatgattaaaattctataattctggatgctaaaggagaaagaattactgatccaaatgtccttaaataccaagcctagtgcttaaaagttcttccttatcaaaatattggagaatatatacccaaatgtttctctattgttgtcctgaattatttacatttaactatttcaccctttggattttgttgtaatttacatatgatgtgaggattttgaattgttttcttttttgttaatttcttttttttattattgaagttctggggtacatgtgtacaacgtgcaggtttgttacataggtatacatgtgccatggtggtttgctgcacccatcaacccgtcatctacgttaggtatttctcctaatgctatccctcccctagccctccatcccccaacaaaccccagtgtgtgatgttcccctccctgtgtccatgtgttctcattgttcaactcccactcatgagtgagaacatgcagtgtttggtcttctcttcctgtgttagtttgctgagaatgatggtttccagcttcatccatgtccctgcaaaggacatgaactcatcctttttatggctgcatagtattccatggtgtatatgtgccacattttctttatccagtctatcattgatgagcatttgggttggttccaagtctttgctattgtgaacagtgccacacaatttattattcttttcactgctttgtgttaccttactatcctgggttaagtttgtctatattcaagacctctctttgtgctatcttttctatgctttttagatgtctttttatggtaattttttttttttgagatggagtcccgctctgtcgcccaggctggggtgcagtggtgcgatctcggctcaccacaacctctgccttccgggttcaagtgattctcatgcctcagcctcccaagtggctgagactataggtacacaccaccatgcctggctcatttttgtatttttttttcttttaatagagatggggtttcaccatgttggccaggctgctctcaaactcctgacctcaagtgatctgcctgcctcagcctcccaaagtgctgggattgcaggcgtgagccaccaagtccagccagtattcccttttaaaaattactttattcttataatagattatactacttcacctaagataattatcctccagttaattcctttttcaaagttttctttacatttctactacatttataatgtcagataaacattagaaccttctgtccaattctctccactaaaaaaaaaggaagaagaatgcttcagtcttcttatccaggcacttacctccatttactcgtttgctttttactcattattagtattggctgggtctgctgaatttttgacattagaggttctaggtataagcagcaatacctaaattaaactcaaagaaagaaaagtcaggaaaggcaattgaaacataatggtacaagagatagaaataccagcagaggtgcattctacaaaggtagagagagtttaagaaagacttgtggtaagcaatgctaaaactgatgaaggggacaataactgaaaatcaacctctgaatttgggagttattatacaaagtcactgatgattttcccaagaaaaatttggtagcatgactaagtcagaagctatattcagtttattgaggaacgagtgagaggtaaggaagaagaaatgctgaccaagaattctttttcttttcatgacattaaatggtaatggtaaatagaggcaaagataatatagatgagagagagattcaaggaaaagcggggagtagagaggggtacagggaatatttaggctagaaaagctctatatgcaggctggaagaaaagagccagaaaccagaggcacagacattaaaaataatctgagaaatgaatctacttcttacacagtaaataaaaaggaaaagatcatagtaatagctaacacccattacttactgtgtgccagccactgtgccatgaactttaatgcactgtctcatgtgagaaaccctcgtacaagacttatcatccccattctagagatgttgcaaactgagacaaatgtacaataagttggcctaaggtcactctgctgtaagtagtggagctggtatctgaaccctgaagtttcactctagagtcagaatgcttgatgaacagcctacatattgtcaagcagaacggtgaaagcagggcgctgccctaacatcgacgaatcacctcccaaatcaccaaatgccacctatgaacacataacaaggactgacagctttgactaggactcaagagtggcagaaacaaaggagttctccattacaagaatgcctatgcatgaatagatgtgtcactttcaaaagcagccacccctgtccttcacaccagttaccaaaccttgatctacacactgcttgttttttgtgtcttcatggtttccacttgtaagttatttatttaataatacaggaacttgggtacaaaaaaacagaaagagtgaataagacctactatttgatagaacaacagggttactatagtcaataatacttaattgtacattttaaaataaagagtataatttaattgtttgtaattcaaaggataaatgcttgaggggatggataccccattctccatgatttgcttatttcacatggcatgcttgtagtactcatgtactccaaaaatatatatacctcctatatacccacaaaaataaaaaattcataaaactgaaaaataaaaaagaacacaggggcaaagggacataattgtttagcccacatggtcataacacagggcttctggcctgtccatttgagaaaagggttaggctggtgagtccccagatgcacatgcatggcacatagtgatagctccctggagcaaagagaagcatgcactggagggcaggaagacagaaaaattagccctacaccaagagggcctactcagactctacacatctttccaaagccccaattcctccgtagaggcttctctgctccttcagctctttcatgtagtcattcatgtaaatgccttctcctaccttgggtttttagttcctttagagaagggaccaagtcctatatctctttcaaacttccaggttggaggtgttcaagaaatagttatcgaaaatgtatcaactatttctactcatgagtaagtgagctgcttctcatgattacttttgatgaaaaaaaatgtgttgatcatgaaccactgtcaagaccactagagcttgaggttttattctaccaagtctgccttaattatttcctcctgggaacaaatattagcacatgccaacaaggagtacgagccagttttcggccagagagtagagctttttctcagtgcaaggccaccttgccaactgttccctgaacagtttagatctagatgatgtattctaaccaattaagctatattctagttgattaagctaataaacctaaattcattattttgctccctgtatcgtgaggtcggtgaacacagcgaatagtatcaacaaataaaacattttatagtgaaaatgccttcattcaaaagcattgctggagattgttgtcaatttaataatttattcacaaaatattgtgactcccaggcccatctttacagaagccctccctggaatccttcctagtggaggaaacctgctttttattcagttgacatctggcttagccatatgatttgggttagccaatggaatgtaagcataagtgatttatcttataattcagctgaagctttaagaaccattgtgatgttcccccgttactcttccctctaccataaaaatggcctggcttcatcagtctggatccccaaatggagctgcagacaatccacagctaatacttttattagcaagccactaacttctaccatagcaagccactgagatttgggggttatgcttggttactatagcataacttcctgaaagctgacaaatgttgaaacctacctataaacatttcattctctccctctagcctctgtcacaccacagacataaaatgcaatttgaagctcagtctttgaaatcaacagtaaaatgagagaaccatgtcacagggttgttgaaattgtttagtggaatcatgtatggagagcacctaggatggtgtgagctcagaaatgtgagctccctcgccaccataatgccttcccttcatgtttcattcccacttccgtggtggaggtaggaaatgacagacaatgtcaaccagaatcttgattcttctctgtaatcgtgtgatgaacaagttataaacagctcctgcctcacaaaacttgtagtcttacttctagcagaaaaatgtaccatgtgcatgcttgcttcctcatctattaatgtgaagttccagcatccaagtgaaaaattaacaaatgtaattaggattgtcttggagatagagggaatccattgttcatgatttttccctctcccaaccactatcaaccaccccaccatctatacacatcaccactgtcagtaccacttccagaaattactccctggtcctaaaacctggattagattgccctcctctgtgctcccataacatcctgtacttaccccttctccaaactgttactctggaatggatttactagtttgggaattagtcttcccactgagagaataaactgttccttcattattttagtcctagaagttgccccatgcctcaaacgtggtagatatttaccaacattttttgaattaatgaatgagtggatttgataagttaatttcttcatagtgacttttgagttcccgctgcaagttgatgacttttttatgccagatgcccagggctccaggcaatccttatagtttttctaactgacaaggaattctctattatgaaatggggatgtgatttacatatacctgcaatcttaaagcactcatagaggccactggaaactcaaatgggtaatacaaattgaattagcagctcttgattaagagagcattgattttattaaaactggtagaatatatgccagaagttaattaatagcttgaaaataatcagacacttcataaagctgaacatctgccaaaaagcgggtattctgaggtatgttcaggaaagtttccaagtgtataatatttgtttccatagttccttatgttgtaataaccaaaaaataggtaaatcaattttaaataaagcaatttaacaaactcatatttcctttatattttggaggaactccaaacttgcaagagtagaacaatgtccttacttactctcttgggatatctaaaatatcttcagtcctataagattcttttttaaaatgaggaatgattcttgttctgcttatttttacataacacctttatcatcaaacaaacttcaagatgtgtcatctttagtaggaaaacatatttccacctcatcctcctgttagacttcagtctacttaagcctattctcagtttaatgggattaacagaagcaaatcacaatttaagactatagtttaccaaccttcctttctcttgttcagtgaaattcccctgataatccatcagtcaacccctgctggccttgagaggcgctctagaaggcaggagaagggcacacaggctcgctttttgaactgaagaagggtttcatttggtttagaattgtcaaacttcaaaaaataaataaataacttaaagtgtttttcaaatcagccataaggctacaaaccagaaagaaaagtgtgaggcaggtgtttggggcagctacccaagttgcctacatggtttccaaggtcctttcaactctaaggtttgtgtatcaggctgtctacagatcatactgtctccataagattgtctagttcattttatggctagtttgaacaatctgattttcttttttacaatggcaggggctcaatccatgttaggcttcaatgttgagtcacccaagttctccacagagaataaccaaccagccgtaaggaagcttcttttagcaatgccaggattctgcaaagtccctcccagcttaacttttctgaccttgcggcagcagaacaacaaaaagaacagcccctggcaccctcagaagagcacaaagccctctgacaacctgagatggcgcccaggtagacttccctcaaaaaaaaaaaaaatggcaaggctgcttcagcaggtctttcagccccaaccactccactctccgtctccttttcttcactgctttccccacctctcttccccccttccactttgacccaccccaattttcgtccacttctccctcaccccttccttgtaatctctctccttgaggcatcctgtggatgttgactgtaatctcccctggaggagggctaagaaatgcacctccagagggtctgtttgccattggaaccgcgtagagaaagcgtgcaaacccgtcaactgctcccgccgttcctctccctcctcaacccaggctcgctacagaagaagggagtagggtctgcccccttgttgtatctattttccccttctccgccagggctgtggccggcaaggggctcaggaggtgagtcccttgcccacacctccaaccccgctggcccggtttataacatggacagccctgccctctagtgtctgcaaccgggagccctaaggcgccatcagctccagaatttctcttttataacctaagcaagacctggagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaagcgcagcgcctgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtgaggggcgcacaccttccgggacgaccttggcttcccttcttacccccacccactccaggtactccagctctggcttggggatgtttgccagctttgaggcgcaaaggcggcgggagttgggatgcggggtgtcggagggagactgagggtcgcccgggcaccgtgcctgcaccctggattatagtacagagagcatttcttgttcaaacaattcctcaaatgtgtgaacctgagaatcaacattgtgtataactgtggtttgagcatttcatcctgcttccttgcaaaaggattagaggcagcttaaagattaaataggtatggaacgggtgctggggggggccagggaaaacttgagtagaaatcacagggaggtggtgtgctccagggaccccggaagaactgtgtgatttcaaagccagctgattaaaaaacctttgattagaaaggactgcactgttgctccagccctcagaaaataatactgtgctcagtcctgataaacaaaatgcccaggtgtggaggtaatgaggcaggctcattttttttaaaatacaaaataaatcttggaagtaagagttaagatgagaagtttggtcttaagccatctccacccaatactgcaaggtgagaggctgaccccctacctaacgaaaaggaaaggaaattgagtctaaagggaagtgattccagctcctatcacaggatcatagtggttttgcatctatatgtatatttctgcctgtgcccagttttggaagaaaggaccttgtattcaacccaacgctgcttgtccttgagttagaaggataaggcagatggtgtcagcatcccaaggtgtttcttcctaacctttcttattgtccttccttgcctcctgcaccaaatctcttggggagggagcagcccaggaggaaataatagatcgtcaaatgggttgggggagcagtgttttttccaaaataatttaggctcattttatcattcttatgttttccctcaaagctctaagcagtacatcgtcctaagctgaatttaacattgctccagaatatatatttatcatagttgtacattcagacacaatatgcataaccttaaacagccaggatgcacttgtgaatcaggggcttcccttacttaatcctgcgcaagagaggcaaagcaggcacgtgggtctgattccctgtgcggtctccttcatgaggagcatatgtgaaatacctttgaaatacagagaagattgagacagcttttctctttctggtacagttgctttcctgctgaattaaatgagatgaccctgtcttcaacaaataaatgaatggaggcatttgaggcccatttaacaaatgcacaaaatatgcctgcctctgtttttcctcccttcagagctttagcctccagcccacggagttgtgatgatgaagcccacctcctaagtgggactcagctcagtttctgtatcatatttaaaacagagtatgttgcttatttctaaaattgcatagcacctcaccactaactattttgctgcatagaggtatttcatcactaagagagctatatagagaaactcactcaaatcctgattcatcattgttgatagaacttaactattgtgtcatcatcacctgacatgggctgcagaagctccaaggattgctatagatctcaattgagacttctagtaacagagctagaaaggagccttttaaagtgtagccatgactctggtcattaggtatatgcatgttcaaatattcccttacgtgcttgttttcgctttcataacaatttccagggatgaaaacttagcagattatttttataatgaagagtattcaaattaacaatgtgtatccaccagctaacaagttttaaattccacagaaatcagcatcacaagcatagtaaaatcaagttttcattctttcctcttctgccataatgacttcattcaaggcctagtcccagaccaagtgcatggaaacgatggctcatgtctctcaacatttgcccaagggaatggtgcctaccttgcaactcagcgtgatgtcacctttattagccattctggtgtctatacaaaatatttgctccccatttcttcttatcgatgcctggtcagcaacaatcatgtaaataagtttccattcttttgaggaagataacgaagtcagcgtttttcagaagtggtgcctaggaagagacaaaatccaggacacacctctagttcaggtaacactgcaatatatttcaatttcctgctgcgtgatggggttattattgaagagggaagtaaggtatatcattcacagcacattgtccccacctggctcaagcaccacccattccccaggtgggctcaatatgctacccccaccaccaccaagataccaaggctgcaaatgaaaagtagatctcagccaggcatgatgggtcacacctgtaattccaacactttaggaggccaaggcaggaggatcacatgagcccatgagttcgagaccagcctgagcaaaataatgagaactcatctctacaaaaaaatttaaaatgagccaagtatagtggtgtgtacctgtagtcccagctacttgggaggttgaagtgagaggatcgcttgagcccagaaagccaaagttgcagtgagccaagtttgtgccacggcactacagcctaggtgacagagcaaggccttgtctcaaaaaaagaaaagaaaagaaagaaaaagaaagtaggtctctttgcagaaagcctcaggccctgaacttttgtgtcatcttctcattactcaagtctaattccctacatctcacttttacacacagatcatttttttcatgtttgttttgattgcccaccctggaattctatttctgcactaccctttaaaagtgaaagatcaaatctaacgctctaatgtgggaaagcattccctctatttctacaagcttatttacacaaaaaaataagcttgagactgatcaaaagctgaatttctaccaaataggaacttactttttatgccgtaaattatcaaggccatctcaaggcagaggtgagtttagcatctcatgctttatgctcctttcttctgcacctaccagatttttattacatgtgaaattatatgaacataaaccccagggaaacattgaagatgagtgtgccgtcacaagtgacgaggggacagatgaacagggaagagaaatggggcagcagcactttagagtgacttacttctctcttgttttctcctccctgaatcattttctagaaccagtattgtggcccctaaaatttggggcttaggtcagtcaacttaccaaagttcatcttcctggtgatgaaaggactttcatcaaaatcccagctactttttattcgttcccacattttgtggattaagaaactgagaaccagaatttatagagatcactcaatcaattggcatattcccggatcacaacaaattgataaaattcttgagaaccctctttctaatacagattgactataattttgtctttcatttttagttctcttattttgtctcatgcactgtggattatctggtttactgcagtccttacctgaatagatgtcagtgttttgatcccattgttgtattcccctaaaacacgtcaaatgaaaaactggacactttaataggtttattgttagcactctctcatgctgatcaattctcaacacatgcagttgtaggattaggaagacaaaatcctttagaagaagctatgaaacctaatccttctgcatctggatcattttaaactacaagttgtaagaggaatgagcatctctggattctagttatcagtgcagaccagatggaaggtctttatgaaatctggtatgagaaggaaagcattttatagcaagaagaaaatattttgagaaatagctaccagcagcagcagctagcagttctaaaactctcagatcctcctaatgaccccattagggagggaggaagggagcaaggaaggaaggaatgaaggaaggaaagaagaaaggaaggaaggaaggaaggaagggaaggagggaaggagggaagtgttataaatattggtcagggaaaagttttattattaatgacagattaaataattagctactaggaaaattcaaggggatacataaaaatgccattagaaagaataagagaacccagtaaggtggctagctacaatagcttgcctggttagcgacaatataatcatagggatttatattacgcttgtacactgttgggcagaaaacatgcctgagaggtataaaagatgctgttagcatccaagaaaaatgggaaaggaaagcccacctcatctgaggaagatggaggaagaagaacctacagaaaaggattccacattccaaactcatccctctgaattcagtaatatttatccttatatgatttctgacagtgtagtttgtcattgtaattaattctttcctgtaagtaaacaagaattgtatacttacttaagtaccttacattttaaactttattacatagtcctaattttaatgttgaactctgccctagtcaaggaagtatttgttacctaacacaagaatttgatatacagtcatccataaacactatcctaccatatagttcatcataatttaacattcaaagaaagaagcatgatttcctcttttattatgctttcatttgagccattttaactttcttaccattctttccttctgaacctaattcaattccttacacaatgctctaaaaaatcaaggattaaatatgtaacttaatttataattagcaaatacatcatttacaagatgcattcatattggcaagcatattttatttcatagattgtaaactggtaaaacaatgtaatctcctcaccctctctgcaatacagtaagcctgtttctaagaccatcaaggttttactttatgtccgaggcattggagaaccagactgtactgaccccagggtttggtgacttacatataaatgaagcatcttaccaagaagggatgaaaaatgactttagaggaagcaaaagtctcaaagctcacaagacttgattactttcagcttggtgacagaggcaatgctcttgtgatgcagatggagtaatttctccagcacaaaagatgtccagccgggtcccattggctttgagataatctctcacattgcattaagtgtactgagtaccctttctcagacttatgtaccattagcatgcatttaattaacagttaatgattacatagtattgttactattaccacatagtcctgttatattaaaatacatgaaatttgtagctatgttttgcctgtttagtaaaatgagtctgaatctaagggtgagagggtctacacacagccaagaggatggggtattaacccaggcctgtgtgaagatatttgcatctcatggaatgctctccagagaacaaactgacctaccctgtgcatgtcagctaagctcccgccagcttcctcagggcttgctgaatgtacagtgagtgccacagtgccagcgtggcagtgaagcacaggcccaactctacggacctggggtcagaaggcctgggttaataccccattctcttggctgtatgagctgcatggtctgtcatcgttacaatggggacaataatacatgccctgtctacctcagcctcctttcagggaagtttctcaaaacagaatatgctattgtgattcattgtcacctgtgatgtcaaactgcaccttgtgttatactactagggggtaacacagcatggggctcaagcccaagctctcgagtccagaaagccaggttcatatcccagctctgccattcattaactgctttcacatctctaaacctcagtttcctcatttgttggggctcacataacagtactatgtcatagggctatttatgaggattaaatgtgtgtattcattattgctaaataataaattaccccaaaacctaatggcttaaagcaacagatttttattatctctatgatcatagttccatgggttgggaatctgggtatggcttagctaggtcctctggctcaggtctgtcactcacaggctgcaaagtttcagccgagactgcagacatctcaaggctcaactggggaaaggtaacgcttccaagctcgctcacgtggctgttgacaagcctcaggtcccagctggctgctggctggagacgttcttttgctaccacatggacctctctatagggctactaacaaaacagagtgcttcatgcagatgttgcagcttgctgtccttggagcaagggctaagattgaaagatagcaaaatagaagccaaggtctttttgtaacctgatatcagaagtgatatcccatggcttctgctgtgttcctcattagagacaagtcactagtttcagcctaattcaaggggaagggattacacagtgggaggaatacctacaggaaccaaatcattgagagccacctgagatactgcctgccacaatataagacatcagaagctgtttgataaagactcaattcagtatcacctcgtggttttatctcatagtaatgttctcagactgaaattagataatctgtcaaagaatttgtaaaatataaagctctatacaatatcaagattttattagttttattaatgctgagaatccagttccactttatagatagtgatataagaacagcaaatcaatgattaagagatgtgaattttacaccttgctgtgtgtgtgaccttggaaaagccatttatttgtttcataccttagttctctcatgaaagtgatgataataacagacttaccaggataaaatagataatagacagccatgcagcacattgacaatattttggtcacccacaaaccacatatatgacagtggtcccacaaattataatggagctgaaaaattcctacagcctagtgacatcatcgctattgcaatgttgttgtagcacaatgtatcgctcatgtgcttgtgatgaggctggtgtaagcaaacctgtgctgccagttgtataaaagtatagcacatacaattatgtatagtatataatacttgataataaacaactgttactggtttatacatttactgtactatactttttatcattattttggggtgtgttcctacttaattaaaaaaaaaaagtgaaaagaagtttaactgtaaaacagcctcaggcaggtccttcagaaggtatcccagaaaacagcattgttattacaggagatgacagctccatgcatgttattgccccgaaggaccttccaacggacaggatgtgtaaatagatacagtgatactgataatcctgagcctgtgtaggctaaggctaatgtgtctgtatcttagttttgtttgtttgtttgtttgtttgtttgagacagagtctcagtcgcccaggctggagtgcagcagcacaatctcacctcattgcaacctccgcctcccaggttcaagcaattctcccacctcagcttcctagtagctgggattacaggcactcaccaccatgcccagctaattttttgaatttttagtagagacgggatttcaccatattggccatgctggtcttgaacccccgacctcaaatgattcgcccgcctcagcctcccaaagtgctgggattacaggcgtgagtatcttagtttttaacaaaaaagtgtgaaaaggaaagaaaaaatttaaagttttaaaaatagaaaaaagtttataaaataatgttataaataatgagaatatttttgtatagctatacaatgtgttttaagctaagtgctattacaaaaagagtcaaaaaggtttttttaatttaaaagtttgggggttttttgttttgtttttgtttttgtttttgtttttttgagatgacgtttctttcttgcctcccagactggagtgcagtggcgtggtgatcccagttcactgcaacgtccgcctccccagtttcaagcaattctcctgcctcagcctcccaagtaactgggattacaggcatgtgccaccatgcccagctaaattttgtatttttagtagagatggggattcactatgttggccaggctggtctcaatctcctgacctcaggtggtttacctgcctcggcctcccaaagtgctggtattacaggcatgagccaccacacccggcctaattaaaaagtttataaagtaaaaaagttatagtaagataaggttaacttattattggagagagaaaaaatggtttttacaaattaggtatagcttaagtgtacagtgtttttaaagtctacagtagtgtacagtaatgtactaggccttcatattcgctcaacactgactcactgactcacccagagcagcttctaatcctgcaaactccattcatgataagttccctacacaagtatcccattttttatctttataccatattttcactgtaccctttctacgtttagatacacaaatactattgtgttacatttgcctacagtattcaatacagtaacatgctgtctggctttgtagcctagaagcaataggctatgccacatagcctaggtgtgcagtaggctacaccatctaggtttgtggaagtacacatcttgatgttcacacaatgatgaaatggcctaacaatgcatttctcagaatgtatgatgcatggctatatataaaattatgctgaaatctaaaaaaatgagatgatggtcataatgacaatgatgaagatgactatatgtttcagcttctactccatggtcctttgaggacaactgaagtaactagatatgatttttgtcagttgtgttttaagtgtatgtatcaaatccagctaccccaagttttacaataactttatatggtttaatcttatcttgctgaacacattagatatgctgccctgaaaagtggcttgcaaacagaatttttagaaactgaaccataattaaaatgcacagaggccgggcacggtggctcacacctgtaatcccagtactttgggaagccaagacaggcggatcacctgaggtcaggagtttgagaccagcctgaccaacatgaagaaaccctgtctctactaaaaatacaaaattagccatgcgtggtggcacatggctgtaatcccagctactcaggaagctgaggcaggagaatcgcttgaacccaggaggcggaggttgtggtgagccgagatcgcgccattgcactccagcctgggcaacaagagcgaaactctgtctcaaaaaaaaaatgcacagagaaggtttccatgtatctagtggaattgtacaatgcttatgtgatcttgtgatatcattaatattttgtaatataaataattatcctcattattttaattttctggcattgtagcaacacctgtataaatatttatagttacttaagaactcacaaaacaaccttttgaagtaggcaaataaaaccaactcttggttatctcaaagagttctttttgtttgattcttgtgttatctacatttcttctctcactgtaaattggcataaatttggcagatacaaaacaagtaaagttcaaactcctccactcaaccactttaagggattttttttcctgcttataagtatatcacatgttcattgtagaaaatttggaaatgcagaaaagtataaaaaatgtagttaaagttactcttattgccaccaccaagaggcagccactattgatactttgatgaatttctgccttagtgctttccctctctatagggagaaaagagtggtttctttttcaatgaaatcaggagtatgttatatacttttcttgtgttctgctttctctaattaacattattttttaaatgatatttccatttattgattcaacaacataaattagtaaatattgactatatccaaagtggaatttggatgaactgtaagaaatatagttaataattgaattcagattttttaaatcaattccaacaattgtgaagtagtttcttttcctttttttaaaaaattttactttaagtttggtgatacatacgcagaatgtgcaggtttgttacataggtgtacatgtgccacggtggttcactgcacctatcaacctgtcatctaggttttaagccctgcatgcgttaggtatttgtcctaatgctcaccctccctttaccctccaccccgcgacaggccccagtgtgtgatgttcccctccttgtgttcatgtgttctcattgttcaactcccacttatgagtgagaacacgtggtgtttggttttctgttcctgtgttagtttgccgagaatgatggcttccagcttcatccatgtccctgcaaaggacatgaactcattcttttttatggctgcaaacattatctatttaataagtttcacatgtaattattatttgaaaacatcatttctaataagtatataatattgttgtatggatatactatatcttatttaaccagtcattactattggacttttaggtggttgtcagtttttatactgtaaaattatagcatgaaaagaaaatttttacataagtctttgtcattcattattctagttatcttagtaaaagtagcaaaggagtccttgaagtcactagggggaaatgaggtttggtaatccaagtataaatatatacaccacagtcttctcttccctcttccctaccacttcctctcacctcccactggcagaaatttgcaggcttttaatgctggaaattgctgaagtaacaatctaattggggtggccatctgtcgtttttggcccatatcgttcaggtcacactgaatgcacccttggctccaagagtgacatgggacccaggcccatccaaacatcttgttctccagggcactgtgattggttcagggataggccgtgatccaagcagaccaattggaatcaatgaggctcagttgagaggtgttcaggtgccatcacctacattggatttggagatttaaggatacatgccaggaactgcagggacccaacataaggggagtgcctcctgaggataaaactttacatggaggaaggaagagcccagagatggagaaagattcttgggtatattatttaagtttctggatccacctgtgcctgatctacacttgacactgaagtttcatgagcaagtaaagtctccttctcacttatgccaatttaagaagatttctgtcatttgtcttttaaaaggtctttaataatccagagatttttaccctctcaattgatgaaaatgagttgtagttaagacagattctggaactgaatcctagttccatcactgacagtgtaacgagggaaggttatatgacctttccccagtcagcttccctacctataaaatgaaaataatgctaatacttatcacctcagagaggtttttgcagggttaagtaagttaatatgtgaaaaagtgcttaaaacagtatctggtatattttaattactacgtaagtgtgtccctgctgctgctgctgctgttgttattttgaaggcagaaagaaaatgcaggagagtaaatgacctatttcactcatgcagagatttagcagccaagctaaaattcaaatttaggtcttctcttttctctgcttgttgttctttctcaagagctaagcctatcgtcatctttatgatatatttgagtattaagctttcagaagtttccatccacataattgaacatttctatcaaaagttttgaggtagaccaggaggccagaaaatagatttaagttactagcaataaccagatgctactgtaggattataggttatcacaacttgtaactaaaaattatgatttttattataataagtttaattacatttatttaattttaattaaaattaaaatacattttattattataatttctactttaacaagtaactatacctttcactgtgttttatttagcacctttcacagtgttgttgtcttttttaatataccttcctattaaaccagttgctctttgcagaatgcttgaatcatttggctcttggttagtaggctcccgttacctaaccaagcactgagtgaacgtatttactggggaggcagctggtctctcccaaatgtaaatcagatttcatcatgtctggcttggagagaacgtggcatatggcaaatgaagacacagctgcatagtgaaattttccatcacaagttagtctaatacctgaatgcagagtgaataaaacattttctaaacaagaatattatgttcaaattcataatcattgttaaatattaagagtcaggttatttcccttgaattatacaaaatttcactattcttgaaaaagtacatgttatcttatatttaatgtcatactattcacatccaggctgcctttcaacttctattatttaaaaatattttcagatatctacattgcctgttattaaaatgcaaactgttctttgagtagagaacctttgtgtaaggccttacaaagttctgatagagatgaagtgcacggaaggaatgacagtgtggtgggaaggtccatggccttaggggaatgggtgggagcctaagctttggagcagttaggttggaattcagacaaagccctgccacttctaggctgcaaaggtattgaacaaggtacttaactaccctctgcctcagtttccttatctgtgataagaataatatcatgtaatgataatacaaacatcataggattgtcagaatcaaaatgagaaaatgtatgcaatattcttagcatagtacctgccacataataagcactcaaaaataataagacctgcttcatcactggctctaaagttgtgtccaattggtttcataaccctaagaaggctatcaaatcttcctgggcctcagttttgtcattagatgagtaaattggaccaaattctataaaaagtgcctttgggggttaaaatgctatgacaatgcccatacacattggggtaaaccaaaaatctataacaggggcaaacttgggaagattttttcaaatctgtttttctacactgaaattgagctgcatcccttctccaaaggtgatcatcttctctaataataaagcaaggtttgtctatttttaactttttattgatccagtgctcagatttttcagcaccatttggggaggagtgttcaatgcctcattgcagaaccttccttgtcatgatgattttgataatattattgacattctttcagattccatagtgagtctttgtcatgatcaaagggctcatgatgctgataacacaaacaagagtaaccagttcaagaattaatttggttaatgaggatcactaatacggataatttcttcctaactgttttggcgggatgcattatttggttgagtgtattatcttgtctacactgatcaagctagcttgaaactcttcttatcagcctttaactacgtactttaccaacacagcctttgaaatatttgttttcttttcatgaagagcttttaaattttttgcctagattccaaagtaagaaatcaatttaaatggcataactttcaaactagacttctgaaagactttatgcatcatcagtaaatctaaattgatatttttctttaaaagatgcaacttttctatttcctatgtaaataactgtgactctattgatttataaactccaagaacaattaccactagggaaaaagacaggataaaggagcatttgttgtcaagcagatataatattttgaactgatgataatgtttcccttacaaaacatgcttgtattaactgatatttatactcatttttgaaaactgaattacagatttatgaaggatatattcgaaacttaattcactaaaagaaaaaaatatatatgtctattgaaatatcccctaagaagcagaaaaatatttttgttctagtagtataaatgaataatgcaaataagaatgtcacctgaattttaagtaacacacagtatatttggaccccagattgacaattggcaacagtaccagaaaataaactagaagctagatgcagccaggccttggcaaatatatttttatactgttgttaagaaactcataataactgcttcctcactgatgtgaactttccttagttgacactctcttgattacaagtacacgatgcctactttaaattatccttaatcatgaagggaatttgttagaagatgccaggatatttggtgaaactcaagagctagagttagctactaggaaattatcaggaatctagaaccttatttttctcttcccttttttctctccaagactggctttgaatatttctacacacatgtggctaaatgtgggtgtcccatagctccttagtttcaatttcgagattcaaacaactcacagagaaaaccaacaagcatctctcactcacagttcaaattcctagaaaaaaagggagtttggcccagctatagttagctgtctatccctagcccatcaacaatggtgcaaacataggtgctgggaatctagtcttagcaggaggggaacagtatgcagaaaaagggggatctgtgttgtacagacaccccaaaaaagttgtcttttcttccttttggcttacacatacacacacacagacacacacacacacacacacacacccctaccattcttcccatttattaaaaggtctccctgccatatatgacttaaccatcttacactgaactacactctcattcacccccttcctaaaggggataatccaatcaatcatatctagcaactgaatcctaaaatgtcatcaatgggcccctcttctcaaagtgaatgatccccagaatagtccatcttttctgtagattaggcttcattttgttcagaaaaatagctttctctttttattctgcaacataatgattgaatggtaaaattagaaagttatcagtaaaaccacaaacattcccactcaaaaaatgattacaagaagcaaaaatcttcacagcaacatcatacattggttaccagaccagagaatatattgcatcctgcaagacaaggattgcaagaaaggtgaagagtaggataaataggttttatgggcttccattattgttgggatgggttccttcctaaatcaagtacttcactacaatataatgcaaataaagtgaacctctctgcatgctgccttgactgactcagccaaccagtttcatattctttacatagctttgttaactgtagctctctctattgatgcaatttctctcttagtcgagatccttttggttgtgagtaaaaacatacacagatacaaaaccacagactttaagttagcttaaggaaaaaatatgttgggaggagtttactggaagggttccaggatacattaattcataacaaatgaccccaaaacttaatggcataaaatggcactctttatttaagtcagttttggagattatctgggtagttttctctttatttaagtcaattttggagattgtctgggtagttttctctgctgagatttttcctgcctctgcatgagctggcaggtcagttacaagccagatgatctactgtgttctcacatttctaagggtcggcaggctgtcagctagtgcaaaggaatcagtggttagaagggactaggccatgtggctctcaacatccgggatgctacactaggcatcttcacagggttcctaaaagtacagtgaagaaagcagcaaagtccttgagactcaaactcaaaactcacatgattccatttctgtcacattctattagtcaaaataattcataaggtcagcccagactcaaggaacagaaaacagattgtattagtctgttctcacattgctataaagaactacctgagactgggtaatatataaagaaaagatgcttgattgactcacagttccatagtctgtacagaaagattggctggggagtcctcaggaaacttgcaattatagcagaagcaaaggggaaacaggcacatcttacatggctggagaaaaagcaagaaagtgaagggggaggtgctgcacacttaaacaaccagatctcgtgagaactcactcactaccatgagaacagcagagggaaatccacccccatgattcaattacctccaacaaagcccctcctccaacattgggaattacaattcaatatgagatttgggtggggacacaaatacaaaccatatcatagattcacctcttgatggcaggagctgtagtagggacatttttgcagtctacaacaagggatattatgaagaagtcaaagataatttgtatagccagacaccacaaggggctagaactgtgaactgtaaagctggcagagcctgagatatttccatttttattcaggctgtctgtctgcctctcatcatatggcctcttactctgcttctctcactaagacatcttactttattcaattactttattcaacttactttattcaaggtatgtatataagaccctagaggcctgccccacaaatccccagtgtgcatgtcttcagttcaagtgatctgctcagacagctgaatagtatctcttagcaccaatttcaattcccaaaacagaggatttgattgtcccagatttggggcagtgattcatcccaattcatccactatttctggatggggagccacagaatagatacgtggttactgtgaggcccctctgcagaagagagcggtgtgggacccttctcagaggatgagagactcaggagatgctttctatcacagaatgtaatggcaaagcccgtatgccctgaaaaattcaactctccaaatgaagtcagtattctgttaccaagtcagtgccaggaaaatgcaagaaaaattgaaaacaagcttgtcattttcttctatttttttctgagtctgaagtgcccgtagatactcttaattcttctagaaagcttgaaagcaatatttaatggaagtcaaatttggtctgcagcagatttctttctcatttgattttctccttcttatcttggaaacaacctctaatgagagaaatattccagagcaccatctcaagatgtatctgggaaaagaacccattgtaccccagagcaaatcgaccctctgctccctgacaatatgcttggttttcaacagcttccctgatcccagttcttatgactttaccacacttttctacacttcccagaggttcagcaaggcttccgtctccctgccggtcttgtcagggcaatctcttcactggcaccatggcttattttctacagaaccattgaaagcagacatggttcccatgcagattatcttcccatttgcacttaccaatcatgtgaactcaggcaggtccacctccctgtcagcttgtctcctgcaaaatttagacttcatgtattttctgtcactgctattctgtatgtttgttatcagatcaaatgagacgcctgcatgcggtagcaccttaaaaacgttagaatgctctgtacatgtagagaaatggaacttctctcacagatacttgatagtgagataaagtggcacgggtcatttcatgtccagtgtcatcatacagatgtaaaatcccaccttggaaatgtaggtgaccacatgtagaattttacctctgcctgctcatgagaccctgtgcaaaggactcagctaagtcatgctcaggcttctgatccacagaagctgtgagataataaatttatgttgtttaaagctgctaaatttgtggtaatttgttacacagcaatagacaactaatacagtgttcaatctcaaatgtaaaataacattttacataacagaatgctatgtgtaggcttgagtgagtgagagagagtgtgtgtgtgtgtatgtatgtgtgttccaaaggaaacgtattttaaaatgaaatacattttaacatatggttttcaaaaagctgagaaactgatgataaatttacacttgttgctgcaacatctcaatattgtaaaccaaaaataaaattctaagacccccccaaccaattgactgaaaccccctctcagtcaagggcattccaaagtaaacctgaaaaactagttcaggccatgatgggaatgggggattagacacacctcattatacccttctctctttggaattggggcacaatggaccagcattaacactacaacagagatctcaagactgaccaaagagattctttgtggcaataaggtatatcacaaaatcatagatagcaggccctaaaagaaatagaaagtattttaccctgaaatatatttctttgatgtattttaaaatggccctgcaaagctgtctcttgtgggagaaatctacattctataaagaatcctcttccctttccaggtctttttctgatcccagaaagactaactaaaagtctggaacctttaaaagtctgataagaaatatttaccatctaatctctctgaagcctgctacttggaggattcatctgcataataagaaccctggtctccacaaccccttatcttcattcagacattcctttctatattgattccagttctttagataataacttaacactttcaaccaattgccaatcagaaaatctttaaatccacctataactggaagctgccctgccaccatcactgctttgagttgttctgcctttctggaccaaaccaatgtacaccttatatgtatcaattgatgtctgcttgtaacttctgaccccctaaaatgtataagaccaagctgtaacccaaccatctgcgtacatgttctccgaccctcctgaagctgtgtcattggcatgcccttattcttgacaaaataaacttctaaattgattgagaaaaaaaatttaaaaaaataaaaacctgattttcttggtcagagctgggctactacttgcttgccatatgatcttgcacacattatttatggagttttttatgtttcactttctgttttttaaataagaacaactccactaacttcagagtcttatgagaataaaatgataaaaggtatgtgaatatgcttagcatactatttggccatgctagaagactataaggttaggttttgtttatttgtttgtttgctcctttcttggtgttcactgggttcaatggctaagttctattacatgttaaccttgtcgtttagtatagaaaacaatgtgagatttagcatgattattgaaacagcaaatcttcagaaatccaacaaacctatggcactcaaacagcttagtaaaacctacccaacaaaatttaagaagtcttggaagcagatggtttggggcatctaggctccagcccaggggcatttttgctggcatttgtgagacttttcaaaaacaataagcagtcaacattgttcaaggctcattttttccctgccttctgaggtgactacttgagcaacatctttcagataattctaatctaagaagaattttttattttaaccttttaaaaaggcaataaaataagacatctattttttctccaaatagctttgtacgataacctctatttattaggacatttgaaagtttcttaccatatattctagccaaggccatcttttttttatgaaacattgttagaattaaatcccagaatttcagatgagctttcccttacactgtcatatttcaccttacctcttaacttttaagggactgtccatgaatacctgagccccaacatctcagtcacttggcactggagaaaaatcatagtgccacccacctatcttctgaatcaatgtatctgaatgtttaatattttccatttgttttacaatttcttacaaaataaattattttcccattgaggaaaagaaagatttttatgcatttgcatgaaaaggtttcaaagatattgttaaatggaaaaaaagggcacagtaaagtaaaaaatagcttgcatatcgagatctcatgtgcatggaaatgcatgggcaaaagcctacaggagcacagtggtggatgctggtaacctatggaaggtgagtggagtgtgagcagagagggggcctgtcacctttagtcatatatacttccataatagtaaaattttttaaactcaggctatatccccacactatttaatttttaaaattgtttttaactgggcgtgggcaggaggcatgcattccttgaccaatagaggcatttttttttttttttttttgagacagagtctcgctctgtcgcccaggctggagtgcaatggtgcgatctcggctcactgccagctccgcctcctgggttgacaccattctcctgcctcagcctcccaagtaactgggactacaggtgcccgccaccatgcccagctaattttttgtatttttagtagagacgaggtttcactgtgttagccaggatggtctcgatatcctgacctcgtgatctgcccaccttggcctcaatagaggcatttttaatttacgagcccatgggagaagcccatgtgcctatactcaaatgccagctcctcacaatgaccccaaacattctgtctaaagtgccctctcatcttccagtctgttcctgtttctgttttttccctcatgatacttgctacgatccaaaattaataagtatctgttggcctctgttttctcccagctagaatacaggcattatgagggcaggagtctcatcaatcttgttcagttttcatctccagtgtctagaggagaatcgagcattgagtagatgctcaacaaatatttgaataaatataagaatgaatgagacaaatgcccttgtgccattattgtctgctataaaactctgaaggagcaggggctgcaagcaaaaatggcagtgggcccaagttttacatctgcttccaaagtactatttcttatttgttagagaagacatttgtttcaagagatctaagagaaaatttgcctggtggaagatcctagcagccccagactctgaacaggaagtgtctaccaaccagatattggcccagctcccacacagcataagacaatgtattaatcagggctctccagagaaacagaaccaattgcacgtgtgtgtgtgtgtgtgtgtgtgtgtgtgtgtgtgtgtgtgtgtgtacagaaagagagagattgatgttaagaaattggctcacacagttgtggagcctggcaagttcaaaatctgcagggtaggcaggtaggctggagacccagggcagagctgatattgcaactcaagtctgaagacggtctagaggcagaattccctcttccttggggaaactcagtcttttttctcttgaggccttcaactgattggatgaggcctaccacattgtggaggataatctgctttacctgaagtccactttgaatttaagtgttaatctcatcttaaaaaaagaaaaaaagaagaagaaaaaacactcagctgagcactgtgactcacacctgtaactgcagcactctgggaggccaaggcaggtggatcacctgagctcagagttcgagaccagcctgggcaacatgatgaaaccctgtctctacaaaaaaaaatgcaaacgttagccaggcgccatggcacctgtatgtaatccccagctattcaggaggcagaggcatgagaaatgcttgaacccagatggtcaaggctacagtgagtggagatcctgccactgcactccagcgactagtgttttgactaatctgggtaccattgcctagccaggttgaaacacaaaattcatcatcatgggcaggatgacggaacctcagctggagccttagctgtgtaggtaacacagagagtatcctgtggtgaaaaaattagaaacagacattgtgtgagaaagaaggggcaagttttgtgtaacatcctgacaaattttgaatctctgttaatcctcttttatgcaagtatcagaagatcacttcatgttcagccataggagccctttcctcatagccccatatcagccaagcgcatatagataaagctgcaggcaaagataaggcgtctctgaatccccagctgtgtctgtagggacactcttccttagtgccactatattcctcatactagtaaggaagtcagccaattctactcaatgtacaagtaagtacattgaaatgcagactatctaaataagcaaactgaagaggcacactgggaaagttatccagataattcaggataaaattcagcaggtgtcttggtctgttttgtgctgctttaacagaatagtgaagactggatgatttataaagaatagaaatgtatgtcccacagttctagaagctgggtaaccaagatcaaggtgccagcatgtagtgactagtgagggccttcttgctgcaccatcccaaggcaaaaagtggaaggacagaagggggatgaatgctgtgtcctcacttggcggaagtgcagaaaagagcaaacccactcccataaccctttttatactgacattaatccattcataaaggcagacccctcctgacctaaacacctctccaaggccctaccacccaacactgttgcattggggattaaatttccaacatatgaattttggggacacattcaaaccaggcaagtttgaaaagcttatatttggggtttacattattccacctggtgaacttcaccagttagactccatttatgacacagctcaggtgaatgttctgttatcccggttgttcaatcaagatccattgagctgtagtgggtgggggaagtgaatcaggagcaaacacttcaggaaagtgaggttaaatgaaagaaaggctgagctaggcacggagaacctgaattctagattttaacacctctcttgatcatttgggacaagtcacgtaaccctaagcctcagtttcctctctgattctcctttagccctatagtttcatgggatgtctaatctcagacactctgctggccatgtggcctcagatccctctcctaatgcctaatatgtgttagcacccttgtgctttcaaatatctgctactactgctagttttatttctaccacttaaagaatggaaaacccatatttaaaaaaaattgatttcccccacaatagtgtgtctgaatacagattctgaattgctttacacatatactgtatgtttatctaattataagtagaaaataatattgtgccagtgataaaaatgaagctaggaactatcaagagagcctggtcctatttccaaataccattatatgctttagtattttggtttcaaatcagcttccaatatttggggagtcagtttttcttttttgatattttttctgctcaactgtttcagaaaatctcttgttgctatggaagtcaaatgggatttttcatctgttttaaaatcatctcctcatgcctttacaattaaaagtcatagctaattataatgcttacctactgaatgtggatcccatattaaacaaaagaaaatatatgttcataatgtcaggttcgtaagaaaaagaatttttttaatttaattattttaccagactttaagtctttcccattcttacacatcccatttgaatgacactaaaatgtataaaatcaattatatgagtttaatttgcccaagcttggtataaaattttattattcccttcctgagtatccggctattctaattaattttctcctccttatcagcggatttaatgattcacttccatgcccctcttttgccaagtgcgtcagcgtgtattgttagccagaggtgtctccatggctgttaagaagctctgactcggtgaagaaacagaagcagtgtgctgagcaggagaagagggatgaggtcatgcctttgagcaccgactataacctttatgttgctcttggtttttgtaatgcacacatatgcacatgcaaatatacatgtgcacacaaaaatgcatgcctagctatatgaattctcatgtcagaaatgagtggcgagtgaagatcagaacagatttcacatttttaacctagtctaaattcagctcctttgcagaacttcatctgagtaatcccttttaaatctgagccctccagttactccagattttcttagcacttagttagttacgtgcatgcctctgctgtcatagcaaagtcacaggctgacatccacagcagggaagataagtaacaaatgcatgaacttgtggcacaagatcaagcactgggtgtacagctcatgactggcattgaggaacatggtaaaaaaggaagggaaataaagcaagtaagatttttgtttgaacattaaggagaattttttggttaggtacagtggaacagtttataaaatgtggtagtatgatccccaatcctggagcacataaagaagaaaataaaaaaacattttcctggagttgcttgggtcagaaatgtcagagatgcagtgcaaatcatcttatcagctatttgagaatggtcagatgtagacatgaagagattaacataattattcattctataaatacagtcatacaccacataataatgttttggtcaacaacagaccacatatacaatggtggtcccataagatggagctggaaaattcctattacctagtgccatcctaacatcatggcacaatgcattactcatgtgtttgtggtgatttggtgtaaacctactgggctgccagtcatatgaaagcatatcacaggctgggtgctgtggctcacacctgtagtcccaacactttgggaggctgaggtgggcagatcacttgaggccaggagtctgagaccaacctgcccaacatggtgaaatcctgtccctactaaaaatacaaaagttagccgggtgtagtggtgcatgcctatagtcccagcttctcaggaggctgaggtgggagaatcacttgaacctggaaggcagagattgcagtgaaccaagattgtgccactgcactccagcctgggtgacagagcgagaccctgtctccaaaaataagataaaaaataaaataaaaataaaagcataccacatacaattatgtatagtacataatacgtgatctctgttactggtttatgtatttactacactatacttttattgttattttagtgtgctccttctactcattaaaaaaatgttaactgacaaacagcgttaggcaggtccttcgagaggtattccagaagaaggcattactattataggagatgacagcaccatgcatgttactgccccaaagaccttcctgtgggacaagatgtggaggtagaagacagtgatattgatcattctgaccttgtgtagtccaaggctaatgtgtatatttttgtcttaatttttaacagaaaaatttaaaaaataaacaaaaaaatttacataggaaaaagcttataaaataaggatataaaaaaagaaaatatttttgtacagctgtacaatgtacaccactgcacctggctaacttttgtatttttagtagggacaggatttcaccatgttggtgtttttttatcaagaagttaaaaaaatttaaatacttataaagtaaaaatgttacaatgagctaagtttaatttataattgaagaaaagaaaatattgtttataaatttaatgtagccttagtgtacagtgtttagaaagtctacagtagtgtacagtaatgttctaggccttcatactcatccaccactcactcgctgactcacccagagtaactttcagtcccacaagctccattcatggtaaatgccctatacagatgtaccatttttttatcttgcatactgtatttttactgtacttttttatgtttaaatacacaaatatcattgtgttacaattgcctacattatttggtacagtaacatgctatacaggtttgtagcgtaggagcaataggctatatcacatggtctaggtatgtagtaggctataccatctagatctgtaagtacactgtgatgttcacacagggacaaaattgcctaacgacacatttcttagaatatgtccctgatgttaagcaatgcaggactatacttattaagcacctattatatgcccaactctctgttaggccctggagacacaataaacagactctattttcaaagcccccatggtcttaggggtaggacaaacagacaagcaaaaattactctacagttcaggacatcattctagaaaaccctagaagagaagttgcactgggtgctatggagaagaagagaggcaccttccctggagcaacggtatgctagggaagtcttcctgacaatatccagtcttctagtttgaaaaacaaaatcatcatgtgaccgtgaagaaagctcatatagccatttgcatgactgaaaaaatatgcgttggaatcgtatctgggggcatggggcagattgcattactaacacataagacaaatcaggaatatttacaattatccttaaaaatcctacatattgctcataaagtactaagtgcatgaatatgtgcatagttttatgttgtggctatatttagtaagtaatatatatgcctaaatatgccatccatgcaataaatgtaagaatcacactctgtggcaagatgctctcagtgtgagacacaaggaaaatgtgatagcaggtgatatactcatttagtgatatagcagaactgtctgcagtacttaaattctttctctctttctctgcctttatattttctttcaagcatgggtggttacatttgtctaagttaaacctctctttataacagtaaagttgtaaactttgtctaagctgtaaacttctccttacaacagaaataagttacagtttgaacaaagtttttgaaaattttttaaatcatcttaaaataatgatccacagtactgaagaactcaatgaaagagtaattacaaattgctaatgtttattaattcttaaggttccttatattttaatgccttgcaataatgaattatttaaatcataggaattataacttgcacataaaattatagtcaataattttaaattaataaatgaaacaacatagtactagtaaaagaaagaaaaaggaacatatttagagatatattcttcaaatttattgaacttcattcacccacagattttgttgttcgagctgttgcttcagaaccaaatctgctcaatgaatatcaccttctgcctcatttccctcatctttataggtcaaattccctatcactgcctccactccatgccatatgtgggcttccagaccaaatctgacttgagggactcagcatcccggggctttccacctccttcactgaagccacctgaggggctcctccgtccatcctgggcatgctcactgctcctctgacagagcaagccattgacttgaagcagttctcagagtctcaccgtctctgcaggagtgttcctacctgataatgaggctctcactcctggcatggaatctatcccactcccccgactttctatgagttccagttcagaggttctcaatgattctcaactgagaacactagaacttcttagtacagtggttctcaaatttggtttcacgttttattcatctgggaagttctgtatttttttttaataccggtgcctagccatcacccacataaattctgatttaatcgttctggaataggtttgagtcatcaagagtttgtagaaatttcccaggtggttctaatgtgcagtcagggctgaagaccactatctttgcaggcttcttgcaggcctcaccttcccagtcaatgccaagagccaaaccagtccatccaggggtctacatacacacacacagacacacaccaaacttgctataagtaaatagctcaaggaatgatagcaaatatatggtcttccttattctaagtgaagtaactcaggaatgtaaaaccaaacactgtacgtcctcactcataagtggaagctaagctataaggatgcaaaggcataagaatgatacaatggactctggggactcgggggaaagggtaggagggggctgagggataaaagaatgcaaattggttatagtgtatacttctcaggtgatggatgcatcaaaatgtcagaaatcactactaaagaacttattcatataaccaaacaccacctgttccccaaaaacctatggaaataaaaaagaaataggaattctctaacacccacaaaaaaaaatagatggtcttcccctatatctaagttgttctagttgatccagtctttcttggagggtggtataaaatgaaaggatgggtggtttcaaatttttcagactccgaaaaaaaaatgaatacaggatctgggtgggaaataatattactaagaagagggaagaaggaaaacagctgaaaataaagtcaggttaagtgattgagtccaaggtaaaatgttataacataagaagaaagagaaaagtaagaaggaaataattgagatattttaggaaagttaatgttatttaaatgaacagacttacaaataaggaaactctccatccagttattagcatcatccaatgactgaggcactgtggataatgcaaagtatacaggtcctgagccaaagtggacagatggaatctcatctctacctctttccagctctggaatcttgggcaattgtgggagactttccaagattcccacagcaagatcttttctcacacattatcttcttacaatatgagattgaatctcctcctgttttgaggtaggatctgtccttcccatcccttgagtctaggaggtaagtacaggggtgtgtaagacggtgtgggagctgagaaggaacttgctgacatgtgtttgttggggactgattcagaaaagaggtgatgctcagtctgagtatggaatgctgagatggagtttgccaggcagagaaaaggtatttcaagtaaggataaccaacatatctgaaggcttgaagatacaaatgtgcgttttcattacaccagggcttctgaaactcagctgcatggacatattcttaaaagatttaaagaatttttattattttaaagggttaatattttattcaagtttattgaacagatataattcttcataaccagagacaatacaaggcacataaaatgcacatattttctagagaaacacagagcttctgaattgaaggggacctcgggatcttttatctcagcccccatgtacccatgtgccatggctgagtgatatagtataataagcagaaagactgtgaaaccagacacatagctaaagagcaagtgcaattaaaggttaaaattagattattattccttttgatgcccttcccccatggcatatcacaaaacataaaagcaaaggcaagggaaaaaaacagcaactgggaagactataccctctagccaacctatcacaattataatgtggtatttgaaagaagaaaagacatttcaaaagggcaccattattaatgccaccaagaagggattggaaagttgcagtttaaatcattgattttgtgccagttctcttgtttatataaatatcaattctcactgtgaattattgcacctttatttagttaggaatacatttttaaaatgccttgctaaaaggtgtgattcaatggagagaaagtattatcaagtagtgcaatgatccataaatagctattattattattatttaacattcgttaaacacccacagtgagctaagcactgtaccaaactttgggaggatgtgtttcttactctgacgaggacagattaaatatgcgaaagagaggaaagcttaggatcagggaaatttatttttctactccaacatttccatgtcaaatttccacttgtcaaattaacaaaattcaagatattataatagtattaataatagttatttcttgtgttcagtgttttttacattacgaagtgttttataaacctatctcattatataacttggcatatagtctctggaagatgtgagaataagagaggtaattttatttcaagagaagcatcagctgatttgttggagcatgaaagggcagtcatactgaaggagaggggagagtttttttggataggtagtatatgcaaaaaagaattgttcctctcacctggctttcagctatcagtttccctccctgaaagcagtcactgtaatcatgtttttgcatatcaatcgagataataaatgagtttactaacatacagtttacacatgtggtatcacactatgttcactgttctgcaccctattttctcttacattttggagattatttcatgctacattattatttttaatggttgcatcctattccatatataagtgtaccacaatttatttaactggtctgttattaaagcatatttatagaaattttgtcacaatttttgtttctgaaaaattctgctattacaaacaataattaaataagtagctttgtagaaacacctctgcaagtatatatgtaagataatttcctataagtggaattgctgagccaaagtgtatgtgccttggtaatttggtagttgctgctaaattccctctggaaaatgtatactggctgcaattcctagcagcaatgtatgagtgcctgtttccccacactgtcaccaacacaatgtgttatcaaaatttgagatatttcataatctgatgagtgaatagcagaatctcatggtagtttcatttgcattccttctaagtataagattgcttaagcattagttcatagtttaacaaaaacattagtggttccttttctgtgaactctatttatattttcagttcttttataggtgggtgttcttttttgaattggtttttggcaactcctttaatattgatgaaattagtccttaatacataatctgaattgcaaatatttttcctagtgtggcattcgttttcattaatggtatttttacgttacagagttatctagttttaataacttagtgtattaatcaatcttttgtggcctctaagttttgtttcatgttcataaacatctctattaacacaagattattttttaaaaagaaacttcctagttttcacttatgattttttatgtaaattgttaatacctttggtatttattttattatgaggtagggatctaactttatttttttaatagatgactattaagtggtcccaactctattcatgaataattcaactttcttccatgagtttgaaatacttctgtcatatactaaattcccttgtaggggaagtgctttgtaaatgccatcattattcagtttagaaacgcagacattcccctaggttaattcactagagttgatggttgataataacctactgaatccaagcagatgtgtggggcaagaaacacagaaacagcaatatgcaggaagcaggaggggtgcctagttggaattaagagagcaaataggaacagaggaaaaataagattaaaatgtcagagaaaaagtagggacaactccaaaacaaatactttcatgatataaaaggtaatgagaggacacctactccaactgccctcctgataaagttcaagctgcatcacatgaactccaggacttttctggtctggtctctacctacctctctagcccagcgtagatttctcactaattatctttcaggtttcagcttgaacattattttccgccatgtacttccaagacttggcaaagaatgaatcaagtgttccttttttggtccctgcagcattctgtgcattgtattgtctggtctctttcacctctgttgtggacatttttcttcactcccagcttttagtcatctctgtcagttaccaagtttctctctggatgacttcttctcttacactaagcccacgtgcttctgatggcactgacttgaccccatccctgaggtcccacacgtgacctaggcaaagctgcttgatacgagtcactctccacaccccagccacaccccagtgagtggttcagggattggcatgtgcccaaggagagctaatgtgacacagtggaacttggcctggggagcctgaatgaaaactcaaaccagaagtcatcttacaacaacgggggtctacagagtggaccaaaaatgaagtagaaccaagaaatggagggacagggaaagccatctgaagccctggatcaaactggaaaccaatatcatccctggattatttcattactaataaattccttggttttcttcacattgttttaagctcaattttctgtcacttctagaaaacgactgcaacttcttaacagctcctgaaggttgtttcttaagggaagaaactgtgtcttaatgctattgtattcccagggctccattcctggagcacagcaacattcaataaatatacagggaagaaaaaggaataaataatacgacaaagttcttttaaatcctaaagtaacaactgcttccaggtatggatattctacttatggaagatcactgagttgactgatggcagaatctggattcaaatctaggctgacccgggcccaaatccttggtttgctcacctgtaaaatggcaacgctttgtggtttgatattaaaatggtgatgataccctcttttattgccggaaccaaggagtgtgccaaagagaagaaggttcctgctttgccaaaaaccctcaagaaaaagcaaagaagttttgcagagctgaagatcaagcacctgagaaagaagtttgcccaaaaggtgcttgtaaaggcaaggagaaagcttatctgtgaaaaactgaagcactttcacaagaaatatacacagatggacagaatggagattcgaatggccagaatggcaagaaaagctggcaacctctatatacctgcagaatccaaactggcatttgtcatcaggatcagaagttccaatggtgtgcacacaaaggtgttctgaaaggtattattgcagcttcttcacctttgtcggatcttcagtggaacctttgtgaagctcaacaagccttcagttaacatactgaggcttgtagagccacatattgcatcagggtacccaaacctgaagtcagtaaatgagctaatctacaacagtggttatggcaaagtcaataaattaatcgccttgacagataacactttgctcaatctcttggcaaatatggcatcatctgcttggaggatctgattcatgagatctatactgttggaaaacacttcaaagaagcaaataacttcctgtggccctccaaattatcctctccatgaggaggaatgaagaaaagaccactcattttgtagaaggtggagatgctggcaacagagaagaccagatcaacaggcctattatgggaatgaactaaggtgtctaccatgattatttttataatctaatccattagtaaacagtaactgttttcaaattgaaaaaagtaaaatgataataatataacagcacatatcaaatacttattctctgttagaactgattatttcacaccttttctcctgtagcctcactgttcttcagaaactttatggattataaaaaccatgaactctctaaactctaaaagaaaggcatcatggatatgagcaattactctgatttccgcaaataaaattgtttcatttagcttccaattgcctctgctaatgagagaacgtaaaattgtggataatcaaaagtcattgatatgtgtttggagaccttgttgtatgatgagttcagcagtaaattttccttgctaatttcattttgcctccagtggcaaaaaaaaaaaaaaatgagtttggattgtctgagcatatgttaactgggtgatgaaaaagataattattgtgctggacatgaacagaaatcattttattttttaattttattttattttagattcagaggggatgtgcaggttttgacatgggaatattgcatgatgctgagatttagactctagagattccatcgcccaagtagcgaacacaggtagtcttttggaatccccagtgtctattacttccatctttgtatccatgtatacccaatgtttagctcccacttataagtaagaacatacagtatctggttttctagaaaccatttttaaatgtccttaaaatttacttagtgtaatctacaaggcagataacccacaagcagataattgaggggtgaatgtcaactgaatataagaaaatgtttgttctattgcattattatgattttaaacagagcattataattttttattttgcaataattaaaagcaatcttacctactttagttggtgggattttcattaagtgtaaaattttatatcacttgaatattctcatgtttcaattgccatcttaaaatagcacaaataatggctgaaacattattcattctattcataagttaatgctgcttaaattctgtcagtaaaatgtattaaaaattctttatgcattttttcatcccttacattcttagctatgcaggggttaaaggtcatgcagaatacttcaaggtattgtttgggtattttcaggggaaaaaaaaggttacctaaactgagtgaagtaaccaacttttacaaggctcttctcatctcattacaactggtggttgtacacattgaaatattgttgtatggggcagttttccaagttgtatgaaaagccttgaaatatttagcattttactctattacaatttgagaaattatattaaaaaataaagaaacaaaacgatatatgtcattgcagcactatttattacaggtggaaaaattctaaatttctaataataatggcatatctgtgactttaaaaataatatttcaaagattatttcatagccaaacaagctaattataatataattgtttttaagtcttaaaaaaggcagggaattatcccagatatctgtatgagtgtgtatgcgagttgggggaactctggaagaaaatctgccagtgattactggggttatgccatatagatgatttttacttctcattttcaacctgccaaatcataatgagtttctgtaataaatctgtataacttttatcagaacaaattctgttttcataactagatcctagttcccagagcaggcagattaggtaaacagccctctttacaagatggtttctaaaaagaggcttgaacacagaagcacgttctaccactgctgtttctagttagctagttctttattacagttgtatttcacagcttagtctataatatagaaattctctagcaaggttggatacctccttactatttagtaggaggatttactttcctggggggtaaaaactgtatcttcattctaccctccaccttctccttttaaatccttggcttttaactccactgtaggttctatgctccttgtctggaagctggaagacctattaggaggctgttgcaatagtctgagcaagaaataatgagccagaacaaaggcagtggctgtgtgtgtgtgtgtgtgtgtgtgtgtgtgtgtctgtgtgtgtgtctgtgtgtgtagctgagtgggaaattcagtaagtctgaggctgacagggaacgcaggagaggggatctctccccactgctgtgctgattacagctataccccgctccataaccttgcagccaccaactctcataaaatctaccaatcagacctaaaagagatagagcactgtaaccacaaatgtcctggccatcagcatagagactttccaaaagacccgccccaaatacatatgttctgtagggtcttagctcaccctaacttaacatttgcttcattttaatagtaaaaatcacagcccaggaaggagatttaagatactaatgagacataggacatataaagaagcatgacaagagaccgcacaggtgcagccaacagaccactgcaaacatgcaataatgttacctggaagagagcttagaaagaatacaagttcaagctaacccactttcaggcagccaacagcagatctctttctgctgtagtttccctttctgctccaggtgaaagccgcaataaactgccttgctgaagcccatcttagactctccatcagtttctattttctgagggtagagaaccgactggccagtcacaagtccacacggcccatgtgtattctctgcctagaataagtctccttcacctctggttgaccagatccttctatccttcaagttcccattcaaacatctccttctccacaaaacccttctatacccacagctggaagtaattttccctcctttgatttttatgtttttacctttttcatgtatgtatatatttttttattttgaaacaatcaaaattgcaatacagagaacttttttaaaccacttgagagtaaattgccagcctaatgctccatcacagctgaatacttttgtgtgtatttcctgcaagaaatgagacattctttacataactacagtacaaacttcaaaatcagaaaattaatattgaaatattaatgccatctgttcctcagtccagtaatgttctttatagcaaaagaatcctgttcagaatcaagtgttgcatttaattatcatctctttaatctcattcaatctggaatggggtctcagtcttaaatttcatgaccttgacaatttagaaaatacagactaacagagtactcatcaatttgggttttctagtgtctcctcatgactagatccagtttatgcaccttcagtagaaatatcacagaagtgatgatttgttcttattaaatggtgcatgattgcaatttgttctattattagttatgctcactttgattgcttgattaagatgatttcttccagtcttctcaactttgaagttattcttttcccctgggtaattaatgatattttgtagagatatattttgaaacttttaacttattcattcacttatcttttgtcagtatggactcactgtttattttattctataagctctaatccattactatcattatttatttttaacctgaaattgacaagatttggccagcagaaaccccttcaaagtggttcctgtgtactttgatacatcctcaccattctttgagcatttctttgctttatgttacaagatgttccaagatcattcgcattttctcttcccccaacctggactcatccatagttctacaaggactcctggttccctgaagaatggtatttagaaaccaaggtctgagtcctaggagtttttattgcatttggggtggtactgctccgaagactgctcagtgcacaaaacttaaaatcatgggaatgtatggaagtgcacacatgtataaatccacacgtttacatcaatagttattatctacctgtagatactgaaaatcatgagttcacactcaaaggttccaactccattgagtttattccagctttctccctttccatatatgcaattcctatttccaatagtgaaaaacctggctcccattatccttaacatagttacttacttaaacacttccatatatgtctcccatctttggaactatcaacttctcacataaatatcctccttattccactcaggtcatgattgcacatggacatcctctcctgtatgttcagtctctgaaacccatgttcaagtcactctcccctaccgctccatctatatattctcctaagcctgtgcattccctgaaaattccatgccaggccacccaccccctgtgatatccttgtcaccctgcttgggctctgttacccactttggactatcctatatgtgtaccctcctcactctaccaggatgcccgtacatggacatcctctcactctgattacaaataataaaattttttagttaaagaaaaaagagatactggtaggatttttagtctaggaacatcctaataccttaaggtccttggccaaaccttaatttattagcatacgtgaaacacactcatggaaaagtgattcctttccttcttttctgcctgtgagaccagaccagtcatcaatataatcattgtttaagggaaaaagtgtattagtttttttattaaatctcaccttctctctttctctctctctctctctctgagacacacacacacacacacacacacacacactctctctctctctcccattcctttaccatgaaagcttatttcactgttgctcaatcctctgtggatcaaaatcggcaaaggatactaaaagtactaatatttttcatggaaaacaccgcctattgtattctgttgctggaaagattcttccacaagactgatgacagaaacaaaggaaatacaaggaagaggttatggaaaacaggagggagagggatgagtaaataagaaaaagaaaaggtgggaatgaggaaagtagcaagaagggaaatggaaagaggtgatctgggagagaaaaaccacaggtgggatgctaaatgggagaaatgtgaaaagaaagtagtgggagtggcattcaggagagtctgacttagccaccaaatcccatggcaaagagtgccaactttattatcagccccaaagcagtgctactgtcaaaataaaaaataaagttacctactccaaaatcactgacatgtctaagcaagtaatggagaaactgttggttcatacactttttgagaaccaaacttctgaatttttgtctacatacttgtttcctgacatctttaaagaattgctgtttggagcatcagttttggacaccacacatcaacatctccaagatggtgaaagagttcttggttgaccaaaactttgttgaagaaaaatattgatatgtgtataaatggaacgcctgcactattagcatcacatctgattttgctgcttttataaagaaagaaactacacatttcatcacgtcaatgtgtctgactcaatcccctaccaacgatccagaaaaatgtcttgtctaatgctaggatcttgtcaaatccaggttatgaaatcattgcctttttatcactttgaattcaaaaacatactttaatatgaagttattctcttcgtattcttcattatagacctaagtttgctggatttccaaaaagtagtttttgaaacacaataaaacttaagggaaaattttgctccttttacagaaaaagaatatcacttcttagaacaatttttttaagatgctctattaactacctttattgtgacactttttaatactgtatgaaaacctcggtatggtgccaatttctttttttccctcttaacttttattataggtgtggggtatacatctgcaggtttgttacatgggtatgttacactcagggagtaagcttagtacccaacaggtagtttttcagcccatgcccccttccccctctccctcctctggtagttcacagtgtctgttgttcccacgtttgtgtccgtgggtactcagtgtttagcttccacttataagtgagaacatatggatttggttttatgttcctgcattaatttgcttaggattatggcccccagctccatccatgttgctacaaaggatattatttcattctttttatggttgcatagtattccctgtatatgtaacacattttctttacccaatccacaattgatgggcacctaaggatgattccatgtctttgttattgtgaatagtgaggaaatgaacatatgagtgcatgcatctttttggtatagtgatctattttcctttggttttatacctaataatgggattgctgggtctaatggtagctctaagttctctgagaaatctccaaactgccttccacagtggctgaactaatttacattcccaccaacagtgtgtaagcgttcccttttctccacagcctcaccagcatatgttgttttttgactttttaatataatagccattctgaatgaatggctgaaatggtgtctcagaatggtgagatggtatcatattgtgattatcatttcgatttgcatttctctgatgattagtgatgtggagcatttttccctatgtttgttggctgcttgtatcactccctttaagaagtgtctgttaatatcctttgcccattttttaatggggttatttgttttttgcttcttgatttgcttaaattcctttatcagatgcgtaatttacaaatattttttcccattctgtaggttgactgtttactctgttgatagtgtcttttactcacagaacaatttgatgaagatttattccatgattagtttaattagcagatcttttttgctgaagtaaatcattctatatgcttcctacagatgttattatagatactactgaaaatatcagtagggcacattagttactttcccaacattcatttcactttattccttcctaatgaaatcctgattttagtttgtacattatttcccccactcaccaaatgactgaggaaaacaaatctcattgccaaattgtccctccttagttgaaaccagtcagcacatgacactgttctggctactgttatataggtagaggagaaattacatggcctgcatcggtccaatcatagttaggggaagaactctcttttacaatgttaagaacatacgttacatcagattctcctggtaggtgacttgtaaccataggagaaccagtctgaattccaggctgtctaatggagcagaaatatggaaagcatttatgtcttgataacattatggatcactgagtcaccaccctgaccaaagctgactctacttctggactctctgttatgtgagataataaatttctttactgtataatttgtcattgacttgggcttttgtacttgcagccagaaatatcctaattgatcaaatcaagtccaacctcctgtctgaaaactgaaattgcaagcagacatgcatgccaactttgaggtgctggtgaaagtgtttctgcaggttaggccttcacagcttccctgcagaaagaaatctgaaaacactgaatagttcccatgcaggtttcttctgctcagataattttaaagcttaaacatgacctcataatcctttccttcctggcatagagagaattggtaatgccagctttgcaaggtaacctcattgatttgaagaaaaaggaaatgatgctacacaaattaaacccaagagagtcttggagaattctgatgttctttgacagcaatgtacctttgagtcacgggttttagtaccagctgccatcaaaataaaaatgtcaaaatcaattgagtgtccaagataattttcacattgctatgtcagtctctttttcaagtttaacatcagatggcttaatttgtacagagttaatgtttactcttaggattttattttgatttttttgcacagtttagattcatcttgattatttcctgaaaatcaccactaaatttacatggcttttcccatgaagaaaatattctttgaacaaaatcaacttccagttcaataggagaaaccataatcatatgcaaatttgttatgtatgtgtatatacttttctgaaaaggggaattatattttcatctgattcacaaaggagtccatgactcaaaaactatttctgaaggccaaatagtaactatagatggtcagagaaattaccgtgaaagaggaaaagagaagaaatgaaataagacgtattttttaagttttggcctggttgagaggacagatataaggtgactgcctcttggatatggcaaagtggtggtatatatatttgagtctattacagtatagttggaaaacataacaagtaaataagaagtccctggagactttaagacatgtaatgacaatatattgctgtgtgggtacaaattaggtgcatgcctggatcaatcaaagtacttgtaggaaacttaagacacaatccaaaaaaaaggtaattgaagagattttaatgaaagtactatttacaaaagagtaaaagatgggattaagggaagccacagggatggtgaaagagcctaggattgacaacaggagaagccattaccgcttctatgccgaagctagcctattgagagtcatggtggtagaaggatgcctgacaggagctatgatcataggtggaaggttacagaaacggtccacctgcagcaccacaggaaaggagccccggaaataaataccccattctcactctctccccataatctgaccgcctgccaaagcctctcactgaccaaatccaaacaagagctgagggggtggaagctggattatcttagctgacaagatcagtcctttagaatcaaaacagggtcggccaggcgcggtggctcacgcctgtaatcccagcactttgggaggccgaggcgggcggatcatgaggtcatgagatggagaccatcctggctaacagggtgaaaccctgtctctactaaaaatagaaaaaaatagccgggcatggtggcgggcgcctgtagtcccagctactcgggaggctgaggcaggagaatggtgtgaacccgggaggcggagcttgcagtgagccaagatcgagccactgcactccagcctgggcaacagagcgagactctgtctcaaaaaaaaaaaaaagaaaaaaagagaagaatcaaaacagggtcatggatgaagagggacgtgacaaggcaaacaggcaccacccaactcagacacggcccatataacagtacaggagggactctcaataagaaatagagatatttagttccacagtagctctgatacacatttttggcaaagatgtgtatttcagaatcctttccgtttagttaatgctagtttttagtcatcatactctatgttgacaactttacggatataaacaaatacttattttataatcattaagtttctgatagtaaagctaatttttcccctcaggcaaaaatattcttctagtttcatagctttggcagtactttattcctcttaaagagtaaagtgtttatgtaaactggaaacaattgttttgattccatctccaaattatactaattcctatgagattcacagttcccttttgagttgttatgaacctaaactgtgtccaggagtatgtgtgggtgggtgtgtataatgtactgaactgatcaattgacagtccgtgtgtacatgcacctggaaggccaccactagctcatcatgtctgtgtcttttcagggatggactgcataggttgtctggtgcagtggaaagagttctgaagacactggtcatgatctgtcttttcactaagcagctgtaggtcttttggcaagtccctcacccctccaactactcttcaaaggagtaatgggttgaggcaacagaggctcagatatccaccgactttaagttctgtggttcccatgcctgtgcctgatcagcatagctaatgggaacatccactttgctgcttactgactgctctggtttgaaaagagctttgttttaaacttatctagagtgctaactactctactttaaattaaatattagataaggaaagcaacagatgacattaaaatacaacaaatcctcagtgactttctgtgggtctaagagttacagcctcacatgaaccttaggatttccgtgaattgcataaattatgcttaccatttcgcaggtaaatatttacatgtccaagtaatgactccacaaagctgtgagaaaggaagaagataattcatgccctagaatagatctgtacattgtaattcaggtccactggagaaactctatttactatcatcttcaatgtcctggaatggaggaaggagctatggagccactgctgaggccaaggtattccatgccagctgtcacatgggtatttgtacaacattcttgcatcatacaaataaataattagctacgtatttaatacctactgcacactgtgtattacatatattgtttaattctcataactgtcctttgatattatctccaatttactggtctcaaagaaatcaagtaaattaaccaaagacactacctaggaagggaaagagtcaggatttcaacctaagattctaaagctgatgcctctatccttgttaccctagtgtctccagcaactctggccagacatattcactatctctcaaacacttccattggtttttcacagaaaatgaagctgttcacttaactttgatttctcccttgagtgatgtatctgaacccttagccctccacatgtgcctctagcaatatctactattccctggagaataagaaccaggtgggctgggcctggcctcaattgccagtattctccagctccatagcagggcaagcaacacatccatgtgacctgtctttacgcactagaacttctatctcttgtctttcttctaaattatagaccatattttcctgtaggcatctacctcctcttcccttccaccataattacccaattatctaaacaccctactccctacttcaactgtctctagagaacattcaccttctaaatgtgctttagataattttatacctttactgggctttgagaatttttttaaggggaggcactgccctaacccactctccttttgtcttaggttgggtttcttggaaatagattctaagatggagaattgtgtgcagaattttggttgtgatgtgctctcaggcgatacacctgcaaggaagtgacagaagaatgcctgaggaggagtgagaatccaggaatgggtcagccctgaagaggggtctggggcaggcactgtggtgtgcactgtacctgctcagattggtgggcctgacttgtgtcttcagcttaaattacctattcctcttccagacaaaagatctttaaggtcctaaacaccagtctggaatctgactatgcaaaaatgaaaagatcctgagctccctctccagaggaactaagtgaaacaaagaacgattataaagtaggaaagttctaaaaatagtaagatgagactgggtaatttgaatgaaagccagtcaagtctatgtggaatatagcatcttactgattcattatcagcccatataatttaattacattctacttaccatgcaattttcacatcctaaaccatccagcgtgaagtctatgttatctgattaaagaaagaggaaagggagagaagggagtgagagaaaaagagagctcctgaagccatgcaaaagaggagcttccttaaggatggcagaatgcattgcaaattcagaaacatatttaacatataaaagaaataatgtaaatttatctcttgttttctataaataagccaggtttgattatcttaagctattaatacaaatattcttctctttgtctttcttaacttgagccatttacaatttgtaacacagagaatcatttttcagatctaacttaacatgtaactcttcattgtttcaactgaaattagcaaatcccagaaagaaaattcttccctaagaaatcatttcttcaaagtgattatttaagagttgctaagttagaaacatacatatcactatcactatcttctgatcatggtatcactatcttctgatcaaaatttaaagatattcatttgaagaacatttatacctcaagttctaggaaaaggaggttttagtgactgaaagatgttgaggaaaatgtgaagctcttaattaaaattattgagtcacgtgaatatactgaataaaatggtggttcccagaagctgggacaagtaatgagaaaggggaaatgacgaggggttggttaatgggtacaaaaatacagttagtagaaataacttctagagcttgataccacaatagggtgactatagttaataatttttattgtacgtttcaaaatagctagaagagaagatttggaatgtttccaacacaaagaaattataaatgttgaaggtgatggatatcccaatcacccagatttgatcattatacatcatatgcatgtatcaaaacatcacatgtaccccataaatatgtacaacttattcagatctttttttctatttataactgattgaataaacctattcattttactaaacaattagttttcaaaaataaccaatatataaaactgaagaaagtcaaagaccatatcctgaattacaaaaataatattttaaaatatatatactcctagaattatttgactttcacttaactaatactctttgtgatcaatccccctgattaaattcaaatttatgttaacctatatttacatttatttttggaggtactctagaaaagttttccaaactgcatcctagttgctgtggcctttggtttgatggctttcacttttgagttcaaacctcatttcccaaatacattctacaactaggcatatttatttagaactcaaaaggccaccatcttcagacttaagaaacaaaagcagcagtggtttcattatatttcatatatttcattatattttacctgtgtgtaaaatataatactgtcttcttgggcgaaaggtcatataattctactctcatgtggatgttttccacaaaatgaatacatagatttaaactgatcaatccacattctttcaattgacctctcttaaaaaccaaagcacagccatttgagcttcagtgcttagagcaactctttctggcctgtgtaaggaatttacccatgacttgggttttaatactgtactctaaccagcagcaagagagagccaccaacaagaaaaaacagggatgctgattttaagaacttaattacaagaatttatcagttagaataaccctaagtactgtaacaaataaaccctgaaatgtcagaggcttgacagagcagaaggttatttcttactcagataatggcccaactctggaactcctaattgggaggtagcttttctctacatggtgatttgggaaacagactccttgcctcttgtggtcccacagggtctcataatcttctgcattttgccagtggaagaagaaagcatggagaaacatcctgtttcttaaaaactgtggcccagaggtaacacacatcacttttgctcacatttcattgatgtgaaataatcataaaatcaaactaagatgcaaggtggtgggagggggagtgtgtagaaaatatacttaaacctaaactatgggacaaggagcacaagttttggtctacaactattcatcacaaccacaaacaccatcaagcaagaatttatcaacacctattttattctggatgctgtggtaataatcaaagacagcataggccaagtgacaataaagaactataatgtattcacgctgtcattcagcaaatgcttactaaacatctaccggctggcacttgctgggccgtaaactaaggaaatgaagatggtgctctcaatcccatataggagacaggcctgagcagtgctgggttacctcaaagcaaatcaagtatatttttaggattccaatgtaggagcgccaaaactagagacagaaaaaaaaagaaagtttttgaaacaatttgatccctgatgtgtccttaaatagcattaaaatgttcatcaaaataaaggtaagaactttgtaggatttctttatacttatgattaacattttttaattatgtgtatagggaacatcaaaatatttttataatatcctagccctttaaggtatcaacttggtccagatatttaattaagtgtaaggaatgtcccaaaagacctcacaaatgggatggaatttgagtgccttagaaaaaaaagcaaggctcagataagcagaagatatgagggaaggtgttccaaatcaaaggaactaggatagcgctagtcagcagagacagcatcaggacaaccactatggctgtgaaagataaattaactgggtgatgggtcctcttaacagcccagcttcactcagatctgccttccctgttgaatgtgagcacctcaagggcaaggaccatggccatcctttagccccaattaccagtatctacccaggtttggagaactgaataaaattcaatgtgtgcatcaacttgcttcttttaaatgctgcaggatacattgcaacaaggtgaaatttttaaagcatatcttgactctggaaaccatatgttgtcaggtcaagatgggaggcatgcagtgctcttatctgtctcatatttgaatgcttctgacttttatcacagattaaatttactggaattcatttatttctatacatttctccttctgtcatcccctcttactttgtgtagtaaatatgagatatttttctccacagactcttcacctcagaaaactgtcattatctattctgtcagtcctaaacatctggagaattggcaaaactattagttcaaaatttatgatggcattcttcacattttacagaacaaattctggtaatgtttactatttccaatatctggaggactgttatttactatatatgctttttttcacaggagaaaagtttatatcactaccttgctatgcttcttagaaacatttttaaagtattatatagggtcacaattctatcagtgtttttgtaagagcttgaattcatactcatggtgtttgaaagaatttgtttttctctaggcagagctaagattgaaattagatttcacgaagatgacagttttcaagacatttgaaggcagtctttttaaattctaggaaaataaaatatcttagttctgacattcagatatcaatgtaggctagttgctagtgagtgagcactaatcagtcgtaactttcttctgctgaatctgaacaccacctccaaatactcagcccagcactccatcagtaagcacccatgagttgaagtttatatgaggtgagactattcgcatttcccattatatctgaagtacctcacttgtagcagttaagaaaaataaatataatcctataatatttacagagatattagtaccctatcaaattctgcttagtgctactaatccccatagaccctttcaacactttgttaagaaatagtgaaatttgattaaccctattctagaagggattgtagttaatgagagcttagcaactaagaaagttcacggggggtaagaagaaacatagcaaagtccccttggcctctttcataaccatactattgaggaaggaaaaagaaaaggaggcaaaaattgacaaagtaaatattggaaacttggaagtcagaaaatatgtttatacaaagggaaagcaaaacacatttactgttgaggcaagacaaccaaatacaaagtaaataaacacatatagaacaaatatggcaaatatatagaatgcatgctccccaacccctttccacagccatggcaaataccaattatcaattcacagcaattctcatgctgagcccatgtgcaatcttagcccaacacagtgtcagtataatcactgaaacatgagatgagataaggcttagttgtcattcccagtcttgcatctgttgctaaagctttcttaggttttttactatactgtatataaaaagctagggctctccaaggcacacaagtcttaaaacttgccacaagttagcagtgaggcagataagctgatctcatccaacctcccttcaatagcaaaggaaaaagaaaactaacttatatttctctaatgctccgtaatgtataaggagctttatcagcactacccaacagaattttgagcaataatagaaacatatatatatatatatgttcaatccaatatggcagccactaatcacatgtgcctattgagcatttgaaaattagcactagtataactgaggaactgatttttactataattaagtttaactggccatgtgtcttagtcattttgtgctgctacaacaaaatagcaagatgggtaatttataaagaacagaaatttattttctcatagttctggagcctgagaattccaaaatcaagacattagcaggtttggttgtctggtgagagctacatcctccacagggtaagaatacagtgtcctcacatggcagaaggcagagaggcaagctcaccaaatgtgtgaaaccttttataagggtcttaatctcattcatgaaggaggagccttcacggccctatcacctcttaaaggctccaccttttagtactaacacattggcaacacctgactttcggagaggacatagttaaaccatagcactatatatggctgctatattgaatagcacaggtatccatattatctaatttgatcttcacaataactttgtcaagtaggtcatctccattaaaaagagaaggtaaagagacacagaaatattgacttgccaacattacaaagctagagagtgaccaaatgtatacttgaatctcattctttcagaatctaagttatcagacccttctttggtaccacatcaaacttgaggtaggtatggatcaaaagaggaccatgccctgaaactagtggttctatgcagcccactatgagtttaccacgggaagtacactgcaaagaactaactctgaaaatctgagattttaccctatttgtaagctaacaaattagcatgccaatttcatgaaagccagcagaacacagaagactcctggatcagagtaaaaggactttattactcacagtaatagcagtagacagggtatgaacattttcttacagcaacttcccaagcccgaattcccacagaatgatggatgcagagggccggatgactcttgtgcatgcagtgggttgcattacagtttgcaaacttaccttagaaaacctaaatcatttatagtaggcagaaagcatgcctactccttattccaaagcggagtattatctttatcataataaacagtaagcatgactccctttctctatatctatcctccaaggatgctgtctatacaagcatccttgaaatgataacctgaaatgaaggaagtcccaaaacatgcataaatgtgagaaaccacacaccacttcttctcctgtttggtgaaaaactattttctcctgttttgtcaccaaagagtagaaaataagccaagaaaagagaaagatgactaaatatcaacataagagccaagttgaggtgtaagtgtgtatgtttgatagaaagactacgtgttcaaagttaaaaccaggaattaatgttaagccaggaaattaaagtgaaagtaaatttgggaaataatagtgccatataagtgtgatgaatcactgacatttttattgggcattaacaacacgtttttaaatataatttcccccaaactagaggctacttctttcttggaactgaatgataaatacatgcacataccccttacccaaggcagccatctgttctaagggatcctccaggttactgtccctaccccgacaccacactgcctcccagatgtccttctccctgaagccagccccagatcttctctccccaagcagctctcctttttgcctgtcttcctgagtaccggtccccaaatcaccaaattctaccttgaacatattgaatgaaagtgtgcagtgccttatgccctgatgagaagtggtcttggaagatgttttctgcaccaacttaagaagctatcacaaaatcatgataaaaaaaatgatgagctatttatactttgcagacataggtggttgttggaagaaaagagtgccttaggaatcaaataactggtattggaggattcctgtgactttgtaaaattcaattaaatatccaggggaaaataatagacaacattgtcacctgaggatacattattggtccttgttgaaaaagcagtagtttctaaccagttccttcctaacctatttgccattaatttctggaagttacaaactgtaataacaattaccataacactgactgtagcataaaaaccataggatgttagccccaaaagatggtcagaaataatgaggtgctaattttacagatagggaaacagagacctgaagcaaggagtgtctttttcagagtcacacaaccaatcattaatgtatctaagacacatttgcaggaggattctgttcttcactcctccatttttatacaacatactatctcttgcttttcaacctacagtaagttgagccaaaaaaaaaagatacctacaaatctccttcttgaacatgccctttgaggtggctggaacagtatcaagtggtctgagatagcaatgcactaggtggaagcttagatagatggcactaagtggaagcctagtaggaaacctcagccctgcaggcagcttccatgtgtattcccttgggtctgccacaaaagcatgttgcactacaaaagattcaaaaggcaaatgtgtgcacagcacaggagggagcccagttcttctctgaggagtttcctacttcagtggtgttattaagctgggtcaaaagaaagtcatttcatttttttaaaatatgctaatacaacctcaagcaccagctagcttaaatgataggcatttcataaagttcatttttattattctcagctgaaaagtaaataacaccctacaggtgtccttcatataaaaatgatgtatttgccttcaatggagactctgtattgactaaaaccttatctgtatttcacaagacagatcatttttccccatcacctttcaaagaggtgttgttgccagtctatacaggacaaacgaaaacagtctaataaaagaaatggttcagcaggaactaactgaaagagttcccagtgaccaaaactggaacaacttgagcaataaaataaataacctagtattggattataacccaaagaataaaataaatagccatgagttcatacttatataaataaacataaataggcatcaatagtgtatttataaaataatttccccagaactaaaggctactgcccccttgggactgaatcataaatatatgcacagtaaatatcaatataaataaatgactgaacaaataaagtaggggagaagagataaatcttcctttcagaattccatataatgtatgttcatattctccctctccaaaaggcagagcttaattcctcagttttggaggtagactagacttagtgattcacttcttaaaaaatagagcagggaaagggaaaaatagtaactttatagtggagaatcatggcaaatgctaccttaaccaaatgatgacagttaacaccaccagtaatgtcaagtgaatatcatgttctctaatatgatctaatgagaagggcttgacttctgagatactcttcaccaaaacttataaccccagtctaaacatgagggaaaacatcagataaactgagatcagggggacatttttttctacagaatacctggccagtattccttaagacagtcagtcatgagaaacaagcaaagattagaaagtcacagaccagaagagactggggagataagaaaaattaaatacaatgtggtgtcctgaattggaacagaaagaagacattaatgcaaaaactattaaatccaaataaaatctgaagtttagttaatagtaacgagccaatgtctttttcttaattttgaaaaatgtaccatggtaatacaagaagttaacaatgggtaaaactgaatgaggggtatatatgaactctctgtactttctttacagctcttctataaatataaatttctaccaaaataaaaagtttatttcttaaaatagatggtgcaaatgtatcttattgcatgctcttccctggagcatggtagagttttatagtgaatgcattgccaaatccaaggaagacagaagacttgagaaaactaaatactttcagcagccaggggtggagtggtgacaacaagctgtagaataaaaggaaaagtgatgtttgttcagtgaagaacaaactaagtcttatttgtgtagtggtctcagaagcagaatatgttctaaacaaagagttaaggaaggtaaaagctcaaaccaacaagtaaaccagatttcacagaaacacaaatgtgtagcggctgtccaataatgattatgtttaatagtagaatagactccagttgcaaacatatgttttatacaaactcttcaaattggagacatttctctaaattttccttgtaaattgtgcaggatattacatctgactttcatattatcatctcaaaagtggtgaaaccattttgccaatcacttgcatcacctttctgccaccctgccttctaaattacttccttttcccactcaggccatcctctactttcaattccaaaggtttcagttcctacccaaactgtccccctctacccatcccacttacaacccttagtctcattagaaaaatctcaaccacccgcttgcctttaacacctttttctggatttgccttctaaacaataatcccttcgaaatgactttgtgaatgaatgcaactgatttaaagggtaaagagaaatgtatctgctttctacaaaagctttatgtagatagggaaaattacttgtataacttgccctttttctcctcatctttctatagaaacatagagttgtgtttccaaaaattccaaggaaggcctgggcatagcttgtaatacatgtggtatggaggttattaaaaacagtttttcaattcaagttctcaagcctactatgaatgtttaccaaagaacgacgtgaactggactgacaaatgcattatactttggtcaatatatattaggttcacattttgttttatcaccttgatggctgaagaataaatttaaaagggatggactaaacattcaaagacgcaaacacgagtaaatacttcagagttcaatatgtagataacaaatccatcagcatataaacatgttcagcaaacaacagactgaacaaatgtttattgagtatctcttaggtgtcaggaaatgtgcaagcactttggcaaatgctgtcccatttaattctctctataaatgtgtaaggtaggtataattatcctcatttttcaaattgtaaaaccaagcttccaaagattaagtaacttacccaaggagaattgatgtgttacttaagtaatattagttccaaaatatcagtggcttaacacaataaaatattgaaatgtttctcactcatatcaccattcaatgcaagtcagtggtgggtgtggctaagaatattctatcccactcgtccattcagggacccaaaatactttcatcccatgtctctgccctcccctaggtccccagagacctctccatccaatagctagatggagattaagagcacattaaaggtttttttgtgcaagacctggaagtagcacataccacttatgctcaaagttcattctccaaaagaagaaccagaaaaggaacagccaagcaagaagaaaactttcagacaatgggtaaaactgggtgacagtatataagaactctctgtactatctttacacttttctataaatataaaattttaccaaaataaaaagtttatttaaaaaaaaaaagatggtataaatgtatctcattgcaagctcctgcctggagaatggtggggttttataaccaatgcattgtgaaatccaaggaggacagttaaagaaaccttgggaaaactaaatgccttcagcagccaggtgtggagtggtgacaacaggctgcagaatgagaggaaaaacgatgtttgctcttcacagagcaagtgaactattattcgtgtaggagtctgagaagcagaatatgttctaaattttactaactgtagccactatatttctaccaagcactacccaaaaaaaaaaaaaaagtgactctatctcctcccctgccagaaaaggccaaatttgctttccttctaccactgcatggcagcaatcatccagcactcctcttctctccctggagcaacgtcagaggaagactgctacaacagaagattcaaagaagatccagagtctcataatataatacccaaaatgtccaggttgtaataaaaagtcagtcatcatatcaaagaccaggaaaatttaacttaaatgagaaaaaaaaaatctgcagacgaaaaggatttttgaagcccatagcaaaaacatctcagtgaagaattatgagcacacttgaaacaaataaaataacagaaaatcttgtcaaagaaatagaagacataaagaagaaccaagttgacattttacaatggaaaaaaatacaataactgaaattaaagagctcagtttatggactcaagagcagcatggaaaacagaggaaaagatcggtgaacttaaagatagaaaaatggaaattacctaatctaatgacagaaataaaataaacagaagaaaatcaacagagtattggggacttgtgagatgtaacagaagatctaacatccatgtcagtggagtctcataagggagaaagaagacggggctgaaaaagtattttttaaaataatggctaaaaatgtcccattttggcaaaagatagagaaaaagattcaaagagttgagcaaaccacaaatataataagtcaaaaaaatcacaccagacatatcgcagttaaatttctgaaaattaaagacaaacaaaaaatcttgcagctgtgaaagagaaatgacaccatacctatcaggagaaaaaaaaattgaatgacaaggtttttcagcagaaaccatggagaccagaaaatcctggcacaacatttttcaagtgctcacagaaaagaactgtcaacccagaattctacatgcaaagaaaatatccttcactaatgaaggattcaatacagtcttaggtgaagggaaactaagggaatttgcctgaagatctacactaaaagaatagctaaagaaagttctctagacagaaatgataaggagaaatcttagaccatcaggaaaaaaggaaaaaaacagaaagagtgaaaatatgaatcaatgaaatatgctttcattttcctcttgttttctaaattatgtttgatagttaaagcaaaattgtaacagtctgatgtggttctcagtggatgtagaggaaatatttaagataattttattataaatggaaagagggtaaaattatataaaggaagtaaggtttctatactgcacttgaactggaaactggtaacaccaacagatgggataagttgtgtatatatcatataatatctagagcaactactaaaagagctctacaaagaggtaaatccaaaaacactaaaagtaaattatgatgaattccctttaaaatgtccccaagtaacccacaggagctgagagaaataaacagaaaaacataaacagtgaaaacaaatgaaaaccaaaaaataaaatggcatacttaaggattaacatatcaataattacattgaattttaaaaggtctacataccgacccggagccgtggctcacacctataatcccagcactttgggaggccgaggcaggaggatcacttgagctcaagactttgagaccagtctgggcaacatagcaagacctcatctctataatataataaataaataaataaataaataaataaataaaggtctacatacgaatgaaagacaaagattggaagagtggattaagagaacatgacccggccagacacagtggctcaagcctgtaatcccagcactttgggaggtcgaggtgggcggatcacctgaggtcaggagttcaagaccagcctggccaatatggtgaaaccccatctttactaaaaatacaaaaattagccaggcgtggtgacaggcacctgtaatcccagctactcggaaggctgaggcagaagaaacgcttgaacctgggaggcggaggttgcagtgagccaagatcacaccactgcactccagcctgggtgacagagtgagactccatctcaaaaaaaaaaaaaaaaaaaaaagaaaaaaaaaaaaaaaagaaaacatgacccaactatatgctgtctgcaaaaaactctaaatgtaactaggtaggttgaaagtaaaagagtagaaaaagatatgccatgaaaagattaatcaaaggcagtaggagtgtctatattaatatcagataaaatggacttcagagtaaagaaaattaccacagaaagagaatgacattacataatgataaaaagctcactccaccaagaagacatagcaattctaaatgttcataaacaaaatagcacctgcaaaatacgtgaagcaaaatttaacagaactgcaaagagaaactggcaaatccacaactagaactggagacttccataccccactcaaaaactgacagaacaaaatgacagaaaatcaaaaggagtataaaggaaaccaaaaataccatcaaccaacaagatctaatcaatatttataaaacacttcaaacaacagcagaataatcattcttttcaaggccccatgataaaccttatcttggaccataaaatagacctcagaaaactcaaaagaactaaattaacacaaagtatgtcctctgaccacaatggaacccaactagaaatcaacaacagaagtataacaggaaaatctctaaacagaaactaaacaacacacttctaaataattaatatgccaaagaagcaactcaggagaaatctttaaatactttaaatttttatagagaaaatcaatgaaaggttgtttttctttaaaagatcaataaaattgacaaaccttataactgacatagaaaaataaaagattgttattttgttatcaaattattgatatcagtaatatcagtaaaatgttatcaaattattggtatcagtaatgaatcagggaatatcattacaggcctgcaaatatgaaagagataagagaatactaaggacaattctgtacatgtaaatataacaacttaaatgaaattgatcaatacctcaaaaagcgtgaactattacaattcacccaaacagtttaaataggcctataactactaagaaaattgtattaataatcttaaaactcctgaaaaagtaatctccaggcctagattgtttctctagagaattctatcaaaagattaaagaattaacaccagttacacaatctcttgcagaaaatagaaaaggaacactttccaactcattttatgaagccggtataccaagcaaaggcagtaaaaaaaaagttagagatcaatatcttccatgaatatagacattcaagtccttaacaaaatattatcaaaagaattcagcaatatataaaaagaattatacagcacaaacaagcgagatttattctagaaatgcaaggctgtataatccaccagattaacaagctatagaagaaaaatcacatgatgatatcaatcaacacagaaaaattatttgacaaattttaacattcattcattataaaaaagattcacataaaagtagtagtagaggaatacttccttaacttgataaagaacattgacatgaaacctaaagttaacatgattcttaatagagaataactaaatgctttctctctaagatagggaataagataaaaatgtctgctcttactactaatattcaacatagtactggtagatctaaccgctaaaataagacgagaataaaaaagagaagacatacatatgagaaagaagaaataaaaatgttcatatttcaaatgacataatcatttatgaagaaaatttcaaataatctacaaaaaaactcatatctaataagttagttcagcaaggtagcataatacaagatcaatacccaaaataaaagatatttttatatcctaaaaatatatatgtgaaaaccgaaatttcaaacacaatgccatttgcaattattctaaaataaaataaaatacttaggtgtaaatctaacataacatatgcaggacttgtatgctaaaaattacaaaatgctaatgaaatgaatcaaaaaaggcttggacaaatagaaaataagttaaaagatggtagacttaaaccaaagcataccaataattacactaagtgtaaataatgtaaacatcccaattaacaagcagaggatgtcagactggataaaaatgcgagattcaattacaggctatctataagaaacctacttaatataaagatataaataggttagaaataaaaggattaaaaaaggcatgtcatgcaaacattaatcaaaagaaagttggaatggctatattaatattatacaaactaaacatcagaacagagaatattatcagggataaatggagatttacataatgttataagaactattcatcaaaaaaaatcttaaatgtgtatgtatatatctaatgacagaacttcaaaatacatgactcaaaaattgacagaactaaagggagaaattgacatacccacaattatagttggagattttaacacaatttcctcaataattgacagaacaagctgacaaaacactgatagatgtatataagatttgaacaaaactatcaagcaaattatcttatagaacattgtgtggaacaatcacagaatacacattattttgaaacataagcataatatcaccaagatagactacaagctgagccataaaataagtctcagcaaacttcaaaagattaaaatcatgcagaatatattctatgagcctgagtacaatagaactaaaaataagttttgaaagaatctataaaatctctaaaaattttaagttaataaatgccctcctaaatattgtgtaagtcaaataaggaatcatgaaattagaaaacatttcttactaacaacgaaaatacaacatactgaaatttgtaggatatagctaaaataacgcttagagcaaatggataattctaggtgcttatattgttactgacaaaatgttttaaactaattatcttagcttttacattaagagaccaggaaaagggtggtgaattaaaccaaagtaagtaaaaggaaggaaataataaatataaagactgaaaggaataaaataataggtaataatagaagaaattaagtcattcgaaagctggttctttaaaaagatcaataaaattgaaaaattattacttagactgatcaagaaaaaagaggaaaaaactgaaattaccaagattaagaatgaaagaaggaatattactatagatagtataggctaaaaggatatgaaaggaatattgttttgggggggttgtttttttgttttgttttcacttatttgtttattttcaaacagagtctcgccctgtcacccaggcgggagtgcagtagcgtgatctcagctcactacaacctctgcctcttgggttcaaacgattctcatacctcagcctcccgagtagctgggattacaggaacaggcaacaacgccaggctaattttttttatttttaagtagaaacggggattcgccatgttagtcagtctagtctccaattcctggcttcaagtgatctgcccacctcggcctcccaaagtgctggtattacaggcatgagccaccatgccgggccagttttggggtttttttgttttgtttttcaaaaataggttttaagatataccaaataaactatacagatatcctctaacaatacaaaaaaattaaaaatgaggttaaagtatatagcaaaagccaaatatgacaatacacatgaataatttataaaacaaggcttttaatcctaaataactaaaatggggagacctcactgagggctaacatacataaaatgaggactaatagcaaggaacaatcctaaacattttcccatgtgactgactaagccacaaaaagcaccttagaaaaactattagagtaatttttttctactcagttaccaccatcttttccttttcaccttttccctgattttctctaccaatggtttttctttggtttgatcagttgaacccaaaagatttggaacctaaaatgagtatcaactcttattggaatagcgcttgggaaatgcaatcctagaaaaggcaaatttttacctgaggtagcttgagaaagttcagcatccattctcagtgtgagagcatctcccatgttaatcactaggttaatagctgtgcttggctagattacatgaccctgcatgatactggagtgctccctggtgaggtgctactatctacacaaacacctgcccattaagccttcaataaatacaaagcaccattttaaaccatttcactagaataaatttttaaaatatatcatttcttctggcctaacttgcttcttcagatgggctggggtgctgctcatgacacggaagacataacagctaatgtgtggctatttcaagctctttagacttcagcacttcccacttatcaagcctcagtacttttttgcagcaataatggtattttccattaacattccctctgtcatgggaccaacacccccagtaacaggaatgatgtaactggcttttttcctgactccttaaaattccacatctccaaccaacttgagtttgccagttatgggaccttgacctctcttttttcccagatcaatgactgctgaaaaaggggtcaattcagctagaagataaaacaattgtaatataaaattatttttaaaaagaacttccaaaacctagagtaataaatcaatattcaagtacaagaagacgattaaacaccaagcaggtttaacccaaataagaccacctcaaaacatttaataatcaaactcccaaaggataaagatttttgaaaggactctaaaagcaggaagagaaaagaaacaacaaacaatggagctccaatatctccagcagcagacttttcagtggaaaccttagaggccaggagagagtggcatgacatatgtaaaatgctgaaagaaaataacttttatcctaaaatagtatatctagcaaaaatatccttcaaacatgaaagagaaataaagactttctcagacaaacaatagctgagggatttcatcaacaccagacctgtcctgcaagaaatgcaaaggaagttcttcaatctgaaagggggacattaatgagcaataataaatcatctgaatgtacaaaatgcactggaaatagtacacaaacaaacacaatattataaccctataattgtggtgtgtaaactattcatatcttgagtagaaagattaagagataatctatcagaaataataactacaacaactttgcaaaacagacagttaataagctatgaatagaaacaacaaaaagtttaaaagtagggggataaagctaacgtgtagcatttttattagttttctctttgcttattagtttattatttatgaaattagtctgttttaagttatcatcagcttaaaataatgggctgtaagggattatttgccagcctcatggtaaccaaaaatcaaaaaatatataacaaagacacaaaaaagaaaacacataaaattaaaacataccacctgaggaaatcacgtttgccaaaaggaagacagaaagaaaagaaggaaggaaaagaagaccagaaagcaacccaaaacaaatcaaaaaatggcaagagtaagtccttacttacggatagtaacactaaatgtaaatggactaaactctctactcaaaagacatagagtaggtgaacggatttaaaaaacaagacccaacaatctggtgcctacaagaaacacactttgttactgaaacaccagggcttctgtctaggtcctgctgcttgccacagagaaagtcaatcactgagaccatgagtattgccaaggaagaagattttaattgggtgctgcagccaaggagatgagagctcagtctcaaatccatctctctgactgactgaaactaggggtttatatagcaaggaagaaatgtaacaatgtgtaagaaagcaagaattagagaggggcaaggaagcaatcatgacaaatgaagcatctggcatcttattgtctggatgtagtgatctggtgagtttcagttctttaatactttttgtgagaggcctgaaggtcatttcctgaggaaggaactcagacaaaaataaatacaagtttcaagctttaagaccagaaggatcaatttttatgtctatcaaaaaagaactatctatgagactattgggtcagtttcaacttcatctataaggatgcatacacactgacaataaagggatggaaaaagatattcaatgccaatggaaaccaaaaaagatgaggagtcactatagttatatcagacaaaatagatttcaaaacagaaactataagaagagacaaagaaggtcattatataatgattaaaggggtcaattcagcaagaggatataacaattgtaaatatatatgcacccaacactggagtgtgttcggaatttattccttccggtaggttcttggtctccctgacttcaggaatgaagccatggaccttcacagtgagtgttacagttcttaaagatggtgtgtccggagtttgttacttcagatgttcagatgtgtctggagtttcttacttctggtgggttcgtggtcttgctgacttcaggagcgaagccatggacttggtggcgagtgttacagctcttaatggtggtgtggacccaaagagtgagcaacagcaagatttattgtgaagagcaaaagaacaaagtgtccacagtatggaaggggacccgaggaggttgccactgctggctcgggtggccagcttttattcccttatttgtccgcacccacatcctgctgactggtacattttacagagtgctgattggtccattttacagggtgctgattggtgtgtttacaatcctttagctagacacatagtgctgactggtgcatttttacagagtgctgatagtgctaattggtgtgtttacaatcctttagctagacacagagtgctgatcggtgcatttttacagagtgctgattggtgtgtttacaatcctttagctagacacagagtgctgattggtgggtttataatcctctagctaggcagaaaagttctccaagtacccacctgacccagaagcccagctggcttcacctctcaggagcacacagatatataaaacaaatattattacagctaaggagagagatagacctcaatacagtaatagctggagacttcaacaccccactttcagcattggacagatcatccagacagaaaatcaacaaagaaacatcagatttaatctgcactatagaccaaatggacctaatagatatttacagcacatttcctccaatggctgcagaatacgtattcttctcttcagcacatggatcattctcaaggatagaccatatgttagacaacaaaaaagccttaaaacattcaaaaaaattgaaatgatatcaaatatcttctctggctaaaatggaataaaaccacaaatcaataacaaaaggaattctaaagaccatacaaacacatggaaattaaacatgtttctgaatgaccagtgggccaatgaagggcctaagaaggaaattgaggccaggcacagtggctcaagcctgtaattctagcactttgggaggccaaggctggtggatcacctgaggtcaggagttcaagaccagactggccaacatggcaaaaccccatctctacttaaaaataaaaaaattagctggccatggtagcatgcacctgtagccccagctacttgagaggctaaggcaggagaattgcttgaacctgggatgcagaggttgcagtgagctgagactgcgccattgcactccagcctgggcaacagagagagactccatctcaaaaaaaaaaaaagaaaaaagaaagaaattgaaaagtttcttgaacaaatgaaaatagaaacacaacatatcaaaacctgtgggatacagcaaaaggttacaggaataagtgcctacaagaaaaaagtagaaaaacctcaaataaacaacctaataatatgtcttatacaactagaaaagcaaaagcaaaccaaactcaaaattattaggaaaaaaaggaaataataaagatcagagcagaaataagtgaaattgaaacaaaaaatacaaaaaaacaaagaaacaaacagttggttttttaaaaagattaacaaaatagacaaactattagtcaaactaagaaaagggagagaagatccaaataacatcagagatgaaaaaggagacattacaactgatgtcagagaaattcaaaagatcgttagaggctactgtgtgcaattatatgccaataaactggaaaacctagaagaaattgataaatccctaaccacatacaacctaccaagattgaaccaagcataaatccaaaacctgatcagactaataacaagtaatgagataaaacctgtaataaaaattctcccagcaaaggaaaatccaggatgtgatgacttcactgctcgattttaccaaacatttaaagaagaactaataccaattctagttaaactataccaaaatatagaggaggaggaaatacttccacatttattctgtgaagccagtattaccccccagacaaagatatcaaaaatagaagactacagaccaatatccctaatgaacattgatggaaaagtcctcagcaaaatactagcaagccacattcaagaacacaataaagattactcatcatgactaagtgggatttatccctgggatgctagaatggctcaacattatgcaaatcaatgaatagggtacattatgtcaacagaataaaggacaaaaaccatatggtcacttcagttgatgctgaaaagcacttgataaaattcaacatcccttcatgattgataaccctaaaaaaaatgggtatagaagtacatacctcaacacaataaaagccacatgacagacccacagctagtatcataatgagtggggaaaaactgaaagtctttcctctaagatcttgaacccaacaaggatacccactttcaccaatgttatttaacatagtgctggaagtcctagctagagcaatcagacaaaagaaagaaagaaagggcactcaaatcagaaaagaagtcacattatccttgtttatagataatatgatcttatatttggaataacctgaatactgcaccaaaaaactattagaactgatacacaaatacaatcaagtcaaggatacaaaatcaacaaataaaaatcagtagcatttctatatgccatcagtgaacaatcagaaaaagacattaagaaagtaattctattaacaattgctacaaataaaataaaatacctaggaataaacttaaccaaagaaataaaagatctctacagtgaaaactataaaacatgatgcaagacattgaagaggacacaaaaaagtgaaaagatattccatgtttatggattggaagaataaatattgttaaaatatccatactacacaaagcaatctatggctataaggcaatccctatcaaaataccaatgacattgtgcacagaaatggaaaaaataatcttaaaatttacatggaaccacaaaagacctagagtagtcaaagccattctgagcaataagaacaaaactggacgaataacattacttgatttcaagttatattacagaactatagtaaccaaaacagcatggtgctggcataaaaacagacacatagaccaatgaaacaaaatagaaaacccagaaataaatccgtacgtctaccatgaacttatttttgacaaaagtgctgagaacatacatgaggaaagaacaatatcttcaataaatgctgccgggagaactggcagcattccatatgcagaagaatgaaatagacccctatgtatcaccatatacaaaagtcaaatgaaagtggattaaagacttaaatctaagacctcaaactatgaaactacaacaagaaaacattggggaaactctccaagacattagtctggacaaagatttcttgagaaatactccacaagcacaggcaaccaaaagtgaacaaattggatcttgtcacattaaaaagcttcttcacagcaaaggaaacaatcaacaaagtgaagagataacccacagaatgggtgaaaatatttgcaaactactcatctgacaatagaataataaccagaatatataaggagctcaaacaactctattggaaaaaaatctaataatctgattttaaaacaggcaaaagatttgaatacacatttctcaaaagaagacataaaaatggtatatgaaaaggtcttcaatatcactgatcatcagataagtgcaaatcaaaactacaatgagatatcatcttacccaagttaaaatggcatttatccaaaagataggcaataacaaatgctggtgaagaattggagaaaatggaatccttgtacactgttggtgggaatgtaagttagtacaaccactatggagaacagtttggaggttcctcagaaaactgaaaatagaactattatatgattcagcaatccctctgctaagtatatactcaaaggaaagaaaatcaatatattgaagagacatctgcactcccatgtttattgcagcacaattatagctaagatttggaagcaacctaagtgttcatcaacaaatgaattgataaggaaaatgtggtagcaaagagataccatctcacaccagtcagaacagtgattattaaaaagtcaagaaacaacagatgctggcgaggatgtggagaaataggaatgcttttacactgttagtgggaatgtaaattactttaacattgtggaatatggtgtggcaattcctcaaagatcgagaagcagaaataccatttgacccagcaatcccattactgggtatatacccaaagcaatctaaattatcctattataaagatacatgcatgtgtatgttcactgcagcactattcacaacagcaaaaacatgaaatcaacccaaatccccatcaatgatacactggtaaagaaaacgtggtacatataaccatggaatactatgcagccataaaaaaggaatgagatcatgtcctttgcagggacatggatggagctggaagccattatcctcagcaaatgaacccaggaacagaaaaccaaacaccacatgctctcacttataagtggtagctgaacaatagaacacatggacacagggagagtaacaacacacactggggcctgcggggggagtggaaggaggcaggaagagcattagaaaaaaatagctaatgcttgcggagcttaataactaggtgatggcttgataggtgcagcaaatcaccatggcacacgtttacctatgtaacaaacctgcacatcctgcacatgtaccctggaacttaaaataaaaataaaaattaaaagaaaatgtagtgcatatgtacaatcaagtactgttcaaccataaaaaagaatgagatcctgtcattttcaacaacatgaatggaactggagatcattatgttaagtgaaataagccaggcacaggaagacaaacttcacacagtctcacttatttgtaggagctaaaatttaaaacaatgaattcatggaggtagagagtagaatgatggctaccagaggctgggaagggtagttgcagggggtggagagaatggggatggttaatgggtacaaaagtatagttagatagaaaaaataagatattgcatttgatatcacaacagggtgactatagtcaacaataatttattctaaattttaaaataacagagtacaattggactttttgtaacacaaagaaagaataaatgctgaggtattaaatactccattaccttgatgtgatgattacttgttgtatgcctgtatcaaaatatctcatataccccctaaatatatgcatctactatgtacccacaaaaaatttaaaatttttaaaaattaaactcttctggctgggcatggtggctcacacttgttatcccagcactgtgggaggccgaggtggtggatcacttgagctcaagagttcaaaaccagcctgggcaacacggtgaaaccctgtctctataataaatacaaaaattagccaaaggggtggcacatgtctgtggtcccagctgctcaaaaggctgaggcagaaggatcgcttgacactggaaggcggaggttgcagtgagccaagatcatgccactacactccagcctgtgtgaaagagtgagattctgtctcaaaaaaaaaattaaactcttctacttgtcaaaaagcaacattaaaaaatacaaaggcaaaccacagaatggaagaaatgttcacaaaacattgtgacaacaaaagacttgtatccagagtatataaacatctcctaaaactctatgcactgttttgagattataaaatggtaatgttttcttgttattatgaatataataaccttgtaataatcacatgtcatattccaatcacaatttaaataaataaaaaaagaaaaagagaataaagaatcccacgctgcagtatctcctctacatcctcccactgcttctactgaagatctaattgggaaacagagtatccacccttccttttccctggagaggcaaagaaaagtattttcaaagactgagaaagtaaatttaacaaacagaaagataaaattactaatatgagggcaagttgacattcctgaaataataaaaaaaagaagaaattggtacatggtacatattgaagacttctttaaataattggaagtaatttgggcaaaatgagaacaatcaaagaagagacgaaagaatatttatggtgaattaacaattattgaaaaccaatagattagctaaattggtgaaattaaaaatgaactgagcatgccatgtacatcaatgtccaaaagcagccattctctgtggggaaaggtgagtgttggctcttcctagagacaagaggtccttcataattaggttcacaggcactaattttagagtataaaatgcagcttgctgattaacacatgaaacagaattccaggctgaattattatttacatttaaaagcacctttttaaacctcttaaattaaaataaatgtatagtttattaaaatattataagatgatcacccctgcaaaccactacccagatcaagaagtataacttgacaaaacacagaagctgtgtctcaatcacaatcgtgtctcctcctctaaaaataaccactctccttatgtttaagcttccttgaaagttacatcactcaaatatatacccctgataatgatagttttggtttgcttgtttttatttttatgtgtcttttgagtcccttttagtctatacgccacacttctttttattttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccgtttaaccctgagtggacacagcacatgtttcagagagcacagggttgggggcaaggtcacagatcaacaggatcccacggcagaggaatttttcttagtgcagaacaaaatgaaaagtctcccatgtctacttctctccacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggccgaccccccaacctccctcccggacagggcggctggccgggcagaggggctcctcacttcccagtaggggcggctggccgggcaggggggctgacctcccccacctccctcccggacggggcggctggccgggcggggggactgacccccccccacctccctcccggacggggcggctggccgggcggggggccgacctccccacctccctcccggacggggcggctggccgggcagaggggctcctcacttcccagtaggggcggccgggcagaggcgcccctcacctcccagacggggtggctggccgggcggagggctgacccccccacctccctcccggacggggtggctggccaggcggggggctgacccccccacctccctcccggacggggtggctggccgggctgaggggctcctcacttcccagtaggggcggccgggcagaggcgcccctcacctcccggacggggcggctggccgggcggggggccgacccccccacctccctcccggatggggtggctggccgggctgaggggctcctcacttctcagtaggggcggccgggcagaggtgcccctcacctcccggacggggcggctggccgggcgggggggctgaccccccccacctccctcccggacggggcggctggccgggcggggggctgacccccccatctccctcccggacggggtggctggccgggctgaggggctcctcacttcccagtaggggcgaccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgcggggcccgtccgctcctccagccgctgcctcccgggcggcgctcgccggcctatacgccacacttcttatcgccctccttgtctgcaatttatttaagaaactgggtgatttaacccgtgaatttttttacagtttggattccaatgattgcataatcaaaaggtagtttaacatgtttcttgattctctgtggtttctttaaagtagttattggtctaagatgcttaaacttttaatacattgactttagacagcttcaactccatttgcaatagctactatgtgacctctgaatttttggtaggcaagaggtaaagcaattgcagcccagaacatcatgtggagccaggaaatgctgctaggagagagggtggctaagctgacagagttgagggcagttttcctggatcagtttagaggccatgtgcaaaacagaaaccttgcagcaggagggaatgacttatcaaagggaagtggtatctggaagtgtctaggaatggacagaagtcagtacttaacacaggttgactgggaaaatgctgggaagtaaatagagaaaggcaagtataccctgggttccttcaaagcagttcaggaaaatattctctaaatgatggtggttacatgcaacgtaaatgagttgatcaggaatgctccaggtccaccagcatgttaaacttttaatggttgagacgttatataatattttctggtaattcaaagtcttagcaaaactttgtggtaaggatatttgtcccatatttcagataactctaagaatgctaggaaaggggaatatgtcaacaagaaatgttacatgtatggctggatgctattttctattttttccctttccttcagtcaagcatgtggcctggtttatgcttccttacctcacagatatttcagaaagcggaagtatcagacagtaatccctatttatgttctcaaaagccaagcccataggagatttattaataaaagatttgtaaataagtaaaaaaggaaaagagagcttttaataggtggctgaaagggttagaaaaaaaaatgaaggaagaaaggaatttctccaatggtctacatacctttcccgcgcaaaatggaggaacagaaaagatcctgggggtctaagacttgggccagaagttctggaagtgccttgaagagtctataatattttaaaaagggatacatgcatggtgtggctagggacttaggggctaggcatggggttcccaaccttaggacatttcctaagcgtgttacggaagcagtctggggatctgaaagaactgtaggagtgggggacagtaaatatcttaccagggactttctctgtgcatgcaacatctgaaacccctctccccaaccaaacctcaatgccttggccctaaataatcctccagagacttgggggtgtggttggggttagagaaagtctcaagcatgagaagtgagaagcttagaagcagcaattaggttgacacatgttctcacttataaccgggagctaaatattgaataacacatgaacacaaagaagggagcaatagataccagagcctacatgagggtagagggtgagtggagggtgagatttgaaaaactaccttttgggtactatgcttattacctaggtggtgaaataagctgtacaccaaaccctgcaacacacagtttacccatgaaacaaatctgcacttgtaccctcaaaacctaaaataaaagttggaaagaaaaaaaagaaagaacaaaattaagttgacttatttttaataggcttttattacacatcagagtttgtgggatgaaatctgtctccattacccaatgcaaaaatcactgggaaaattagtataacaaatgaccgcaaacacttacatagtacttactatgtattaggcgttgttctcagcttctacgtgtattaacacatttgatcttcacactacttactttagagaaagatgtcattattcctgatttaaagaggaggaaattgaagcaggctaacgttaaagaacatgcttaggattacactgcagctgacaagtggcagggtcagcattcagagtccatgtgggtagtcaccactccaagctttctctccaaaaccgctgactcaggcacactttttaggttaaagtaaatcaggacttatgaagtgaaatgtcagttttctaatggaggaaccagatccaaaatataaaaccctctttaagataatttttaagatgagcaggtgccagctgactcctccttcttgataatgcttaggtgctttggaaactcttcctggatgagaaagagattcttgtccctcttcatctgctgcaaaggacaaagccccagaagaataatatgccaaagtcggccttaacatctatcatccctataacctcatctccctggtgctctgaccttcactgggatggtataaagcagaggctctagagtatccctggaaatgaggagcagcgtacactaaccagtttggtttagagtaattctctcctatttgtaatttttatgaaaaacaatttaaatatggccttggactcatgatattttttatgtcacaataaagtggaaatttaaagttacaaatccccaaaaaggtcctccatcaactcctcataggatgtatccatttttagctctgattattgcagttaactttccaaagtgctgggattacaggtgtgagccaccacgccagcatatttactgtgaaagtttaaaatctgatttgaaagctgcttattataagcaatataattttttctttaacggccccagaatgtttaatgttacataatatgaatatatattttcaaatgtaaaaaaaagcctttttatatataaacatgtataaaagaataaatataaataagaaattaattggggtggcaaagtacatttaaaattttgtgatgtttttgtcaaaaacgatttgaacaaatttataggaaaaaaacaaacaaccccatcaaaaagtgggcgaaggatatgaacagccacttctcaaaagaaaacatttatgcaaccaacaaacatatgaaaaaaagctcatcatcactgtcattagagaaatgcaaatcaaaaccacaatgagataccatttcacgccagttagaatggtgatcattaaaaagccatcattctgagcaaactatcgcaaggacagaaaaccagacaccacatgttctcactcataggtgggaattgaacaatgagaacacctggacacagggcagggaacaccacacacccgggcctgtcgtggggtcgggggacgggggagtgatagcattaggagaaatacctaatgtaaatgacgagttaaaggatgcagcaaaccaacacggcacatgtatacatatgtaacaaacctgcatgttgtgcacctgtaccctagaacttaaagtataataataataataataataataataataataataataaggcaggaagcaacagatgctggaaaggatgtgaagaaataggaatgcttttacactgttggtgggagtgtaaattagatcaaccattgtggaagacagtatggcgattcctcaaggttccagaaccagaaataacatttgactcagcaatcctattactgggtatatacccaaaggattttaaattattctactctaaagacacatggacatgtatgtttattgcagcactattcacaatagcaaagacttggaaccaacccaaatgcccatcagtgatagactggataaagaaaatgtggcacatatacatcatggaatactatgcagccataaaaaaggatgagttcatgtcctttgcagggacatggatgagttggaaaccatattctcaacaaactaacacaggaacagaaaaccaaacaccacatgctctcactcacgagtgggagttgaacaatgagaacacatgggcacagggccgggaacatgacacaccagggcctgttggggggtggagggctaggggagggatggcattaggagaagtacctaatgtagatgattggttgttgggtgcagcaaaccaccatggcacatgtatacctatgtagcaaacctgcaagttctgcacatgtatcccagaacttaaagtataatttaaaaaaaaacagtttgaaaacttccctgaagtaaaaaaagtatcctttgaggaacaatgtaacgatgagctcaagttccacaggaaagagaaaattaaaatttataaagaatttataaatatcaaactattttcatgttttccaggaaaagtgtggctttctcattcattaaccaatagcataatattttccaggaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaacagaaattttgtagaagtaataataagatgaaatactaaataccttttatgggttttttttttttagccatttcagttaccctgcaattaaagaatgccaaaaatatctttatttgcagaatttcttattacttataaattaaatacctgataatgccctccatggcattaaatctgagattatggctctatctgcgtacatattccagtgggaattgcatgactacataaagaattaaaagaaagtgatgtgctgtcatctactgcttgcagacctgagctaaagtcgtttgctgtagcactgtgactacatagcctattcatttcaggtaaaaatagtacagctggcttgtcctttttagttcatgattaaataaacttcctctttttctaaaatggaaatacctggaataaatgcactggcacttttctatgtcttttactatgaatataaaacataaagcaaataacaagtcatctaaatctactttggtcagtgtgttgcaatattacctgacagacacattgggcctcctccaattctaaaatctatcccagctaagccacccatatacactttcactgtagcaggacaaaggtaggagtacatgtcaaatttgggaaactttttaagaagcttaatgaggtgcagtgatcaaatgacagaatatattatctgaagaacttcattggagactattactcattaaattaccagttgcagccgggcgtggtggctcacgcctgtaatcccagcacttcgggaggccaaggcaggtgcatcacctgaggtcaggagttcgagaccaagctggccaacatggtgaagccccatttctgctaaaagggcaaaaattagccaggcatggtggcacgtgcctgtaatcccagctactcaggaggctgaggcaggaaaatgacttgaacctgggaggcagaggttgcactgagaagagatcatgccactgcactccagcctaggcaacagaatgagaccctgtctcaaaaaaaaaaaaaaaattaccagttgtgctcttggggaaaaaaagtaaaagttgaaaaactgtgtttacaccaaaggccactcatcaggatatgagaatgaaattgcgtctcccagaatccctgtggcttctgtgccagactgtaccctggggccaggaggctgcaggtgggacctgaagccctgggtgtggcctgagaaggagtgattgctctagtcacatggaggagtacaccattacaaaatcaagagtgatggtaggaggactgaaagtttgtacattcttgcatactcctaagtaggtgaccgttctcaacctctgctcctagtctgtcatccacagcctctccccatctcttcactcttctttgtagggagaagacattgatttgcctcctttccacctccgtgtttttagtccttcaatctaacccctctcaacgtttctagaatcttgcttcttacacccaacctccctctgcaacttcctttctccctccccatcccaacacttttcctcctcattcctctttaatctcacctattactttgctcaagtcccttggacacaaaaatcaacttcctctggccctacttccccatcaagctcctacttcatctctcccttaactcccttacctgggtttctccaatcattaatccactcattctgcctccacttttcaccttccactgacttttctatccttttccatctgagtatgccctagttctccccaaacttatctcccaaaggtcattggagacttgcccatagtccttctctgcatctctacctgtcattttctcatgagttacaacagctaaccatccctttcatgtttaagcccataccttccaggatattttgctctcctggttctccaactaactcctcatctattctttgtctcctttccttcctcctgaggttttgtcctcagcaatcacctcctatatctccatattccatcccaacttcggccatttcaacaattagtttcatgcctgtggctcctaaatttgtgactttagtcctgatctttctctttctcaaactgcagacccatgagttacatctggtgagcctctccctatgaatatttctttagtacctcaaacacagcctttctatactgaactcaagataattttcccacactcaagccttctcctctttctaccttctcagtctcagataacagaattaccatgctttttatcattcctattagatgaatgtaattctctctctttgcctcaggtctccaacatccagatagtcctgaagtcttgtccatttacctcacagaaacatgtgtttaggccacttgctctccaataagttggtcctctcccctagatcaaatgttatttgatccacctgcctctggattctcccacctgcaactcggcccccacacatctcccagtgtgagtttctcactgaggcatctccagactagcagcattagcagcacctgagaatttgttagaaatgcaaagtcaagggccccattcaagacctactgaatcaaaaactaagagtggagcccattaatctctgttttaagaagccatccaggagattctgatacaagctaaagtttgagtcactattttagagcatacagtagatttttaattgcattgttcaaaatcctttactctttccctatcaatataaaataaattaatagtccatagtatagcattcaaggcctcttactttgtggccccaaactatctttgcagagttatatctcaccacttcttttcacctacttcatgctccagaaaaatgtgagtattacctgtgctttctaaactcccctaacatttgatcccattgcttcagaaacctggcctccatggcttcacatctttcttccaccaaatcttcatatgcagctcaaatgcagtctcttctaaaaagtcttcctgagatacttcttccttccctgtccctatggaagtcttctctcccagctctatgctcccatataacttcacttgtatctctaatactatatgcatcctatcttctagtgcatttgtttgtgtatttgtgctgtcttccctagtagattgtgagctccttgagggcagggactgtgtctgtttcctctctgtatctctagggactcataccatgttttacacacagtcggcactcagtgtctgttaatgtgaatggaattaagtccctggaggagaaaatataaatgtgtcatcttttctcagtgagaaaacaaaacttccaaagtccatgatgcaatactgacctttttttttttccaaatcttaccctgacattccaggtttgtttcgaaaaattctgggaaaaacttatgtatggaaagaaaataaatttctcattgaatataagtgaatattctttattaattaggattccagataagctgttctcaaaagagggaaaggaaaaaggagagattcgatacaaggagacaaagaataatctctgccacaaggggatattggtttctgtatgagcaactcaaatattactgggaaagtcacatggctgcccagctaagggtgatctgtgtacaaggatgttggcatctaaattacaggtgattttaccaagattgtgcctatgctcaaaattcagtatttattatgactgcaatatctagaaagtatatgagccactcacactgctttcccatcatcctccagatgttatctttgaaaattcttggcaattataagagttttaaagttttaagagtctaagtaaataaaaagcaaaaagcagatacataataatttttacttgcttattttcattaactcatttcctaatcactaggtaaatcctaattaaatacatttatctcacagctgcctctgcccttagcaaagaagttgcatatatttcctggtataaaccaaacctgttgaaaaataatctattgtttgctttgcttattgagccaatagtgccagctgccactgactactattgtcccctttaaactaaaacttgaatgaagtaatagtaccttttaataagatcagtgtttctcatgcaaacattagtatgctaaaagtaaaccctagggatggcattttgattgcctccattagaaattaggacttcttagctttctattcttggtgaaagaattcttgaatataagtcactccctggtagagctgacaggtcctttagttacaacaggtggcagtaagaacccccatcagcattgctaccatggtctgctttgggtaacactacaggcctcctatactttcggacttcagttttcaaactctgataattacgtatgaggtaagttcctaaacaagttccagcaattgcactggcttccagcacaacgcattttagcttcaaccatcacactggtcttggtctactaatgtgtgtgtgt

SEQ ID NO: 350 - DNA, 3392 bp, Homo sapiens
gttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaagaaaaaaaatggaaaaaaaaaaagtttatggctgaaacagtgtaattgattaaaaagtgaaaatccaggccgggcgcggtggctcacgcctgtaattccaacactttgggaggctgaggcaggcagatcacctgaggtcgggagttcgagaccagcctgaccaatatggagaaaccccgtctctactaaaaatacaaaagccaggcgtggtgggacatgcctgtaatcccagctactcgggaggctgaggcaggagaatcgcttgaacctaggaggcagaggttgcagtgagcagagattgtgccattgcactccagcctgggcaaaaagagcgaaactttgtctcaaaaaaaaaaaaaaaaagtgaaaatccaggagttagtatgtctgcttccaaaaagattagatagatacattttttcctctcagtaagtacagctaaactccttggtcacataaacaaacacaagactctgaaaggtagagataagacggaagactatccctggaccttgggatctgaggaaggactctggtagttattccgtggcttttctttttgtctcaaggttgagtgctggcttcggaaggccaaggcgggcggatcaggaggtcaggagtttgagaccagcccgaccaacatggtgaaaccccgcctctactaaaaatacaaaaattagccgggtgtggtggcatgcggctgtaatcccagctactcaggaggctgaggcaggagaatcgcttgaacccgggaggcggaggttgcagtgagccaagatcatgccactgcatgggtgacagagcaagactctgtctcaaaaaaaaaaaaaaaaaaagatatgagtgctggagaagccaaccaatgggcacagacaagaaagcctgctctctctacctgcgttagtttcctagacctgccctagctagttaccacaactttggtggcttaaatgacagaaacttattctctcccagttccggaggccagaagtctgaaataaaggtgtgaacaggatcacacctcttctgaaggctctagggaggttctatccctggtggcgtccagcttctgttggctttaggcaatccttggcttgtgactgcatctctgcccctgggtcatattgctgccgctttctctgtcacatctctgctgtgtatctcttacaagaatacttgccattggatttagagccaatttgaaaaatccagggtaagcactttgtctcaagatgtttcatgtaatcacagtttgccatatgaggtaatgttcacaggctctggagattatgatgtggacatcttcttgggggccaccattcagcccactacagtccaccctctggcaccccaaaatccatatttgtcctacatgaaaaagacatttattcctcccaacatctcccaaagtctcaactcatacagcatgaactaagaccaaatttgcatctatatattagctcagaagtcctgcatctcatcatctaagtcagatgtgggtgagaccccgtgcatgattcattttaggattaaatttctctggctgtggacctgtgatactacaggttatcagcttccaaataactttggaatttggataaataaatttatttaaaatgatgtaataggcatatgatagatgttctcattctgaaagggaaaattggaagggataaagaagtcaccattcccaaccaattttgatctagcagagaaaattccattaggattcaaggcctgcaaataattccctagcttgaagtgccgcccactgggcccacaacagttgtgcagacctttgtgtctgctcacagcagaaccatgggcctctctgtacccatggtggctccataggcctctgagtctgtgctcacagtgacctcataggcctgtgtctctgcatccatcacttctgtctgctcctctggcctctgcctctgtgcccctggctctgcccttggagtcattcttgctttttcttgaaggatcgcatgtttgcagcccagtagctctatcagcccatttcttgcccgtagcagtttggatttcaacagccttttctcatttcacactgtctctgtcacttccaggctaagctgtctctgctgatgtaacattctcaaaaatcttgtgggtcccctgtgtaatgtcatggagttcaatgccattagacaagagggtcctccacaaattttctgggataatcccatctctattcctgacttctactgagatggttgaatgagtccaagagtcccatgcttcatctcttcgtgccaccacacccagtacatttttcttatttttgtaaaagagatggggtctcgccatgttgcccagtctggtcttgaactcctgggctcgatcctcctgcctccacctcccagagtgctgggattacaggtggccgtgtttgacacttcagcaaaactgcaatttaagttattaactttattgagtacttacgtggaaacaaaaattaagtcccttctcccgtggagctggcattgcacattggtgggaggaggagtgagcagggagtgcataatgtgcaaccacgtgtgaatatttccagtccttcttagtactgtgaaggaaacacacaagtaaaaacctgggcctggtccaggaacgtgacaagggtgtgactgccaggctgggacctgaatgatgagaagaaggcagccaggg

SEQ ID NO: 351 - DNA, 69345 bp, Homo sapiens
ttctatctgtatctgaaaagcaatcaaccaccacaatcgatagccatgaaaacaatcttctctcttccagtctcctcctcatctcctgccatctctcctcaccctcaccacccaagcttcctgagtgcattctcttcacccccggctggcctccagcttccctctccacctaggggcactgggttctgggttctcttttcacccacgtgttcttctttcctgaaatcacccagttctgtggcttcagctaacacttctacctctccctctttagacctcactctcagggttcaagactacttctttaaaaaagttttcatttattaaaaaatatataatacatacacttggttcaaaattcgaaagggtgcggtagctcacacctgtaattccagcactttgggaggtcaaggcaggaggattgtttgaggccaggagtttgggaccagcctagacaacataatgagaccccatctctacaaaaaatgcaattagccaggcatggtggcgtgtgcctgtggtcttagctattcaggaggcctcccaaagtgctggggttacaggcatgagccactgtgccctgccagtctttctaaaatacaaaacaaatcatctcacttccttttctaagaaccttctgtggctccccattgcctacagataaagtcgagctccttattggagtagaaaggcccttgcccgctgctctttgcttgatgccaccgctgtgtctccatcgccgtcacatacgtttgtccctgtagtgctgtttccatcaaacggcattcctggattctgccagaatccttttgaggcccttgtcccatatatcagtaggagtctcaactgggaccaaaagcacattccagtaatgtaactgcccaaggggttcaccttgcttgctgcctagacagagccgattcatcaagacagcagaattgcgatagagaaagaataattcacacagagccagctatgcaggggaccagagttttattatcactcgaatcagtctcctcgagcatttgggggcagagtttttgaggataacttggtaggtcgcgggggaagccagtgagctgggagtgctgattgatcagggatgaaatcatcgggagtcggagctgtcttcttgcgttcagttggttcctgggtgggggcagcaagatcggatgaaccagtttattgatctgggcagtgccagctgatccatcaagtgcaaggtctgcaaaatatctcaagcactgattttaggagcagtttagggagggtcagaatcttgtagcctccagctgcatgactcctaaatcataatttctcatcttgtggctaacgttagtcctacaaaggcaatctagtccccaggtaagaaggaggtctgctttgggaaagggctgttacgatctttgtttaaactataaactataaactataaactaagtgtctcccaaagttagctcagcctacacccaggaatgaacacggacagcttggaggttagaagcaagatggaatcagttaagttagatctctttcactgtctcagtcataattttgcaaaggcggtttcagtaagatttatttacaaagaggggggtttatttataaagggagtaattataaagctgtgacaggcctaagggagccatcagggactttccaagccctgggcaagcaggtctgttgccacccctgggtttatgggttgaggagagggagagctcaccagggtctggagagagtcatgtggagctggcttccttctgaggaacagttggtcttttgtgaaggacatagctgtccccaaacaacctcaatgggagaacacccggacctcactgccctcctccctctagtcttctgttgagccccctcatctgccaaatccaatgggaatccagagggcaacagagtcctggtgatggggtccctgcaggttgacctcccaggccacagagctgagcggcaatgggtagaaagtggatttggggatggggcagaaggcagaggagcacattccacatcactttatatgtgtgtgcccttcccttttctagaatctactccttttgtatatctggcaaatccttccttccttccttccttccttcctcctttgctttcctttcctttcctttcctttcctttcctttcctttcctttcctttcctttttttcttcctttcttccttttcttcgaagtcttgctctgtgacccaggctggagtgcagtggtgcgatctcagctactttttgtatttttaatagagatagggtttcaccatgtcagccaggctggtctcaaactcctgatctcaagtgatccacctgcctcagcctcccaaagtgctgggattacaggtgtgagccacctcgcccagctgggcaaattatttcctgttcttcaagattcagtcaaacatcaccacattccctgattcccttgggcagaattaacgaaaattttccataccactttgtccttgtttatttacttatttatttatttttaagagacagggtctttctctgtggcccaggctggagtgcaatggcgtgatcatagctcactgaagcctcaaccttttgggctgaagtgatcccccaccctcagcctcctgagtagctgggactacaggcatgtgccaacatgcctgactaatttttaacgtgtgtgtgtgtatatatatatatatatatatatatatatatatatatatatatatgtttttaacgtgtgtatacatatatatatatacacacacgttaaaaattatatatatattatacataatttatatatatatttaacatctatattttttatagagacggggtcctatattctcattgttcagcagagggctgacatgcaaaaaaacccaaaacaccaagtgtcaaattacttgattcatactcttttccccttccccagggtgtcctcaagaggatagtgacattgccttcttgattgatggctctggtagcatcatcccacatgactttcggcggatgaaggagtttgtctcaactgtgatggagcaattaaaaaagtccaaaaccttggtgagggcccaggggtaggttagggaagagcccacacggggctggaagatacatggcaaccgggccaccatgttctcctcccagttcaactgcagacattgccaaattgacgatcgattatggtttgccttcctgagtctcttttctgctctgttggatgcagcctcagcattctttcagccttttataaagcgggcagctctaattgttaaggttggcatgggagatgaagcccacgtgtcattgctggctgagttctattttcatttttatttcttatttttttgagacagaatctcactctttctctcaggctggagtgcagtggtgtgatcttggctcactgcaacctccgcctcccgggttcaagcaattctcttgcctcagcctcccgagtagcggggattacaggcgcatgccaccatgcctggctagtttttgtatttttagtagagacggggtttcaccattttggccaggctggtctcaaactcctgacctcaggtgatccacccgcctcggcttcccaaagtgctgggattacaggtgtgagccactgctcccggccgctggccgtgttctagtattgaggagagatgggagctgctggcagctctccgtcctggtgaggcaggggattaggggcagcacagaggaggaatttggagagtggagtgtttaagatcttcgtggagcttgctgggagatgtctgaggggtgggggcaccttctccagcatcacaccagccgccccctccgcagttctctttgatgcagtactctgaagaattccggattcactttaccttcaaagagttccagaacaaccctaacccaagatcactggtgaagccaataacgcagctgcttgggcggacacacacggccacgggcatccgcaaagtggtgtaagcttccccttttcccttaggatggagggaggaggagacacttttagctgggctttgatggatgaagggagccgttcagacaggggtggtagaggatgcttccccaccggcagaggtggggaggctgtgcgtggtgtgttcatcaaaggacaagttgtgagtgaaaggtgggagtggagtggggaagtgagggaaaggtgtctggagggaagctacaaagatcagctcaggccagggagccaaaggcagctttacagcctgtggtgagatatcgccatgtctcattttgggaagttcactctgattttgaggtgggtgtagaggcaaggatggggttgggacagaagtacaagaagcactggagagtcctagaggggctggggagctggtgcagtgctctgggagaggtttcctgaaggccaattaactatatatatatatatatatatatatatatatatatatatattttttttttttttttttttttttttttttttttttttgagacagagtctcactctgtcacccaggctggaatgcagtggcctgatctcggctcactgcaacctccacctcctgggttcaagcaattctcctgcctcagcctcctgagtagctgggattacatgcgtccatcaccaccatcagctaatttttgtatttttagtagagacagggtttcaccatgttgaccaggctggtcttgaactcctgacctcaggtgattcacctgacttggcttcccatagtgctgggattacaagtgtcagccataaatatatatatttttaaaattcaaaagtaataatactcagttaaaaaacccaaattatgcgaaagtataaaaacaaaaaccgtgaaggcttcctttcccttccctgctgcttttccaggtctcggggcagttgcatctcagtgctaagtctcaggggagacggagcccctccgagacctcgcctagctgtatctgtgtctgggactctgctgacatttcctttctgacgttaatagcatctctggctaggtgcagggtctcataccagtaatgtcagcactttaggaggccgaggtgggaggatcacttgaggccaggagtttgagaccaattgacaacatagtgagactctatctctaaaaagataaaaaaataaaccaagtgtggtggtacatgcctgtagtcccaggtactcaggaggctgaggcaggagaatcacttgagcccaggagttcaagtctgcagtgagctatgattgtgtctctgcactccagcctggataacagagtgagtgtctatttcttaaaaaaaaaaaaaaactagtgtgtcatctacttgcatttgactttgtccctcctgtttcctgcacagacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtagggaatgcagctctcaggttgatgcttctgtggagggtttctatgtggatccatcctcccttcaatttgcaaatattattaaaatcaaagtgacatgagagctaatgctagctcatatacaccgtatcagctatctgttgccacatcaatgctgtgtaataaactatcccaaaattcagcagcttaaaataataagtaagcctgtgggtcagcctgccaagagttctggtctcaatggccttcctcactgtcattagctacaggttggcaggctgctctgctgatcttggccaggctctctctgtttctgagggttgccagctatgtcatctgctggaccagatggccttgggtggaaccactggggtgacttggccctttggcaacctggctctcattctccagggctagcctgggcatgtcctcatggtgaaggcaggggagcaagagaacagtggagatgttgcaagtgcttttttacgcctctgcatcatgtttgataacatccatgggtgtcacgagcagtgcaaggttagcgataaccaggtccatgcaggtttgtgtttttccacaacatctttcgctgatgctatttcaatcacaaacgccacaagctgcatggaattcccaaggaggcagttcttcttagtgcatcctgttccctcagacactctggctcaagccacccacaagtcagtcaatattgcaaaccatatataatagtatacttaatcaatatataagttataggttaaacattccacagcaaacaaagtaacatttaacatcagaagaaaaagaaagaggagaaaggatgaatgaaaaggactcctggtctgggcccaagggtcctggtcctgttagtcttgcaaggcagagtctttgatacggcagagccctcggcagcaaatgccaggctctcatcatgagcgactgcgaggtgtgagttccaacagctgctttgagctgctgaaggcctgatctcttctagtcacagagctgtctggtgagaacagacagagaagaatgtgcttgtttgcatccttatctggttggatgtagtctttatttgtttattttatttatttatatttatttatttatttattttgagactgagtcttgctctatcgctcaggctggagtgcagtggcatgatcttggctcactgcaacctccacctcctgggttcaagcagttcttgtgcctcagcctcctgagtagctgggactacaggcatgcaccaccatgcctggctaatttttgttttgtattgttagtagagatggggtttcaccatgttggccaggttggtcttgaactcctgatctcaagtgatctgcccgccttggccttccaaagtgtgggattataggcatgagccactgcacctggcctatttaaaaaatttgtttaaaacgaccttatccttgttggcaaagtgccctgtgaaatatagaatggagcctttttctaagatggagtcagttatgtcaagggtgctctgtatacaatgggctaaagcaagactcatgtctgagcccagaggcaatgaagggggcagatgactccaccaagagcaggagggcacagcagagtgctgggggaaagggcttggatacaggaagaggcaaggagtcaggatcatcagtgtaatcaaactactacagcacctgcatgacacagaaagcgatatcaccatggatacatgccttggcacgtaggacataccttcatataaagaaaaaggctccccttcctctagggggaggtcagctccataccaggagacgtggcacagcagatggatcagcagccgggtttctgccccaacttgcttccttggcacagtgccttgtgcagtgtacaacctgcccaactatacctggcaaccctgtcccagggaccttctgatgcatttcctcacttgataaataatggttcagactagtttcctgcagaattgtctttgccagatgatattgctagcctcacaccatgatttagcctctgttccttggtaacaggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtgagtcaggcatctgtgttcccagagcagctccagaggcagccccccaccccagaacatagtcccctctagaatccagaccttcctaacccttggtatcccccagcatcaactctctccacttcctacagctcccagtcccagcctcacttggtcaattcctttgaagtcaaagaatccatacttttatctgtaattttgcaaatcttggctataggctggtaaattggagtatgggggagtcaaatcccacccagtattttaacaaaaatttggatgtgttgccagctgtcgtctgttcggttctctgttgtatcccaattgcctagaatagtgcctggtactcagaaggtgctcaataaatgtttgttgaataaaaggaatttagaaattgggggatttcataaacagtctgggtttatggcttatcttgaaaagctggaagattagacaccttgaagaccgcattcccacttggcaggatgttgctggaggtgaatggctgccatccttctaagagggacgtatgctgtccagcttgacacagatcctgtcggagtctcctttgtctgtggccaccagagcacttgggttttcagtacctgttctaggttcttctgctttcttttcttttctttctatttttttttgagactgagtcttgctctattgcccaggctggagtgcagtggtgcgatcttggctcactgcaacctctgcctcccaggttcaagtgattctcctgcctcagcctcctgagtagctgggattacaggcgcataccaccacgcccagctaatttttgtatttttagtagagacggggtttcaccatgttcaccagactggtctctaactcctgacctcaagtgatctgcccatctcaggctctcaaaatgttgggattacaggcgtgagccaccatgcccggccttctgctttctttaatatagaaacttctcctctttacaggtactcagacaggaagtagcagctcctttgagcatgagatgtctcaggaaggcttcagcgctgccatcacctctgtaagtggcccttcattaaattgcgggggtggggcagggggtagcaagaagagataggagagatgtgggggtttggggactcttctctgtgatagatacttgggaagtagctctgtgaggggcagcggttgtcccttcttccttcctcatcaaccctgttctacacctttcccagaatggccccttgctgagcactgtggggagctatgactgggctggtggagtctttctatatacatcaaaggagaaaagcaccttcatcaacatgaccagagtggattcagacatgaatgatgcttacttgggtaagtggggagggcaagggttactctaagaaggggtgaggatttggcataagtcaactagcatagatgtctgggtcttgaatgaatgggatacatatgtatgggatactagctattagtctcttgggatagctttaaagacagaaacttcaatttttttttttgaggtggagtttctttcttgtcgcccgggctgtagtgcaatggcactcggctcactacaacctctgcctcctgcgctcaagcgattctcctacctcagtctcctgagtagctggtattacaagaatgcaccaccacccctggctaatttttttttttttttcgaaatggggtttcgctcttgttgcccaggctggagtgcaatggcgtgatcttggctcaccacaacctccgcctcccaggttcaagcgattctcctgccttagcctcctgagtagctggaattacaggcatgtgccaccatgcccagctaattttgtatttttagtagagatgggatttctccatgtcggtcaggctggtcgcgaactcccaacctcaggtgatccacctgcctcggcctcccaaagtgctggaattacagacgtgagccaccgtgcctggtctttttttgtattttcagtagagaccgggtttcaccatgttggccaggctcgtctggaactcctgacctcaggtgatccgcctgtctcggactcccaaagtgctgggattataggtgtgagccaccgcacccggccagaaacttctaaattgaattgtaattatgttcataaagagaaatatagcgtagggatcagttaccccaacacagcaagcgtggggctgccccagtgcccctactcaaggggtgggtctgcatggtggaggagggggcagggaatgcacttcacctctcagacccccaccttcaggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccaggtgagtgcggtttgtggagcatgaatgtgcaaacagaggcgccctggggtcttagagattccaggaggggcattcagatgacatgcatggccctcttgtaaaggaggctttgggggctgtgagctggggagttgtgggatcagcttagcatttgtgaatgctgtgtcctcagcttttttaacaatgataaataacaatgcttgcctgtacagagctctctatgggtctttctgtactcagggctggtattcaacccgtatataaccaggatagccatgttagttaataaaatattgaaacaattccgtattcattgataaatggtggattccccctcacccatgcactctggtgcttccccagtctctgtgggcttccccatgatccagcaactatgaggtcaggcaggacacttcacacaccctctaggatctgctccagccatgcccctgctcagtacctgtgcagctccagctgttcattattttgaatatcacccctgcaaaagcagcatggtcacatattatgtgggaactagcgagtgaggcaaaactctctagtcaaaatcattcttgcaaattcctgaaataggactgcacccatgatatggtgcctatagttctttattttatttttattttattatactttaagttctagggtacatgtgcacaacatgcaggtttgttacatatgtatacatgtgccatgttggtgtgttgcacccattagctcgtcatttacattaggtatatctgctaatgctatcccttccctctccctccaccctacgacgggccctggtgtgtgatgttccctacctggtgtccaagtgttctcattgttcaattcccacctatgagtgagaacatgcagtgtttggttttctgtgcttgcaacagtttgctcagaatgatggtttccagcttcatccatgtccctacaaaggacatgaactcatccttttttatggctgcatagtattccatggtgtatatgtgccacattttcttaatccagtctatcgttgatggacatttgggttggttccaagtctttgctattgtgaatagtgccacaataaacatatgtgtgcgtgtgcctttatagcagcatgatttataattctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacgtgttgtttcctgactttttaatgatcaccattctaactggtgtgagatagtatctcactgtgattttgatttgcatttctctgatggccagtgatgatgagcattttttcatgtgtctgttggctgcataaatgtcttcttttgagaagtgtctgttcatatcccttgcccagtttttgatggggttgtttgattttttcttgtaaatttgtttaagttctttgtagattctggatattagccatttgtcagatgggtagattgtaaaaattttctcccattctgtaggtggcctgttcactctgatggtagtttcttttgctgtgcagaagctctttagtttaattagatcccatttgtcaatattggcttttgttgccattgcttttggtgttttagtcatgaagtccctgaccatgcctatgtcctgagtggtattgcctaggtttccttctagggtttttatggttttaggtctaacatttaagtctttaatccatcttgaattaatttttgtataaggtgtaaggaagggatccagtttcagctttctacatatggctagccagttttcccagcaccattattaaatagggaatcctttccccatttcttgttttttcaggtttgtcaaagatcagatggttgtagatgtgtggtattatttctgagggccctgttctgttccattggtctatatttctgttttggtaccagtaccatgctgttttggttactgtagtcttgtaatatagtttgaagtcaggtagcgtgatgcctccagctttgttcttttggcttaggattgacttggcaatgtgggctcttttttggttccacatgaactttaacgtagctttttccaattctgtgaagaaagtcattggtagcttgatggggaaggcattgaatctatgaattatgttgggcagtatggccattttcacgatattgattcttcctatccatgagcatggaatgttcttcaatttgtttgtgtcctcttttatttcattgagcagtggtttgtagttctccttgaagaggtccttcacatcccttgtaagttggattcctaggtattttattctctttgaagcaattgtgaatgggagttcactcatgatttagctctctgtttgtctgttattggtgtataggaatgcttgtgatttttgcacactgattttatatcctgagactttgctgaagttgcttatcagcttaaggacgttttgggttgagacaatggggttttctaaatatacaatcatgtcgtctgcaaacagggacaatatgaataccctttatttctttctcctgcctgattgccctggccagaacttccaacactatgttgaataggagtggtgagagagggcatctctgtcatgtgccagttttcaaagggaatgcttccagtttttgcccattcagtatgatattggctgcgggtttgtcataaatagctcttcttagtttgagatacgtcccatcaatacctagtttatttagagttttcagcatgaagggctgttgaattttgttaaaggccttttctgcatctattgagataatcacgtggtttttgtctttggttctgtttatatgatggattatgtttattgatttgcatatgttgatccagccttgcatcccagggatgaagcccacttgatcatggtggataagctttttgatgtgctgctggattcagtttgtcagtattttattgaggatttctgcgttgatgttcatcagggatattggtctaaaattctcttttttttgttgtgtctcttccaggctttggtatcaggacgatgctggcctcaaaaaatgagttagggaggattccctgtttttctattgactggaatagtttcagaaggaatggtaccatctcctccttgtacctctggtagaattcagctgtgaatccgtctggtcctggactttttttggttggtaggctattaattattgcctcaatttcagagcctgctattggtctattcagagattcaacttcttcctggtttagtcttgggagggtgtatgtgtccaggaacttatccatttcttctagattttctagtttatttgtgtagaggtgtttatagtattctctgatggtagtttgtatttctgtgggattggtggtgatatcccctttctcattttgtattgcgtctatttgattcttctctcttttcttctttattagtcttgctagcggtctatcagttttgttgatcttttcagaaaaccagctcctggattcattgattttttgaagggttttttgtgtctctatttccttcagttctgctctgatcttagttatttcttgccatctgctagcttttgaatgtgtttgctcttgcttctctagttcttttaattgtgattttaaggtgtcaattttagatctttcctgctttctcttgtgggcatttagtgctataaatttccctctacacactgctttaaatgtgtctcaggattctggtatgttgtgtctttgttctcattggtttcaaagaacatctttatttctgccttcattttgttatgtatccagtagtcattcaggagcaggttgttcagtttccatgtagttgagcggttttgagtgagtttcttaatcctgagttctagtttgattgcactgtggtccgagagacagtttgttataatttctgttcttttacatttgctgaggagtgctttacttccaactatgtggtcaattttgtaataggtgtggtgtggtgttgaaaagaatgtatattctgttgatttggggtggagagttttgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctgtgtaggtcactaagcacttgctttatgaatctgggtgctcctgtactgggtgcatatatacttaggattgttggctcttcttgttgaatttatcggtttaccattatgtaatggccttctttgtctctttgatctttgttggtttaaagactgtttcatcagagactaggattgcaacccctggttttttctgttttccatttgcttggtagatcttcctccatccctttattttgagcctatgtgtgtctctgcacgtgagatgggtttcctgaatacagcacactgatgggtcttgactctttatccaatttgccagtctgtgccttttaattggagcattgagcccatttacatttaaggttagtattgttatgtgtgaattagatcctgtcattatgatgttagctggttattttgctcgttagttgatgcagtttcttcctagcatcggtggtctttacaatttggtatgtttttgcagtggctggcactggtttttcctttccatgtttagtgcttccttcaggagctcttttagggcaggcctggtggtgacaaaatctctcagcatttgcttgtctgtaaagtattttatttctccttcacttatgaagcttagtttggctggatatgaagttctgggttgaaaattcttttctctaagaatgttgaatattggcccccactctcttctggcttgtagggtttctgctgagagatcagctgctagtctgatgggcttccctttgtgggtaacctgacctttctctctggctgcccttaacattttttcctccatttcaactttggtgaatctgacaattatgtgtcttggagttgctcttcttgaggagtatctttgtggtgttctctgtatttcctgaatttgaatgttggcctgccttgctagattggggaagttctcctggataataccctgaagagtgttttccaacttggttccattcgccctgtcactttcaggtacaccaatcagacgtagatttggtcttttcacatagtcccatatttcttggaggctttgttcatttctttttactctttttttctctgaacttctcttcttgcctcatttcattcatttgatcttcaatcactgataccctttctccacttgattgaattggctactgaagcttgtgcatgcatcacgtaattctcatgccatggttttcagctccatcaggtcatttaaggtcttctctatgctgtttattctagttagccattcgtctaatctttttacaaggtttttagcttctttgtgatgggtttgaacatcctcctttagctcggagaagtttgttattaccgatcatctgaagccttctcctctcaactcgttaaagtcattctccgtccagcttcgttccattgctggtgaggagctgtgctcctttggaggagaagaggtgctctgatttttaaaattttcagcttttctgctctggtttctccccatctttgtggttttatctacctttggtctttgatgatggtgacatacagatggggttttggtgtggaaatcctttctgtttgttagttttccttctaacagtcaggaccatcagctgcaggtctgttggagtttgccggagttccactccagaccctgttttcctgagtttcaccagtggaggctgcagaacagcaaatattacaaaacggcaaatgttgctgcctgattcttcctctggaagcttcgttgcagaggggcacccagccgtatgaggtgtaagtcggctcctactgggaggtgccccccagttaggctacttgggggtcagggacccacttgaggaggcagtctgtctgttctcagatccaagctgcatgctgggagaaccattactctcttcaaagctgtcagacagggacatttaagtctgcagaagtttctgctgccttttgttcagctatgccttgcccccagaggtggagtctacagaggcaggcaggcttccttgagctgcagtgggctccacccagttcgaacttcctggccgctttgtttacctactcaagcctcagcaatggtggacgcccctcccccagcctcactgccaccttgcagcttgatctcaaactgctgtgctagcgtgagcaaggctccatgggcgtgggaccctctgagccagacgcgggatataatctcctggtgtgccatttgctaagaccattggaaaagtgcagtattagggtgggagtgtcccaattttccacttactctctgtcacggcttcccttggctaggaaagggaattccccaaccccttgcacttcccaggtgaggcgatgacccaccctgctttggctcatactctgtgggctgcacccactctcctacaagccccagtgagatgaacccagtacctcagttggaaatgcagaaatcacttgtcttctgcgtcactcacgctgggagctgtagactggagctgttcctattcggccatcttggaacctcctctgcctatagttctttaaaaaaaaaaatttcaggcagggcatgttggctcatgcctgtaataccagtgtagcaggacaagctgcatacaaaacccctcagacaccgagttaaagaaggaagggctttattcagtcaggagctacagcaagactcacgtctccaaaaactgagctccccgagtgagcaattcctgtccttttaagggcttaaaactctaaacaggtccacgtgagggggtcgtgatcgattgagcaagcaggaggtacgtgactgagggctgcatgcaccagtaaacagaacggaacagaacaggacagagattttcacaatgcttttccataccatgtctggaatctatacataacataactggttaggtcatgagttgatctttaaccagacccagggtgcagcacagcccgtggatttaatttctgccttttagtttttacttctttctttggaggcagaaattgggcataagacaacatgaggggtggtctcctcccttaccagcactttggaaggctgaggcaggtggatcacctgaggtcaggagtttgagacgagcctggccgatatggtgaaactctgtctctactaaaaataaaaaatattaaaaaaagttagccaagcgtggtggcgtgtgcatctgtaatcccagctactcgggaggctgaggcagaagaatcacttgaacctgggaggcagaggttgcagtgagctgggatcttgccactgcactccagcctggatgacagggcgagacttcatctcaattaaaaaaaaaatttcaagttttagatttggggtacatgtataggcttgttacatgcatacattgcatgttgctgaggtttgggctgcagatcccatcacccaggtagtgagcatagtacctgtggtggtttttcttttttctttttcttttcttttctctctctttttttttttttagagacagggtctcactatgttgcccaggctggttttgaacacctgagctcaagcaacgttgcccaggctggttttgaactcctgagctcaagcaatcctcctgccttggcctcccaaaatgctgagattacaggtgtgaaccactgcgcctggcccaataggtggttttccaacccacacctcctgctcctccatctggtagtctgcagtatctatcattcccatctttatgtctatgtatacccagtgtttagctcccacttataagtgagaacatgcagtatttgattttctgttcctgtgccaattcacttaggattatagcctccagctgcatccatgttgccgcaaaggatgtgattcatttttttttttatggtggcgtagtatttgatggtgtatatgtaccacattttcttttccaatccaccactgatagacacctaggttgattccatgtctttctattgtgaatagtgctgtgatgaacatacgagcatgtatctttttgatagaacagcttattttcttttggatatatggccagtaatgagattgctgggctgaatagtagccctgttttatattctttgagaaatcttcaacctgctttccacagtggctggactaatttacattcccaccagccaacaatgtataagcgttcctttttcttcattgccttaccagcatctgttattgtctttttaataatagcattctgactggtgtgagatggtatctcattgtggtttatgatttgcatttctctggtgattagtgataatgaactttctttttcaaatgttttttggctacttgtatgtcttcctttgagaagtgtctgtttatgtcctttacccactttttaatggggttatttgtttcttgcttgttgatttgttgaagttccttatagattctggatttcagacctttgtcagatgtggtttgcaaatattttctcccattctgaaagttttctgtttactctgttgatagtttcttttgctctacagaaactctttaattagttcccacttgttgatttttgtttttgttgcagttgcttttgagggcttagccgaaagttctttgccaaggctgctgttgagaaagtatttcctaggttttcttcaatgattttaatagttcgagggctcacatttaaatctttaatccatgtgatttaagtctttaatcacatttaaatctttaatacaccttgagttgatttttgtataaggtgtaaggaaggggttcagtttcattcttctgcatatggatagccagttatctccacactctttattgaatagggagttctttccccattgcttgcttcatagtctttattgaagatcaggtggttataggtgggtggctttatttctgggctctctgttctattccgttggtctatgtgtctgtctttgtaccagtaccatactgttttggttactatagcctcatattcggatagtgtgatgcctccagctttgttatttttgcttaggattgcttttgctatttaggctctttttttgttccgtattaattttagaatagttttttctatctgtgaacaatggcattggtagtttgatacaaatagcattgaatctgcaaattgctttgagcagtgtggccattttaacaatattgattcttccaatccatgagcatggaatacttttccgcttatttgtgtcgtctctgatttctttcaacagtgtatttctctttgtagagaccttttacctccttggttagctgtgttcccaggtacttcatttttcgtttctgcctgtagttctgtgtgtttttaaaatttttgtcggtggttctctttgacttgtaattaatgcattgtatggggatgaaaccagtttctcctgatacctgaacagcttgtcataattctttgccaatagtcaaattcttcacgtggtctctctaaacacatactggccattgatggtgtcaatgcctgacatgtataagggatggggtggggaaaaaagtgtagaggaattacgggaagtcaagtgtggattggatgccacttctctgttttcggtgtgtggtcaggaccacatgaggaaggctggctggtcaactcccccaccccacacaagtacacgcacattaccatcaagggtgatagatgcttaaagtgggacagtctgggagttatgagagcaaatgggaggggcacccacagaaaggcagtatggaagccttcctggtggaagtggcagctaagccaaggcctgaggtggaagcacaagagaagtgaaaaggggtgtggggaagcaaggggccagaggagggagagagaatggaatggagggtcagaatatgcgtatagggtggtgggaggagtggtgggagaaaacaggaaagaagggtaggtgtggcttatcccagacatgcagggcttgttcaatatcccaaataccaatattgcagaaatggacaagctgatcctgaagtccatatggaaacagaagggacccatatattagacttatacctaaatgtttcatgacctttggcactattgtaaattgtactggtttttaaatttaaatttccaattgttggaacagaacagagccctcagaaataattccacatgtctacaaccatctgatctttgacaaacctgacaaaaacaagaaatggggaaaggattccctatttaataaatggtgctgggaaaactggctagccatatgtagaaagctgaaactggatcgcttccttacaccttatacaaaaattaattcaagatggattaaaagcttatatgttagacctaaaaccataaaaaccctagaaggaaacctaggcattaccattcaggacataagcatggtcaaggacttcatgtctaaaacaccaaaagcaatggcaacaaaagccaaaattgacaaatgggatctaattaaactaaggagcttctgcacagcaaaagaaactaccatcagagtgaacaggcaacctacagaatgggagaaaatttttgcaatctactcatctgacaaagggctaatatccagaatcatcaaagaactcaaacaaatttacaagaaaaaaacaaccccatcaacaagtgggtgaaggatattaacagacatttctcaaaagaagacatttatgcagccaacagacacatgaaaaaatgctcatcatcactggccatcagagaaatgcaaatcaaaatcacaatgagataccatctcacaccagttagaatggtgatcattaaaaagtcaggaaacaacacgtgctggagaggatgtggagaaataggaacacttttacactgttggtgggactgtaaactagttcaaccattgtggaagacagtgtggcgattcctcaaggatctagaactagaaataccatttgacccagccatcccattactgggtatatacccaaatgactataaatcatgctgctataaaggcacatgcacacgaatgtttattgcggctctattcacaatagcaaagacttggaaccaacccaaatgtccatcaacgatagactggattaagaaaatgtggcacatatacaccatggaatactatgcagccataaaaaaggatgagttcatgtcttttgtagggacatggatgaagctggaaaccatcattctcagcaaactatcgcaagaacaaaaaaaccaaacactgcatgttctcactcataggtgggaattgaacaatgagaacacttggacacaggaaggggaacatcacacaccagggcctgttgtggggtgggggaagggaggagggaaagcattaggagatatacctaatgtaaatgacaagttaatggatgcagcacaccaacatgacacatgtatacatatgtaacaaacctgcacgttgtgcacatgtaccctagaacttaaagtataataaaaaaataaatttccgattgtttagggatatagaaatacaactggccgggcccagtggctcacgcctgtaatcccagcactttgggaggccgaggcaggtggatcacctgaggtcaggagtttgagatcagcctgaccaacatggagaaaccctgtcgttactaaaaatacaaaattagccaggtgtggtggcacatggctgtaatctcagctacttgggaggctgaggcaggagaatcgcttgaatctgggaggcagaggttatggtgagccgagatcatgccattgcactccagcctgggcaacaagtgtgaaactccatccaaaaaaaaaaaaaaaaaaaaagaaatacaactgattcttacatattgatcttgtatccaaaacaatcttagaaaaggggaacaaagctggagggttcacactttccaattcaaaacttacaaagccatcaagccagaaagtaaattagtggtttccaggggctgggggttggactggggattggaaatactgctaacaggtagagaatttctttctgggaagatggaaatgttctggaggtagtggtgatgattacacaacattgtgaaggtactaaaacccagtgaaccttatactttaaaatggtaaattttatggtctatacatttaatctaaattataaaagctactttgaagaaaacaatgtgattcaccataacagcagattaaagaagaaaaaacatgtaaccacctgaacagatatagaactctaatttgacaacatacaacatcgtttcatgattaaaaatactctcagccgactaggaactaaagggaacttcctcaagctgaaaaagagcatttacaaaaaatctctaccaggcattatacttaaaagtgaaagagaatgcttttcacctaaaattggaaacaagacaagaatatctacttttataattcctatccaacattgtactgaaagacctagccaatgcaataaagcaggaaaaagaagaaaaaaaaatataaagaggaaaggaagaaataaaaccctctctatttgcagatgatacaattgcatggaaaattccaaagaacctataaaaaagctatgataataggttttttcagtaagttctcaggatataggagcaatgtataaaaattagttttatttctataatataattgaacaattggaaatttaaattaaaaagtaccatttacaatagcataaaataccatgaaatatttaggtataaatcaaacgaatcatgtacggtaactttatgctgaaaactacaaaacactaatgagagaaataaaagacctaaataaatggagagagacgctgtggtcatggattcgaatattatagttccaatattgttaagatgtcaattctccctgggttgatctacagattcaatgcagtaaaaatcctggataatattccattgtgcacatgtaccacattttctttatccattcatctgttgatggacacttaagttgattctatatctcgactattgtgaatagtgctgcgataaacacgggagtgcagttatctcttcagtatactgatttcctttcctttggcaatatacccagcactgggattgctggatcatgtggtagttccatttttagttttcttgaggagcctccatattgttctctatagtggctttactaatttacattcctactaacagtgcatgagggttcctctttctctgcatctttgccagcatccatcattgtttgtcttttcgataaaagcccttttaactggaatgagatgatatctcattgtggttttcatttgcatttttctggtacacaaaggaatattattcagccataagatgaatgaatcttgtgatttgcaataacaggattggaactggaggacattatgttaagtaaaacaacccgggcacagaaaaacaaatattgcatgttctcattcatgtgtaggagctaaaaaaaaatggatctcatggaggtagagagtagcatgatgggttactagagactgggaagggtagtaaggaggatggggtaaagaggggatggttaatgggtacaaaaatacagttaggaaaaataagacctagtgtttggtagcacagtagggtgactatagttaacaataatttattgtgtatttcaaaataactacaggaatggaattggaatgttcccagcaaaagaaatgataaatccttgaggcaacggatatcccagttaccctgatttgatcatcacacattgtatgcttgtataaaaatatcacatgttccctataaatatgtgcaattattacatattcataaaaaggtaaaaatcctagaagtatattttgcagaatttagccaattctaaaatttatataaaaaataaaaaagtagagtatccaaaagaattttgaaaagaatcttgatacataccattaagtagctgtcactttttatttatttatttaatttaaaaaaattagattgatattttataatttttcaacttttactttaggtttgagggtacacatgaaagtttgttatataagtaaactcatgtcatgggagtttgttgtacagagtattttgtcacccaggtattaagcctagtatccaatggttattttttctgctcctgcctcctcccaacctccaccctcaagtagaccccagtgtctgttgtttccttctttgtgttcataagttctttatagtttagctcccactaataagtgagaacatgcagtatttgtttttctgttcttgtgttagtttgctaaggataacggccttcagctccatccatgttcccacaaaagacatgatcttgctatttttatggctgcatagtattccacggtgtatatgtaccacattttaaaaaatcctatttgttattggtgggcatttaggttgattccatgttttgctattgtgactagtactgcaataaatattcatgtgcatgtgtctttatggtaggatgatatatattactctgggtatatccccagtaatggggttgctgggttgaatggtagttctgcttttagctctttgaggagttgccatactgctttccccaagtggttaaactaatttaccactcccaccaacagtataagtgttcccttttcttcacaacctcaccagcatctattttttaacttttactaatagccattctaactggtgtgagatggtatctcattgtggttttgatttacatttctctaatgataatgattttgagctttttttgtatgcttgttggctgcatgcatgtcttctttcgaaaagtgtctgttcatttccttttcccaccttttaatggcgttgtttttctcttgtaaatttgtttaagtaccctgtagatgttggatattacacctttgttggatgcatagtttgtgaatattttctctcattctttaggttgtctgttcactctgttgatagtttcttttgctcttgcatttaattagatgccatttgtcaatttttgcttttgttgagattgctttttgtgtctttgtcaggaaatctttgcttattcctgtgtctagaatggtattgcctaggttgtcttccagggttcttatagttttgggttttacatttaagtctttagtctatcttgagttgatttttgtatatggtgtaaggaaggggtccagtttcaatcttctgcatatggctagccagttatcctagcaccatttgttgaataggaattcttttccccattgcttatttttgtcttagatcagatggtcataggtgtatggccttatttctgggctctctattctgttccattggtctatgtgcctgtttttgtaccagtatcatgctgttttggttactgtagccctgtagtatagtttgaagtcaggtaatgtgatgcctccttctgtgttctttttgcttaggattgacttggttattcaggttcttttttgattccatatgaattttaaaatagtttttcctagttctgtgaagaatgtcattggtagcttaatagtaatagcactgaatctataaattgctttgggaagtgtgtccattttaatgatattgattcttcctatccatgagcatgagatgttttaccatttttttggtgtcatctctgatttctttgaacagtgttttacaattctcactgtacagatctttcaactctctggttagctgtattcctagttattttattctttttgtggcaatcgtgaataggattgccttcctgatttggctcccagctcttgttggtgtataggagtgctagtgatttttgtacattgatttcgtatcctgaaactttgttgaagttatttatcagctgaaggagctcctaggccaagactatggggttttctaaatatagaatcatgttgtctgcaaacagggatagtttgacttttttacttcctttcttcctatttgtatgcccttttttctttcttttgcctgattgctctggctagaacttccaataatatgttgaataggactagtgagcaaaggcatccttgttttgtgctggctttcaaggggaatgcttttgcccatcaagtatgatgttggctgtgggtttgttgtagatggctcttattattttgaggtatgttccttcaatacctagtttattgagaatttttaacataaaggggtgttgacttttattaaagccttctcttcatctattgagataatcatgtggtttttgtctttagttctgtttatgtgatgaatcatatttattgatttgcatatgttgaaccaactttgcaccccgggaatgaagcctacctgatcatggtggattagatttttgatgtgctgctggatttggtttgcaggtagtgtgttgaggatttttgcattagtgttcatcaagaatattggcctgaaattttctttttttgttaagctgacactttttagtttgatgccaccccatttgtctggtttgcttttgttgcctgtgcttttggggtcatatccaaaaaatcatttctcagaagcttgattgtcaagaagcttttccctttgttttcttctagtagttttacagtttcaggtcttgtgtttaagtctttaatccattttgagttgattttgtatatggtttgggataaaggtctaatttaatccttttgaatatgaatatccagttctccccacaccatttgttgaagagaatgtcctttctcctttgcatattcttggcacctttattgaagatcaattgaccataaatgcatagttttatttctagcctccctgttctgttccattggttgatgtgtctgtttttatgccaccaccttgctgttatgcttactagagctttcttgacacagtatgttttgagatcaggaattatgatgcctccagtattttttttcttgaggattgctttggctatttagggtcttctgtggttctacataaattttagttttttttctatttttgtaaaaaaatgccattgggattttgataaggattgtactgaatcagaagattgcattaatactccagtccatgaacataggatatctttccatttatttttgtcttgtttaacttccttaatcaatgttttatagttttagtgtacatgtttttcacctctctggttaaatttaagcttaggtattttttttgatgctattgtaaatgagattgtttcttgatttctttttcagatagttcattgttagtgtatagaagcactattgatttttcacattgattttgtaacctgtaactttactgaatttattcattagttctagtagttcttttttggtggagtttttagggttttttaaaaatatatttatatatatatgtttttatatatatatcattttaagtgtaaacagagacaaatttccttttttatatctgatttgggtctctttcatttatttttcttgcctaattgctgtgaccaggacttccagtactatgttacatagaagtagtgagagtgagcattcttgcctttttcctcattttagtggtaaagctttcaatttttcaccattgagtatgatgtttgttgtgggcttgtcgtatatggcctttatcatattgaggtacattccttctgtagcgaatttattgagagtttttattataaaagaatgttgaattttgtcaaatgcttttttttgcgtatattgagatgatcatgtggttttagtccttcattctgttaatgtgatatgccacattaattgatttgcatatgtggaatcatccttgcatctcgcatcccagggataaatcacacttgatcatggttattatctttttatcttttttttttttttttttaacagagtctctctgtgttgcccaggctggagtgcagtggcgttatctcggctcactgcaagctccacctcccaggttcacgccattctcctgcctcagcctcttgagtagctgggactataggcgcccgccaccatgccctgctaatttttttttttttgtatttttagtagagatggggtttcaccatgatttccaggttggtctcgaactcctgacctcaggtgatccacacgccctggcctcccaaaatgctgggattacaggcatgagccactgcatctggccggttatatgactttatatgtttgtcaaaactcataaaactatgtactaaaaggctgaattttattgtatgtaaactcttccccaataaatctgacctaaaaaacaatcaaattctgttgactttaggataaagtattcagttatcaatgagtcttccctcaatggtgtatgaggcagaaatcacgttgcagagccgtggcatgatgtcccctgcacattccctttctagaacttgtcccagtttgaaattgctatacacatctccctgttaatccattgattactctcctctcctccacctggctgcactgagggccctggaaggcactgtatctctattacccagctgtgtgcttagcaataagaaacacttgtttgttgaatgaatgaataaatgaatgaatgaatgtatgattaaataggtgaattttatggatgaattctacatattgaccttgaagatatttcttaatatcacaacaaatattcaaataacaaatagttatttttaatctaagccagttattagccttattagtcagagtgccaactttgactttttacctccctaaagattcccaatatattgaaagggtggtattctgtcttctcttctagaattttctatgtattttccaacccaaattcttctttgctgccttaataatctcccaggaataccacctggagtaaatcctcactcactgcccattgactctactataggcttattttttatcttttaaattattaaaaaatatatatatacacttagagattgggatcttgctctgttgcccaagctggagtgcagtggtgacaaagctcactgcagccttaaactccttggctcaagggatcctcccacttcagccccccgaggagctgggattacaggcagaaaccattctgccaggcttattatataggttcctttagctggcagcacattcaagtgataatttatcatgaaccatatagaagatcacatctgctccagagggattcccccagcaggcataacttttcttcagagagagaaaacctccacatctgctttaggtgggaagaggtgtgtgattacggtcctgtctctttcagatcggcgcctacttcggggcctccctctgctccgtggacgtggacagcaacggcagcaccgacctggtcctcatcggggccccccattactacgagcagacccgagggggccaggtgtccgtgtgccccttgcccaggggggtgagtggcaatgggacctgggctgggtggggcccggtgtgggtggaggggtcgcctgggttggggcctgatactgtttgtgtttagcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccaggtgagacctggtcactgtccttgtcatgacagtagcctctttgttgatctttctcctaattcagtgtgcccacagctgccagataagttctcacagtactcctttcagaaccttcaaaaataataacatgtggctgggcctggtggctgacgcctgtaatcccagcactttggaaggctgagttgggaggattgtttaagcccaggagctcaagaccagtcagggcaacatggtgagaacccatctctccaaaaaaaaaaaaaaaaaaaaaaaattagccaggtgtggtggcatacacccatggtcccagctactctggaggctgaggccggaggattacttgagcctgggaggttgaggctgcagtgagtcctggtcacaccactgtactccagcagccagagtgacagagtcagacttgcacatgcatgcgtgcacgtgcacacacacacacacattcacagaaatctcaaagactcttagttccagattgattatttctacagcaataggaggtgcatgatagcctcatcacccccactttacagatgagtagatcaaggcccagcgatggcaaatggcaagctagcagtattgggatgcaggcattcctttcttctgaatctcggtcctggtaaggtgaccaagagctctagtttgcttaactctgtcccagatttagtactgaaatcccacatcctgggaaacctatgcggttggccaccttacgggattgcacacttcacagatgtggaattgtgcagtcacacgtgcccctctctcagaatcgccctgtgcttggcttaatgctctgctattgccatcttcaattcttagtaatttttcaacaaggggtcctacgtttttttgcattgggtcttgcaaagcatggagcccatcctgatgacttgtcaccctatattctggacctgacaactgttttgctctgtaagttggctttctgtctcctgccaggtggagcccactgtctggagggacccttacagtctggttccatcttccctgttcatattctttcccaccatagccacctgagaccatctagttttctggcctctggtctctgggtttttgctagccttacatttttctttctttatgtttaaaaatttttttattgtggtaagggcacttaacatgagacctatcctcttaacagattttaaaatgtacaatgtaatactgtcatctattggtgcaatgttgtacagcagacctcttgaacttcatcttgcatattgaaaatgtatacccattgattagcaactcctcattgttctctagcctctggcagccaccattatattctttgcttcaatgagtttggctgttttatttttttttagtttttgagacaaaagtttcagtctgtcgcccaggctggagtgcagtggcacaatctcggctcactgcaaccttacctcctgggttcaagcgattctcctctctcagcctcctgagtagctgggattacaagcatgcaccaccatgcctggctaatttttgtattttttgtagagactgggttttgccatgttgtccaggctggtcttgagctcccggactcaagtgatccacctgccttggcctcccaaagtgctgggattacaggtgtgagccaccgcaccctgccagtttggctattttagataactcatataagtgaaaccacgccgtattcatcctttggtgactggcttatttcacttagaataacgtcctccaggttcatccatgttgtcacaaatgaaagaatatctttcttctttttcttctcctcctcctcctcttcctcctcctcctcctccgcctccccctcctcctcctcttcctcctcctccccctcctccccctcctcgtcgtcctcctctcctcctcctcctcctcctccttcttcttttttgacaaagtcttgttctgtcacacaggctggagtgcagtggtgcaaacacggctcctggaagcctcaacctcctgggctcaagcgaccctcccacctcagtctcctgagtagctgggactgtgggcccattccaccatgcctgtctaatttatttttattttttgtagagatggggtctccctatgttgcccaggctgatggctttcttttttaaggctgaataatatcccactgtatgtatataccacaattaaaaaaatccatcatttcctggtagagagggaaggaaaaatccctcatctgttgataggcatttaggttgttttcacatcctggctattgtgaatagtgctgcaatgaacatgggcacgttcatatctctttaagatcataatccccattcctctggttaaataaccagaagtgggattattaaatcatatggtagttctatttctaattttttgaggaacttccatacgttttccctaggagctgcaccattttgcagtctcgccaacagtgtgcaaaggttctgatttttccatgtgtttaccaacacttgtcttttgtttttttggcaatagccaggctagcaggtgtgcaagtgaaatttcactgtggctttgatttgcatttccctgatgattagtgatgttgagcatcttttcatgtatgtattgggcatttttgtgtctgaaaaaaatgtctcttcaagcccttaagcttatttttaaatcaagttattaaggccgggagcagcggctcatgcctgtaatcccagcacattgggaagccgaggcgggtgtatcacctgaggtcaggagttcaagaccagcctggccaacagggtaaaacttcatctctactaaaaatacaaaaattagccgggctgtggtggtgcatgcctgtaatcccagctattccagaggctgagatgggagaatcgcttgaacccgggaggtggaggttgcagtgagccgagattgtgccactgcactccagcctgggagacagagggagaccttgtctcaaaaaaagagaaaagttattagattttttgctattgagttgtatgagttcactatatattttggagattaaccccttatcagatacatggtttgcaaatactctctcccattccataggttatattttactctgcttattcttgcctttgctgtgtagaagtctcacttggtttgatgcagtcaggcttagttatttttgtcgtctgtacttttggtgtcatagccataaactcattgctcaaaccaccatctttccagcttctcccctgagttttattctagatgttttactttttcattgaagtctttaattcattttgaattgatttttgtgtatggtatatgagtcaagttgcattctcctgcatttgtatatccagtttcccaataccatttgtctaagagagtatcctttacccattgtgtattcttggcattatttaggagaatcagttggacccatatggatgggtttatttctgggctctgtattctgttccatttgtctatatgtctatctttatgctagtaccatactattttaagtactataactttgtcatttatatatataatcctgcattttattagagtcaaataacattaaaagaaagacacttatattcgctttagaaaacccattgatgttgatgaatttggcacatacttataaaagcaaggcttattagctcatatatttggaactaaaaagtatttgaagttgatcacagcataatgaatcctcaatttccagagtactagagatgattatatacaaaaatccagtgaaacttattttactaatttaccagttctatatcactcctaaatttccctaaaaatatggatttataaaaggtagtattctataattcacaaatatgaagagctttattataatttgagtatgaactgtgtatcacccatatcatggcttcagaaaactattgcttttcttactaacttatttaaggtttcactacatgagtcagtatgcagaactcactatgttgtaactacgatctgtaatgataaaaatatagaacctctttgactttaatctaaaaaagtcaccttatcataaaacagtgttaacataatcaaaaattaaccctgacaaaaaaaaacccacttattttggcttttaaaaatagctcatgctcatggttctttcaaagtggtgttgtagctaccgtcttttctaacagaggaatattttcatcatagcaactatttctgagccaaaaataaaccacactaaaaacagaagaaaattctcagtgtagaaaggaaaaggctcatctgttgtgcaatagcaggcatcgggctctgtgagtgcctttcagacatcctcaatcaacccaactagaggcactattgagtttatccagtaagagcactgtgcaatctagtgctgtgagggcattacttaattagccaaaggaagaacaatctttttttctttcttttcttttcttttttcttttcttttcttttttctttctttctttctttcttctttctttctttctttctttcttccttcctttctttctttctttctttctttcttttttctttccttctttctttctttcttttttttctttctctttctcttttgtttttgtttttgttttgagacggagtctcgtgctgttgcccaggatggagtgcagtggagtgagctcggctcactgcaacctccgcatcccaggttcaagctattctcttgcctcagcctgccgagtagctgagatgacaggcgcccgccactacgcctggctaatatttttctctttttaggagagacggggtttcaccatgttggccaggctggtctcgaacacctgaccttgtgattcacctgcctcagcctcccaaagtgctgggattacaggcgtgagccaccgcgcccagctttttctttctctttctttcttctttctttctctctctctctttccctccctctttctttctttctctctctctctttccctccctctttctttctttctttctttctttctttctttctttctttctttctttctttctttctttctttctttctttctttctttttctttctctctttctttctctctgtttctttctctctctttttatttttttgagacaaggtctccctctgttgcccaggctggagtgcagtgacgagatcatggctcactgcagtcttgacacccaggctcaagcaattcttccttctcagctgcccaagtagctgagactataggtgtgcacccccacgcttggctaatttttcaattttttgtagagatgaagtctcactatgttggccaggctggtcttctggcctcaagccatcctcctgccttggcctctcaaagtgttaggattatagatgtgagccactgcacccagccaaagcagtcttcaagttatgtaccagtaatttatatagcttttctaaaatttaagaaagtactgaatggactatagttattatctaaaatttaagcaagtactgagtggactatagtcattatatgattttttaaaaaatttcagtaacttttggggtacaagtgctttttggttacatgaatgaattctatagtggtgaattctgagattttagtgcacctgtcatcaaagcagcgtacactgtaccaaatatatagtcttttgtctcttacctcctcccagactccccttccccaagtcctcaaagtccgttacatcactcttgtctttgcatccttatagtttagctcccacttataaatgaaaacatatatttagttttccattcctgtgttacttcagtaatggcctccagttctatccaagttgctgcaaaatacattatttgttcctttttatggctgggtagtactctgtgtatatatacacatatacacacacacatatatataactttttaaaatccactcattggtcgacgggtaccacagtttggttccatatctttgcaattgtgaattgtgctgctataaacatgcatgttcatgtatctttttcatataatgacttcttttcctttgggtagatacccagtagtgggattactgaatcaaatggtagatctactattagttatttaaggaatctccatactgttttccatagaggttgtgctaatttacattcccaccagcagtgtaaaagtgtccccttttcatcacatccatgccagatctattgttttttgactttttagttatggccattcttgcaggagtaaggtggtattttattgtggttttaatttgcatttccttgatgattagtgatgttgagcatttttttcatatgtttatcggccatttgtatatcttcttttgagaattgtctattcatatcctttgcctactttttgatgggattatttgttttttccttgctgatttgtttgagttccttatagtttctggatagtagtcctttgtcagatgcatagttggcaaatattttcttgcattctgtgggttttctgtttgctctgatgattatttcttttgctgtgcagaagctttttagtttaattaggtcccatttattggttttgttgcatttgcttttggggtcttggtcatgaattctttgcctaggccaatgtccagaagagtttttccaatgttatcttgtagaattgttatggtttcaggtcttagatttcagtctttgatccatcttgagttgatttttgtataagttgagagaagaagatccagtttcattcttctacatgtgatttgcctgttttcccagcgccatttactgaatagggtgtccttttcccaatttatgtttttgtatgctttgtaaaagatcagttggctgtaagtatttggttttatttctgggttctttgttttgttccattggtctaagtgcctatttttataccagtaccatgctgttttggtaactatagccttgtagtataatttgaagtctggtactgtgatgcctccagatttgttctttttgcttagtattgctttggctatttgggctctttttttttgttccatatgagttttaggattgttttattctagttatgtgaaaaatgatgttggtattttgatgggaattgcattaaatctgtagattgggcagtatggtcattttcacaatattgattcttcctatccatgagcatgggatatatttccatttgtttgtgtcatctataatttatttcagcagtgttttgtagttttccttgtagggagcttcacctccttggttaactatattcctaggcattttattttatttttgtagctgttataaaaggggttgagttcttgatttgattctcagctttgtcattgttggtgtatagcagtgctactgatttgcatacattgattttgtaacctgagactactgaaattgtttatcagatctaggaatcttttggatgagcctttagcattttctaggtaaatgatcatatcattggcaaacagctctaatttgacttcctcttttccaatttggacccctttatttctttctcttgactgatttgatttggctgggactttcagtactgtgttgaatagaagtgctgaaagtgggcattcttgtcttgttccagttcttagtgagaatgctttcaacttttcccccttcaatatgaagttggctgtgcttttgtcagataatggcttttattattttgagataagtcccttctatgtctaatttattgaaagcctttttttaatcataaagggatgctggattttatcaaatgcttgttctgcatctattgagatgattatatagttttcttctttaattctgtttatgtgatgtatcacatttattgacttgcatatattaaaccattcctgcgtccttgggatgaaacagacttgatcatgatgtattatctttttgatgtactgttggatttggttagctagtattttgttaaggatttttgcttctatattcatcagggatattgttctgtagttttcttttttttgttatatccttttctggttttgatattagtgtgatactggctttatagaatgatttagggaggattccctctttctctatcttttggaatagtatcatatcattggtaccaattctttgaatgtctgttaaaattcagctgtgaaaccttctggtcctgggctctttctgatttgatctcgctgcttgttattggtctgttcttggtatctatttcttgctatagctattatatgattaatccaaggtaccgaaaagcattttgaatgatttagcaggccatcctttttccttgtgtcctaatgaggaatttttttgacgcttcataattctcttaacaaggaattttagctcctcctccatcattttgtaaaataacgatgataatttaaaacttccatcaacatattaaattttcaaaattaaacaactaaaagctacaaaaatctcaaagtttgagttttaaactgaatatttgaagctaatatagaaatttttgataagaatatcagtgcagacatataacactcaaaccttcacagctaatggcaatatctattagcaatgcaaggtactctttttttttttttttctttttgagatggagaattttgccctgttgcccacactggagtacagtggcatgatcttggcttactgcaacctctgcctcctgggcaagagattcttttgcctcagcctcctgagtagctgggattacaggagtgcgccaccatgcccagctaatttttgtatttttagtagagattgggtttcaccatgttggccagtctggtctcgaactactgaccttgtgatctgcccgtctcagcatcccaaagtgctgggattacaggcatgagccaccatgtctggccgcaaagtactcttaatgacttttaaatcatgtttaacagagagtttacacaagttagtccaatgtagttagtattagtgtccaataatatatgaacacccttcaagacaattgctgctacattttcaatataattattaattgttgtctgaaaaacacacataaacgcaagtgagactaaaagttgtgtcacaaaagaaaaaaagaaaagaccagtaccatgctgttttggttactgtagcctggtagtatggtttgaagtcaggtagcgtgatgcctctagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctacccacgagcatggaatgttcttccatttgtttgtatcctcttttatttcattgagcagtggtttgtagttctccttcaagaggtccttcacatcccttgtaagttggattcctatatattttgttctctttgaagcaattgtgaatggaagtgcactcatgatttggctctctgtttgtctgttactggtgtgtaagaatgcttgtgatttttgcacattgattttgtatcctgagactttgctgaagttgcttatcagcttaaggagattttgggctgagacgatggggttttctagatatacagtcatgtcatctgcaaacagggacaatttgacttcctcttttcctaatcgaatgccctttattcccttctgctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcctatcagtacctaatttatggagagtttttagcatgaagggttgttgaattttgtcaaaggccttttctgcatctattgagataatcatgcggttttcgtctttggttctgtttatatgctggattacgtttattgattttcgtatgttgaaccagccttgcatcccagggatgaagcccacttgatcatggtggataagctttttgatgtgttgctggattcggtttgccagtattttattgaggatttttgcataaatgttcatcaaggatattggtctaaaattctctttttttgttgtgtgtctgccaggctttggtctcaggatgatgctggccttataaaatgagttagggaggattccctctttttctattgattggaagagtttcagaaggaatggtaccatctcctccttgtacctctggtagaattcggctgtgaatccatctggtcctggacttttttttggttggtaagctattagttattgcctcaatttcagagtctgttattggtctattcagagattcagcttcttcctggtttagtcttgggagagtgtatgtgtcgaggaatttatccatttcttctagattttctagtttatttgcgtagaggtgtttgtagtatcctctgatggtagtttgtatttctgtgagataggtggtgatatcccctttgtcatttttgtattgcatctatttgattcttctctcttttcttctttattagtcttgctagggctctatcaattttgctgatcttttcaaaaaaaccagctcctggattcactaattttttgaagggttttttgtgtctctatttccttcagttctgctctaatcttagttatttcttgccttctgctagcttttgaatgtgtttgctcttgcttctctagttcttttaattgcgatgttagggtgtcaattttagatctttcctgctttctcttatgggcatttagtgctataaatttccctctacacactactttgaatgtgtcccagagattttggtatgttgtgtctttgttctcattggtttcaaagaacatctttatttctgccttcattttgttatgtacccagtagtccttcaggagcaggttgttcagtttccatgtagttgagcggttttgagtgagtttcttcaccctgagttctagtttgattgcactgtggtccgagagacagtttgttataatttctgttcttttacatttgctgaggagtgctttacttccaactatgtggtcagttttggaataggtgtggtgtggtgttgaaaagaatgtatattctgttgatttggggtggagagttttgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagttcttcttgttgaattgatccctttaccattatgtaatggccttctttgtctcttttgatctttgttggtttaaagactgttttacccgagactaggattgcaacccctgcctttttttgttttccatttgcttggtagatcttcctccatccctttattttgagcctatgtgtgtctctgcacttgagatgggtttcctgaatacagcacactgatgggtcttgactctttatccaatttgccagtctgtgccttttaattggaacattaagcccatttacatttaaggttagtatttttatgtgtgaattagatcctgtcattatgatgttagctggttattttgctcgttagttgatgcagtttcttcttagccttgatggtctttacagtttggcatgtttttgcagtggctggtaccggctgttcctttccatgtttagtgcttccttcaggagctcttttagggcaggcctggtggtgacaaaatctctcagcatttgtttgtctgtaaagtattttatttcttcttcacttatgaagcttagtttggctggatatgaaattctgggttgaaaattctttcctttaagaatgttgaatattggcccccactctcttctggcttgtagagtttctgctgagagagaaagttcgggttacccacaaagggaagcccatcagactagatcagctgccagtctgatgggcttccctttgtgggtaacccaacctttctctctggctgcccttaacattttttccttcatttcaactttggtgaatctgacaattatgtgttttggagttgctcttctcgaggagtatctttgtggcgttctctgtatttcctgaatttgaatgttggcctgccttgctagattggggaagttctcctggataatatcctgcagagtgttttccaacttgattccattctccccgtcactttcaggtacaccaatgagatgtagatttggtcttttcacatagtcccatatttcttggaggctttgttcatttctttttattcttttttctctaaacttctcttcacgcttcatttcattcatttcgtcttccatcgctgataccctttcttccagttgatcgcgtcagttactgaggcttgtgcattcgtcacgtagttctcgtgccgtggttttcagctccatcaggtcctttaaggacttctccgcattgattattctagttatccattcgtctaattttttttcaaagtttttaacttctttgccattggtttgaacttcctcctttagctcagagtagtttgatcttctgaagccttcctctctcaactcgtcaaagtgattctccgtccagctttgttccgttgctggtgaggagctgcgttcctttgtaggaggagaggcgctctgatttttagagtttccggtttttctgctctgttttttccccatctttgtggttttatctacctttggtctttgatgatggtgacgtacagatgggtttttggtgtggatgtcctttctgttgttagttttccttctaacagtcaggaccttcagctgctggagatatagaccaatggaacagaactgagcactcagaaatagtgccgcatatctacaactatctgatctttgacaaacctgacaaaaagaagaaatggggaaaggattccctatttaataaatggtgctgggaaaactggctggccatatgtagaaagctgaaactggatcccttccttacaccgtatacaaaaattaattcaagatggattaaagacttacatgttagtcctaaaaccataaaaaccctagaagaaaacctaggcaataccattgaggacataggcatgggcaaggacttcatgtctaaaacatcgaaagcaatggcaacaaaagccaaaattgacaaatgggatctaattaaactaaagagctgctgcacagcaaaagaaactaccatcagagtgaacaggcaacctactgaatgggagaaaatttttgcaacctactcatctgacaaaggggtaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacagcaggtgttggagaggatgtggagaaataggaacacttttacactgttggtgggactgtaaactagttcaaccattgtggaagtcagtgtggtgattcctcagggatctagaactggaaataccatctgacccagccatcccattactgggtatatacccaaaggattatacatcatgctgctataaaggcacatgcatacaagtgtttattgcggcactattcacaatagcaaagacttggaaccaacccaaatgttcaacaatgatagactggattaagaaagtgtggcacatatacaccatggaacactacgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacaaacctgcacgttgtgcatgtgtaccctaaaacttaaagtattataataataaaaaagaaaaagaaaagaaatccaatgaatcaattaatgctatcaacaaagaacatgcaagaatgtaacattacatgtaatttttgttttcaaaaaagacactaaaatgccactgcattaaaatgtatttattatttattattattatttttgagacagggtcttggtctgtcatgcaggctggagtgaagtggtgcaatcatggctcactgcagccttgacctcccaggctcatgtgatccgcctgcctcagcctcctaagtgtctttgactgcaggtgtatgccaccatacctggctaatatttaaatttcttttgcagtgacagggtctgtctatgtttcccaggctggtctccaactcctgggctcaagtgatcttcccaccttggcctcccaaagtgctgggactactggtgtgagccactgcactcagccggactataatttattcagaacatctttagtgttcattcccagagatcttgatctgctcagtaatgctttcacaagatcgattatagccatcttttgcagtgaatgcttaggctggtccgtcctcctgtggtagtagggagcagtctttttttttttttttttaaatcttcatgtttttatttattttttcttttttaaattacacattgggccaggcacagtggctcatgcctgtaatcccagcactttgggaggccgaggcgggcggatcacgaggtcaggagttcaagaccagccttgccaacatggtgaaaccccatctctactaaaaatacaaaaattagctgggcttggtggcgtgtgcctgtaatcccagctacttgggaggctgaggcaggagaattgcttgaacccaggaggcggaggttgcagtgagccaagactgcaccactgcacgccagcctggcaacagagcgagactccgtctcaaaaaaaaaaattatacgttaagttctgtgatacatgtgcagaacatgtaggtttgttacctaggtatacaagtgccatggtggtttgctgcacccatcaacccgttgtctaggttttaagcctcacatgcattaggtatttgtcctaatgctctccctcccccttgatccccacccctcaacaggctccagtgatgttcccctccctgtgtccatgtattctcattgttcaactcccacttatgagtgagagtatgtggtgtttgctttcctgttcctgtgttagtttgctgagaatgatggtttccagtttcatctatgtccctgcaaaggacatgaactcattctcttttatggctgcatagtattccatggtgtatatgtaccacattttctttatacagtttatcattgatgggcatttaggttggttccaagtctttgctattgtaaatagtgcttcagtaaaaatacatgtgcatgtgtctttatagtagaatgatttataatcctttgggtatatacccagtaatgggattgctgggtcaaatggtatttctggttttagatccttgaggaatcgccacactgtcttctacaatggttgaactgatttacactcccactaacagtgtaaaagcattcttatttctccacatcctctccagcatctgttgtttcctgactttttaatgatcatcattttaactggcatgagatggtatctcattgtggttttgatttgcatttctctaatgaccagtgatgagcttttttttttcatatgtttgttggccacataaatgtcttcttttgagaagtatctgttcatatcctttgcccattttttgatggggttgtttgtttttttcttgtaaatttgtttatgttccttgtagattctggatattagacctttgtcagatggatagattgcaaaaatattctctcattctgtaggctgcctgttcactctgatgatagtttcttttgctgtgcagaagctctttagtttaattagatctcatttgtcaattttggcttttgttgcaattgcttttggtgttttagtaaggaagattttgcccatgcctatgccctgaatggtactgcctaggttttattctagggtttttatggttgtaaattttacatttaagtctttaatccatcttaagttaatttttatataaggtgtaaggaagggatctagtttcagttttttgcatatggctagccagttttcccagaagcatttattaaatagggaatcctttccccatttcctgcttttgtcaggtttgttgaagatcagatggttgtagatgtgtggtgatatttctgaggcctctgttctgtttcatttgtctatatatctgttttggtatcagtaccatgctgttttggttactgtagccttgtagtatagtttgaagtcaggtagtgtgatgcttccagctttgttgttttgcttaggattgtcttggctatatgggctcttttttggctgcatatgaaatttaaagtagttttcacaagatcagctacagccaacttttacagcaaacggttaggctgttcctcctgtggtagtaggaggcagggtttttttttttttttttttgagatggagtctcagtctgtcacccaggctggagtacagtagcgtgaactgcaacctctgcctccaggttcaggtgattctcctgcctcagcctcctgagtagctgggattacaggtgcccaccaccacacccagctaatttttgtatttttagtagagatggcatttcaccatgttggccaggctggtctcaaactcctgatctcaagtgattcacctgcctcagcctcccaaagtgctgggattacaggtgtgagtcaccgaacccggccctctttgcccatttttaaattgggttatttattttcttactattgagttctttatgtgttatggatattaaccatttatcagttgtgtggtttgcaaatattttcccccagtctgtaggttgtctcttcactctgttaattattcctttattgtgcagaagctttttagtttgatgcaattccatttgtctgtttttgtttttgttgcttgtgctttcaggatcatataaaaaaatcattgcccagaccaatgtcatgaagctttccctctacgtttccttctaatagtttatagtgttagatcttacatttaagcctttaactcactttttaatttttttattttttaatttaattttattttagatggagtctctctctattgcccaggctggagtgcagtggcacgatctcagctcactgcaacctccacctcccgggtcccagcgattctcctgcctcagcctcccaagtagctgggattacaggcctccgccaccatgcctggctacttttttgtatatttaatagagacggggtttcaccatgttggccaggctggtcttgaactcctgatctaaggtaatccacccgcctcagtctcctaaagtgctgggattacaggcgtgagccactgcacccggcccagcacttttgatttttgtatttggtttgagataaaggctcagtttcattcttttgcctgtggatatccagtgttcttaacaccatttgttaaaaagactgtcctttccccattgtatgcccttggcacctttgttgaaaattagttgattgttggccgggcgcggtggctcatgcctgtaatctcagcactttggaaggctgaggcgggtggatcatgaggtcaggaaatcgagaccgtcatggctaacaaggtgaaaccccgtctctactaaaaatacaaaaaattagccgggcgcggtggcgggcgcctgtagtcccagctactcgggaggctgaggcaggagaatggcgtgaacccgggaagcagagcttgcagtgagtcgagattgcgccactgcagtccgcagtccggcctgggcgacagagcgagactccgtctcaaaaaaaaaaaaaaaaaaaaaaaaaaaaaaaaaaaaaattagccaggcatggtggtgggcacctgtagttccagctactcgggaggctgaggcaggagaatgggggaacctgggaggaagaggttgcagtgagcctacatcatgccactgcactccagcctgggtaacagagcaagactccgtctggaaaaaaaaaaaaaagaaaagaaaattagttgattgtaaatgcatgggttcatttctgagctctgtattctgttccattggtcaatgtctctgtttttatgtcagtgtcatgctgttttgctgagtatacctttgtggtgtattttgatgtcaggtagtgtgatacctctacctttgttgtttatgctcaagattgtcttggatatttgaggtcttttgtgacttcatattaattttagtattgttttttctatttctgtaagaaatgccattgggattttggtaggaattacattgactctatcgatcactttgaatagtatggacctttaaaaatattctttcaatccataatatgggatatctttccattgatttttgtcttaactttctttcgtcaatgttttatagttttagtgtgcatatttttcaccttcttggttaaattaacttgtaagcattttattttttgatgccattgtaaataggattaatttctttttcagatagtttgttgttagtgtatagaaacaaataatttttgtatgttcattttgtattccatgactttactaaatttgtttattaaatttgataactttttcgtagagtatttataacaagtttcttatatataagatcatgtcaattgcaaacagggacaatttttttttctttatttctaacttgaatgcatttcttatctttttcttgcccaattgctctggctaggactttcagtactgtgttgaaatagaagtggtgagtgtgggcatccttgccttgttcctaattttagtggtaaaatcaaattttcaccactgggtatgatgttaactagacactttttttaatgttctttatcatgttgatgtaatttccctgtatttctagtttgttgagggtttttaatcatgagtggctattcctgtggcctgaatgtttgtgtcctccccagattcatatgttgaagcctaattccttgtgtgatggtatttgtagatgggacctttggaaggtgtttaggtcatgagagtgtggccatcattaataggattagtgcccttagacaaaagcaaaatgatggttgcctatgaaccagaaaataggctctcaccagatattgaatctgcttgcaccttgattttggatgtcacaagtcttcagaactatgagaaataaatttctattgcttataacccatccagtctatgttatttgttataccaaataagctaagacagatgtttagttttattaaatgctttcttttcttattgataagatcatgttatttttattccttattctgttaatgtggtgcatcacatttattgatttgcatatgttgagccatccttgcatgccaggaataaagcccacatggtcatggcgtatgacccttttgtgctattgaattcagtttgctagtattttatttaggattttggatctatgttcaatagggaaattggcatgtagtgatcttttctcatggtgtgtttgttgggatttagtgtcaggatagtgcttgcctcatacaataagtttggaagtattccctcctcttcagttttttggatgagtttgagaagaattcatattaattcttatttaaatgtttggttggtagaatttgcctgagaagccaccaggtcctgggcttttctttgttaggaggtctttgattactgattcaatttccttactcattatagatctgtttaaactttctattgccttatgattcaggcttggtaggttgtatatttctaggaatttatccattccttcaaggttatcaagtttgttaacatataattgttcatagtagtctcttaatgatcctttttattgctatggcatcagttgtatgttctttcatttataattttacttatctgttgtttctgttttttctccctttttccttggtctacctaaaagcttgtcagttctttttttttttttttttgagatggagtctcactctgttgcccaggctggagtgcagtggcatgatcacagctcactgcattctccacctcccaggttcaagtgattctcctgcctcaggctcctgagtagctggcattacaagcacgtgccaccacacctggctgattttcgtatttttagtagagacagggtttcaccatgatggccaggctggttttgaactcctcatctcaggtgatccacttgcctcgacatcccaaagtgctgggattgcaggcgtgagccactgcacctggccaaagcttgtcaattctatctttttgaaaaatcaacttaatttcattgatttttttctattctctatttgatttatttttctgtaatctttattattttcttccttctactaactttaggtttagtttgttcttttatttctcatttcttgaggtgtaaagttaggttttgtaattgaaatttgtctttttgttttaaaattaggtgtttatcccgaactttcctttagtactgcttttgctgcctcccattaagtttggtatattgtgtttttgttttcatttatctcatgttattttctaatttatttttttatccattagttgttcaatggtgtattgtttaatttttacatatgtatgtttttttccagtttttcttctggtattgtttttagtttcattccattgtggttggaaaagattcttgatataatttaaatcatttcaaatttgttaagacttgttttgtgacctaacatgtggtctgtcctggggaatggtccatgtgcacttgagaagaatgtatattctgcagtagttggcttgtgtattttgtatatgtctgttaagtccatttggtccattctcccttgggttttttttttgtctagttgttctatttgctattgaaagtaggattttgaagtttcttactattgaattgctgtctatttctcccttcagttctgtcattattagctttatatattcagatgtctgatgggtgtgtatataattaattgttgtaactcctggtgaaatggccatttcatcattatataatatcattatttgttttttgacttaaagtctattttgtctgatattagcatgtcatcctgctctcttttggttaccattttaatggaatagcattttctactcctttacttttagcctatgtgtcagtaaatacaaagtgggtatcttgtagatagcatataattggattttgtatttttattaattctgccactctgttttgagagtttgcttctgtttacatttaaagtaattattgatagagaaggatttactactgccattttgttaattgttttctgttagtcatgtaggtcttttgtccctcttttcttctcttgctgtcttcctttgtgttttattgttgttaatttttgtattaatatgctttcattttgttctctttttgtacttttttttttttgagacggaatctcattctgtcacccaggctggagtgcagtggtgcgatctcggctcactgcaagctccgcctcccgggttcaggccattcttctgcctcagcctcccgagtagctgggactacaggtgcccaccacctctcctggctaattttttgtatttttaatagagatggggtttcaccacgttagccaggatggtcttgatctcctgacctcgtgatccgcccacctcagcctcccaaagtgctgggattacaggtgtaagccacgtgagccaccgcgtctgaccctttttttgtgtatataacttctaaaggtattttctttgtggtttccacaaaacatctcataattatcatggtctattttaagctgataacaactgaacttaaatcacatgcactctatacttttattccccactacacgttttacgttattgattcacaatttacagttatttatattgtgtatccagtaacataattttagctatagttatttttaatatctttgtcttataacttttataccataattaaaagtgtccaattcacttgcattaaggacatgacaaaatcacttttaaaatttctttaaaatttattatttggctgtcatttttttcaatattactcttgcacatactttaaagagtcaaaatagttccaaaaagctcactattaaaaaacaacaatttccacatacacgatggttttggcttcatttcccttgctcttgagggaaccactttcagctctttcaattctctatttgttccaattacataataataattttgctactttttgatttttgttttaccactgacttcccaccatggaaggtggagattgatctctttttcagttttccttttgccacatagtagcactcttttaccccccattcacgcctcatgtttatgtgatcattttgtttagatcaacattcagtgtttgcattattctgactacgtaaatgaaattcagctgagccaaataatatacttttacttttccctgtatgcagggaaatgcaggtaattaatagaaattggggttgggcgtggcggctcacacctataatcctagcacttgagaggctgacagggcagaatcgcttgagcccaggagttcaagaccagcctgggccacaaagtgagacccccgtttttattttaaaagtttttttaaaaaagaaattgtaggtatcctcttgaggttgtggtctaaaggtgaataattccttgataagttctaagctgtcctagttccttggttagttgcaagagatgagacttgagtagagcttagagaacctctgtctgggccatgctggatgactgagttatacatctcctgtctttcctacccctttctctctccacacctcttttttaccctcagcggatagcaggctccaagctctctcccaggctccagtattttggtcagtcactgagtgggggccaggacctcacaatggatggactggtagacctgactgtaggagcccaggggcacgtgctgctgctcaggtgagaatgccttttggagtcaaccggacattctcccttgaaggaatgtttcctgtttgaaggtccctgatggttttctggtgtccctttaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggtgaggcttggtggatgagtctcaagaggttaaacgaccgaggacatgaatgggtgctgcaatccactctgcccagccttctggctgtcctgaactgagttctcacaggctctgacaaccttctccaagccttacctgagtgagcaggctattgtcctgctgggtagggaagtccagtggacctccctaaagaggtgagcatgtggcacttccttactcactcagttctccagagaactgaaggccccatgcctgtgaacaaactatgtttttgttttttaataaacggagagaaaacctatttggggagattgaattgatgaagctaaacagagatttacaaagcactcacatacgcattttatcaccagtgacttcttcccttgttcctattctcaaagagtagaactgtgtttggggtgggagaatagtaatgacaatactaagaataactgtctctagtagtgacagcactaggaataactgtctctagtaatgacagtactagaaagaattgtaccctctttaaaagtaaaattattagctaggcatgatggcatgttcttgtagtctcagctacttgagaggctgaggtgggaggggaggatcacttgagcccaggaggttgaggccagcctgggcaacatagcaagacccatccctaaaaaatgattacctttctaggaacagttttcctgtgctgaggagatagcattccagatatgagagcagccagcatggctagaaattaagagcaaaatgttagagagtagggaattgaagaagaggtacccttaaacctacatagaagtccccctctactctttggctgactcttaagacacgaatgcctaggtcagtactccaagacacccagtagaaaacagcaactgaaaagccaaagagctgatcagagaattcagcagctcctcagtgctggggagacagagatttgagaggccttggtaaataccttggtctttccattgagacaactgactagcaaccaagagaaacaatatacaatagaaatagacccacaggtgattcagaaattagagtgattggataggaatttttaaaaggtaactataattaatatcttcaagaaaaaagggaaaggatgagaacttcagcaaaaacctggaattcataaaatagagtcaaatggaaactctagaaccaaaaatcgcactgactgaaatgaagaattcagtaaatagatttatagcagattagaagcagaacagagaattagtgaacaagaagacagtcatttgaaagtatctggataaatatgcgataaaaagaaagaaaaatacagaaaaacaccataagagatgtgtgggatatggtgaaagatctaacaaacatgtaattggaattacagaaagtggtggtgggggaggagagagagagagagagaaagaaaataggaaagatggaataggaaagacagaataggaaagatggaataggatggaataggaaagatgcagtagttaaagaatttccccaaactggccagtcacggtggctcacgcctgtaatcccagcactttgggaggccgaggcaggtggatcacctgaggtcaggagtttgagaccagcctggccaacatggtgaaaccccatctctactaaaaatacaaaattagcaggtgtggtggtatgcgtctgtaatcccagctactcaggaggctgaagcaggagaattgaacctgggaggcggatgttgcagtgagctgagatcgccccattgcactccagtctgggtgacaagagcgaaactccatttcaaaaaaaaaaaaaaaaattccccaaactgatgaaagacatcaagattctttacaaaatcaaagcaggataaatatgaaggacattatatcattgtacgttataatcaaactgctgaagaccaaagacaaagagaaaaaaatttaaagtagtcagaaaaatacaataaattttttagtgagtgacagaatagctaccatttattgagcacttattgtataaaagacactgtgctaaatacttgataagcactatttcatttcctttttaccattgggagggtatcattattatcctcactttaaaaataaagaatggaggccaggcgcagtggctcatgcctttaatcctagcgctttgggaggctgaggcaggtggattactttgagaccagcctggctaacatggtgaaaccccatctctactaaaaatacaaaaattagcacggcgtggtggcatgtgcctataatcccagctacttgggaggctgaggcaggagaaacgcttgaacctgggaggcagaggttgcagtgagctgagatggcaccactgcactccagcctgggcaagagagtgagattctgtctcaaaaaagaaaataaaaaataaaaagaaaggaaggaaggaagaagggaaggaaggaaaggaaggaaagtaggaaaggaaggaaaggaagaaaaggaaggaaggaagaagggaaggaaggaaaggaaggaaagtaggaaaggaaggaaaggaagaaaaggaaggaaggaaaggaaaggaaaaaaggaaggaaggaaggaaagggaggaagagagcgaggaaagaaagaaagaaagaaaaaggaaggaaggaaggaaagaagactcagagaagtcagataacataccccaagtcacacagctgagaagcagaggagctgggccttgaactcccatctgccgggttccgaggctcaggcccctcactgctgtgccaccctgtcccttcaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccggtgagcaggctagtggccagacccctgggtcttccaagcatggagtgggcttggggagctgaggagggcagatccccaaatcccggctatctcttagaattgcatcgaggacccagtgagccccattgtgctgcgcctgaacttctctctggtgggaacgccattgtctgctttcgggaacctccggccagtgctggcggaggatgctcagagactcttcacagccttggtgagtccagagttggggtcctgcaggggtgtggaagagaccagagaccaaggtggttgaaactcattttatttgattgcatctaattttacttcaacatttgattttattgtttaatttcacaatacttggttattttctttcctttcatttgatcatatttattttttaaaagtttccctttgagaagaattgtggcaatgacaacatctgccaggatgacctcagcatcaccttcagtttcatgaggtgagtttcctttcctcctcacctcctccagagaaggacccgtaccatgacccgctcttttctcctcctggcccccaagggagccgggtgttcctgggctataaggtccggtgtggctgcccctccactgttgtctcttcatcaagtgtctgcgtctctgttctgctggagcaggcttgccacagggaagcccagcgccccatcccccggcctgtcttcttcttcccacagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccaggtagccacatccttctcaggctctatctgacctttgcttccccatcctcacggccggaggtggatatcaccgcctttgcctcccctgccttccagaaccagcgctcacagcgatcctggcgcctggcctgtgagtctgcctcctccaccgaagtgtctggggccttgaagagcaccagctgcagcataaaccaccccatcttcccggaaaactcagaggtcagaactcctggctcctcccctccttttctctttgatttctttggggattcttttcttcttcttctcttctttagtagtggttcctttttgtacaaaacagctttattgagatataattcatataccatccaattcacctatttaaagcatacatttcaagcccggcacagtggctcatgcttgtaatcatagcactttaggaggtcgaggcaggaggatcgcttgagcccgagagtttgaaaccagcctgggtgacacggcgagaccctgtctctacaaaaaatgtaaaaattagctgggcgtggtggtgcacacctgtagtcccagctactcgggaggctagggtgggaggatcgtctgggcctgggaggttgaggctgcagtgagctatgatcacaccactgcactctagcctaggcgacagagtgagaccctgtcttgaaaataaataaaatgaaataaaataaaataaagtatacagttcagtggctttgagtgaattcatagggtcttgcatccgtcatcatgatccattttggaacatcttcattacctcacaaagagcttctgttcccgttggccctcagccccagtcctcccatatcccccagccctatgcaaccactaatctactttgtctatagatttgcctattctggacatttcatataaatgaaataatcccgtatgtgatcctttccctagcataatattaagcaaggacttagcaaggatcattcatgtcgtagtatatgtcagtacctcattgctttaaaaaaattgtttttaaattttttatatatatttttgagatggagtttcacttcgttgcccaggctggagtgcagtggtgcaatcttggctcactgcaacctctgcctcccaggtttaagcaattcttgtgcctcactctcccaagtagctggggttacatgcgcccgccaccacacccagctaatttttgtatttttagtagatacagggttttgccatgttggccaggctggtctcgaactcctgacctcaggtgatccacctgcctcagcctcccaaagtgctgggattacaggtgtgagccaccgcacctggccttcattgctttttatttggtgaacaatatcctgttgcatggatgggccatatttcatgtctccattaatcagatgacgggcatttgggttattttttctctcatatttctgtcattgtctctcctttctctcactccaggtcacctttaatatcacgtttgatgtagactctaaggcttcccttggaaacaaactgctcctcaaggccaatgtgaccaggtgctctctgctaccaggcttctgcaggcagttgcccgtctgacgccccagcccctggcccatggtgggcctttgccctttgcccactggttctcccttcaactcatttgttcactcagcaaacactcactgaccacccaccacgtgctgggccttgtgctgagtgctggtgggatggtggtggatcagacgatagtggttcctgccctctcggagatgataatttagtggcaaagacagacaagaaatctagccattaatcttgcatccatctcaaatccagtatgagatgcaagattagatgggggacggccagtgttcttgggagtttggtgttcagagaagattcctaaagaaaatatatttaggagctgggcgtgctggctcaagcctgtaatcccagcactttgggaggctgaggcaaaacaattgctcgaacccaggagttcaaaatcagcctggacaacatatcaataccctgtttctacaaaaaaaaaaaaatacaaaaattagccaggcatggtggtgcatgcctgtaatcccagctactcaggaggctgaggcacaagaattgcttgagcctggaagattgaggctgcagtgagctgagatggtgccactgcactccagcctgggcaatagagtgagacccagtgtcaaaataataataataataataataataaaaaataaaagggaaaaaaagaaaatatatttagacaaagcaaaggcatgaactgagggcgggcatgaagacagaaggcaggaagcagataccagggacgggaagatcagggtgtgtttaagagtggcctcagcatgaaatgcagggctgaaggagttggtggtggttagatacaggccatgtcccaaaatgactgacgggtgttgtttgggatttgcagtttcgcctctgggagtgacataatcatatttgcatgttagaacgatcactcttcaggagggctggcgattggggtgggagcaggtgtgaattcaggggaccagttagaagaaggtggttgcagacatccagctggagagggatgggcctgggctaggcgggggcaggggttggagaacagtggggtttcagatgcagagataacagaacttggtggctgattggaggcagggagtgagggagagggaggagcaaagactaactgtcagttctcaagagccggctggagctctttctttccctccagtgagaacaacatgcccagaaccaacaaaaccgaattccaactggagctgccggtgaaatatgctgtctacatggtggtcaccaggtgctggcttccaggactttagctgagcctccacttctgggctggacatggctgattgtgcatctgtgtgcatgagtctgtgcatgtgtgtgtgtgtgagagtctgaggatctctgtgcatgtatgtgtgcatgggtgtgtatttgggcatgggtgtgtgagtgtgatgatctatgtgcatgtttgtgtgcatggacgtgtatttgtgcatgtgtgtgtctgaggatgtatctgcatgtgtgtatgtgtgcatgggcgtgtatttgtggatgtgagtgtgatctatgtgtgtgtgcgtgcatgggtgtgtatttgtgcgtgtgtgtgaggatccttgtgcatgggtgtgtatttgtgcatgtgtgtgtgaggatctatgtgcatgtgtgtctgggcatgggtgtgtgtgcatatgtgtgtgtctgaggatatatgtgcattgtgtgcatgggtgtgtatttgtgcatgtgtgtgtatgaggatctgtgtgcctgggtgtgtatttgtgcgtatgtctgaaggtctatgtgcatgcgtgtgcgcatgggtgtgtatttgtgcatgtgtgtgtgtgaaggtctatgtgcatgtgtgtgcgcatgggtgtgtatttgtgcatgtgtgtgagggtctatgtgcatgtatgtgtgcatgagtgtgtattcgtgcatgtgtgtgtgtctgaggatctatgtgcatgtatgtgtgcatgggtgtgtatttgtgcgtgtgtgtgtctgagggtctgtgtgcatgtgtgtatgtgctcatgggtgtgcatttgtgcacgtgtgtgtgagtggcccaaatgggcacgcactgtgtgtccagcacacattggttcccccatccccctgcaccccaccccatctccaccccccaggacttcatacccattacccatgtgcctgttcgctccttacacacttagcctgagacaccctcccagggcacccctcatgttttgtcacctcctgtcccttttttctcccttcagccatggggtctccactaaatatctcaacttcacggcctcagagaataccagtcgggtcatgcagcatcaatatcaggtgggcagctgggacgtctgggtcctgagaaggaggctggggaggaaaatcgatggtagaaaatgcagaaacagggatgggaaatgtgcgcaaggcacctgtggtgtgccaggcttggttccacgctgctatcactcagtatgcacacatacacgcacgtatgtatgtgacatgcacgcacgtagttatcttgtattaccttcgtagcgactctgtggggcactgtcatgatccccagtttacagatgaagaaactgaggctcagagaggtttacagaacaagctcgaggtctcccaccgagtaagtgggagagctaggactggagaccaggccgtgtggcactggaatgcgtattacatgtacactctactctctcaaacaggaaggggcaggacgcccgggcctatggcctgccccgtggggaggggaggctgattctccaggctggtgggggaggaaggccagagccctgaccccgccctccccggtgcaggtcagcaacctggggcagaggagcctccccatcagcctggtgttcttggtgcccgtccggctgaaccagactgtcatatgggaccgcccccaggtcaccttctccgaggtgagcggagctcggcctgactcctgcacggccctgcgcgttcctctcacctctgttaatgctattgggttttagagccgctccgcccctctcctggacccaggccatctcacctcccgagatgaggccctggcgccttcatctctgccccttctcagtgcgtctctttcctcagaacctctcgagtacgtgccacaccaaggagcgcttgccctctcactccgactttctggctgagcttcggaaggcccccgtggtggtgagaagctaagtcagccccagggccacacagagacccagagcgcttccctgctggaacctgtatggtctctgagcaaacggggaggggtgttctctgccttcggcttccttacccgtcccctcccctcctgcgttccccagaactgctccatcgctgtctgccagagaatccagtgtgacatcccgttctttggcatccaggaagaattcaatgctaccctcaaaggcaacctctcgtttgactggtacatcaaggtgtgtggggtcctgaggcttcgccgggcacaggcgtggtgctcagggcccaggtgcagtgcccacccgctctcttccacagacctcgcataaccacctcctgatcgtgagcacagctgagatcttgtttaacgattccgtgttcaccctgctgccgggacagggggcgtttgtgaggtcccaggtacctgtcttgggcgctgaggaactattggagggagaggggctgcgcttgtggagatttctgggggaggagagagagacacaaagagagagggagagagagagacagagcgacagagagacagagagatacagagacgtaaggagagagacagacagagacagagagatagaggcagagggagaaacagacacagagacagacaaaggagagagagatagagagtcagagagatagagatagagacagagacagtgagagatggagatagacagagagatagagataaagagagagatacagagcgcgacagagacagagacagtgagccatggagatagagagacagagagaggcagaaagcgatagagagagatagaggacagagaaacggaggagggagaggagggagaagaggtgggggaggaggactgagggctggggttctgggggacatgaggaggggttccccacttgattcaggggtgcacacggtgtgaatggggaacccccagaaatccagagtcgtctcccctgacgcccctccttcctcccccagacggagaccaaagtggagccgttcgaggtccccaaccccctgccgctcatcgtgggcagctctgtcgggggactgctgctcctggccctcatcaccgccgcgctgtacaaggtgctccccgctgctcccccaccccctcccttcatcctctcgggcctcgcgctgcagctccgtgcctcggtttccccggcggggctgccagctgtgtgactggggcgagtctgggagcctctctgcgcctcagtctcttagggagggtggccgggttcatgcgcggggcgcgctgagaacgagtcgccctccttgtagtttctgtttttctccaggccccgacgcggatgtcactcccctcccgccccgccctcctgggtcccttctgtctctgccggccctcccgccccctccccctggtctgcggagccgcacgctccctggctgctgtcgctctcactgccctcctctgccccgcagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcaagtgtctgtgtgcaagtgtgtgcacatgtgtgcgtgtgcgtgcatgtgcacttgcacgcccatgtgtgagtgtgtgcaagtatgtgagtgtgtccaagtgtgtgtgcgtgtgtccatgtgtgtgcaagtgtgtgcatgtgtgcgagtgtgtgcatgtgtgtgctcaggggcgtgtggctcacgtgtgtgactcagatgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggaacctcctccacaccagcgctgatgcccaataaagatgcccactgaggaatgatgaagcttcctttctggattcatttattatttcaatgtgactttaattttttggatggataagcttgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcatatatgtaaggataatttataggatatgttcctggaagtttgggttctcccagaagcaaacccaagaatttgggtgaaacaagcgtatttaagaggtggcaggccaggcatggtggctcacacctgaaatcccagcattttgggaggtgaaggtgtgaagattgcttgagctcaggagttcgagactagcctgggcaacatagtgagaacctgtgtccacgaaaaattaaaaaaatttagccaggcctggtgttacatgcctgtagtcacagctactccggaggctgatgcaggaggattacttgagcccagaaggtctagactgcagtgagccatgatcgcaccactgcactccagcctgggtgacagagtgagatcctgtctcaaaaataaacaaaataataaaataaaggtcgggcacagtggctcacgcctctgtaatcccagaactttgggaggccgaggctggtggatcacctgatctcaggagtttgagaccagcctgtcgaacttggtgaaaccccgtctctactaaaaatacaaaaaaattagccatgcatggtggcaggcaactgtaatctcagctacttgggaggctgaggaaggagaattgctttaacctgggaggtagaggttgcagtgagatatgattgcatcactgcactccagcctgggcgacagagcaggactccatcttaaaaaaaaaaaaataaataaaataaaataaaataaagagatggctccaggaaataccgaggaagggaaggctgccaataacaggtgtatcacccacagagaagctgctgtgagttcctggagcttcaccccactgggcagttctcggaggcagtgcagaacacgcacctcagtatcaccccacccaggggagaaggctggagcgcatagacaccgattccacttagctattggatgagggctgctcttggtggggagagtgtgttaatttcctaccacttctggcctgccctgagtgtgaggagagtgggctctagtggccagagaaagtgataccagtgctgctggctggatgtttgacaggtgaacacagcccctgacacggtgcctttggttcaggtcagggcaccaggagcacttgctgccaaggtgtgtgcaggtgacattttggtggctgcttcctcagagggaggatgcccagtgcctgtccctcatactttgcaaacacagtaaacactagcctggcctgaacatacatcctctctaatcctcacaccagtccttggtatttacatgaatttcacttatgaggaaacctaggcttagatagatcataccagttgcctgaggtcatacagctgggaaggaatggagctaggagttaatcccagctctgcctaggtctaaagcttttctcttttactgtcctgacagcctcagaggaatggccccagaacaggcatgagggagtgtggggagagggtggctgttatttaactgttatgatattgggttaaagcatatgaaattgatgacatgtttttggacaaaaatgtttctttcttttctttctttctttctctttctctcttttctttctctctctctttctttctccttctttctttctttctccttctttctttctttcccttccttccttccttcctttccttccttccttccttccttccttccttcctccttccttccttccttccttcctccttccttccttccttccttcctttcttttttctttctttctttccttccttccttccttccttccttccttccttccttccttccttccttctttctttctttctttctttctttctttctttctttctttctttctttctttctttctttctttctttctttctttcttttttttcatggagtcttgttctgtcgcccagactggagtacagtagtgtgatctcagctcactacaacctctccctcccgggttcaagtgattatcttgcctcagcctcctgagtagctgggattacaggcgtgcaccacaatgtctggctaattttttttttttgtatttttggtagagatggggttccaccatgttggccaggctggtcttgaactcctgacctcaggtgatccatctgccttggcctcccgaaatgctgggattacaggtgtgagtcactgtgcccagccaaaaaatggtaatttcatgatcttcattgaaatacaagaaaatcatggcttagagggacacttgtttcacatgtggcaggaggagagagggcttactccttagggaggtgaaggaagggtccccaagggaggtgacacctgactgaagcagggccagaagatctccaggcagaagggagggcaggggaggctgggagagtgggcagggcttgggcatgagtgctttgtaagccagagtgagtagttccaatttcactcaaagtgaagtgagatgccctcaaaaggtggctaatgagacaatggccctttgtatctgtgggggtgacacaaaacacggtcacctttagacggttctttgctatttcctctcctgacttaaataaagtctgttaagaatttctgtgtttccttatgttgaaagataaaagtcctcaatatctgcagaagtcctgaattgctccgggaacagagagagttctgtacctttagtcgcctgtcctttcaccctccatgtctgtagtcgcctgtccttgcagcctccatgctggtccttgtagccttcgtacctagttgcttgtcctggcagcctccatacctgtagttgcctgtccttgcagcctccgtgcctgtagccgccagtctttgcagggcagttaaagtcctgtgaactcagagttcacctccgcgtcttcaaatgagaagcttgtgttgaattcagccagataggagctttatgatgggttagaaaagtcaatcatttcaagcgacagatttccctagcatgaccacaaagtgactaataaacaggaccataaatctggtgataagtggccaagtccaggaacgtctgcttgcttttatttttggggatttctcacttcagaataaatgaatcccttcagtatccactctccttttcctacttagagtagaatcttaatttgggccaccatgggagatggttacaattctgactcccagtgaatggtgcttcccggccctacacccttgcagtgtgacattgctgtccctgacatcacatggtgcggcctgtctacctctttgaatctgggctggtcccgtggtttgctttgattaatagaatacagtaggagtgtggtcgtgtgagttctggagcctagacctttaggagcacagcagatcctgccctgcacccctcggaacactgaggtcaccacgccgtgatccatatggcccactggagaaagagtggactcatggaggagacagcggaggccactgccactgtgcatgcatgaggctgctgtgatccttccatccagctgtccaacacctgcagccactggagagtcccacagaactgcctggattgtcacctcatgcaactgtgagaaataatcaattactgatgtctcagtcctgcgtggtggtttgttacgctgcaatggatattgcgtatagccccttagttatagggttcgtctccccacctcctgtgcagctggtgtggctgcctggcgaggttctggctgatgggatgtgagcagcagtgaagcgagcaacttcggagccaggtcctttgagggaagaagtgtcgtttcttttcaccaccttcccgctggctggagtgtcagcatcacggtgcacaattttggaccctgaagatgagtttgacatcgaagaatgcaagagtggaacagaggaggctgggtcccgcctctgcggaggcaccatgtcagccctggactccatattctcatgccattacaggagagagatgagaacactggtcttgttgaaaacactatcactcagagcctccgatacagcagtttatctgttttgttaattgatatcaccaccttcccaaagattctgttctcccaattgtggtaaaggccgaagtcgtcttcttcttattcttctttttcttttttcagacagtgtctcgctctgctgccaaagctggagtgcagtggcgtgatcacagctcactgcaaccttgagctcctgggctcaagtgatctcccacatcagcctcccgagtaggtggaactacaggcatgtgccaccatgcctggctgattgttttatgatttttttttgtagagacggggtcttgctatgttgcccaagctggtcttgaattcctggcctcaggtgatccttccttcttggcctctcaaagcactgggatgtcaggtgtgagctgccactcccggcctctgaaggcctcttgatggtgcagctaccccagcttctagcattttaatccctttcctcttatcactactcatgataaggccagcactcaaaatagagggtccccaagatggtc

SEQ ID NO: 352 - DNA, 12997 bp, Homo sapiens
acatttcttttcctttccatagacttttattctcccagtgagaagacaaatctgtttcccctccaccagaaggcctcaagccacagctacttacattatagtaattaaatccctgctgctaggagggttcaggagacaagcaggactcgtgccaagggctggcctgcagggaggaggcagcagggagggaggctggccagaagggcctgtctctcagctgtctcctgagagtgagaaaatccccttagccacgatgtcttcacaggctttcgcttgtgggataggaagataacgccccccgcagcccaccctgccaacatgcaccatcgatgaggacccccgccagctggaatagcgtagctttcttccagttctctccgaaattccatctggtgctcacgaccttcccgcagatggccagtgcaggaaacatcccctcctcaggctccttctctcactctctagatgacaaaacagaggaccagaaactaagctgccccacacctagcctaggatgcttctcctcacctgcaactcagctggccttcacagagcgctccatgtgtgccagaaaccatgtcctctgccttacaaacagcaatatctcattaactctcatgacagccccagcggccaggttaggattcacccccatggaaactgtgaatcaaagcactgagacagcttcccaaagccacacagcctacagtaagtgacacagccagcgctgtacccaatatctgcttggcactaaagcctgttctcctaacaccaggctagatagcccatatagaagaatcagaggatggcctgggagacagatatgagggaggatggaagaagtgagggtgagatggaccttcaggaaatggggggaaggggagcagacggaggcgtgggacaccaagtctcaggcttgtgggtcaaacccaagccacatgtgtgtgcccttgtctctcgcaaagctcacatcagacctgttgttacttgttcagtgcctgcctcccccaccagcctgtgagctccatgtctatttggtgctgaacccccagaaccaaccagaacacgccaggcagtgcccttgtctcatttattcctcatgacacccattctcatgagagagagaaaacactgttaaccccattcacagacctggagactgaggctcaaagaggtcagttttctcaacaaggctgcacagccgagaagccacagagctgcggcaagaacactaggacgcatgctgttgagggctcgggtggcccctccagggcccacaggagactttcctcagccccagagcccagcacggcacctggagcttcagcaaacccctgtatctaaactgccagcatcctcctcccctcctccctctacccttaccccactccatgagcacaaaacatcccctgaggctctgggggaggctggcaggggactgagggtggcacagtaaggggtggggtgggcgggagtggagagctcaggcagggcaggagaagctttttggcttgaaagagcccagtctaggatctgatatgcaaaagcatgtctgctgcacaatgtgagggcgtcggagacactcccctgtgtgcaaatccaaactccaccacctcccagctgtgagaccctgagcaagtcacttaaactctcggagccttgggtctgtcatctgtaaaatggggagaattatatctacctcacagggttgttgtgaggacttaatgagatgaggtgtgtaaacacacatagtaggcccttaataaatattctcttctccaccgcctgtcacctcttcactcctgaataagacccggtgttgctttggagtcattcttacggaaggaaaaataagttcccatgtaatgagagcggtgccttcccccaagctgctgtggacacaggctttctttctatatgatcccgtccacccaccaggaaaccctcatgactcaactccatcctagacttgctctcagcttgcatcaatttcatttcactcttaagggatctttccatcgctggcacatagtgtgcaccccgtcaggtgtcttctgccaaaatgccctcccaccaggctcagcaccattactctcccagagcaggggaaagcatcttggcagagcttaacaccaggtccagcccagagcaggaggggctgggaaccatgggcccagctgtgagggaccttgcatgatcccaaggccactgagctctcagaagaaacaaccaaggtaaaacccaccattgcccagcatggacaagagccccctgggtgacagctctggcccacgttgaattcttcacctctccacccacaagaggaattaaaataccacctcccaaataaaggggccgctgcgcaaggccacacagccaaatagccaggatttgaatccaggtctatggggaaagcctgtgctctcttaggaagagttggtggagaacaacacatctggctggggagagacccccctggagtctgtaaggcacagattctctgcactcctgccgcctggagcagggcttgccacacagtgggtgttcaggatatgtttccagaagagggatgggagaaacaaaaagagaggaagaactaaaaccaggaattccaggattccagctatgcccctgccactaacaatgctgagtagcctcggacaagtcatgtaacttttttttttttttttttgagacaaggtgtcactatgttgcccaggctggtcttgaggtcctggactcaaccgatcctcccgcctcagcctcccaaagtgctggattacaggtgtgagccaccgcataacttctatgggccttggggtcctataaggaggaggatggtcctttccctgccttcctcacagggctgggaggcatatgcagggatcttgcccacccaggctagcacacctggctggcctacagagcttggccatctagggcaggtatggtgcccccctgaggaggcctcccctgcatcctccaccaatgccatccagctctgagccctccaaaggcggtggctcaaccctgagcaacatgcctaccccaagccctcaccttgggagaaggtaacatcacccatgcaggcagctccggccattcccatgtatgggagatttttggggagccaacatcttacccactggaagccagaaaagaaagaaaatagctaaactccaattcgttaaaatcagaaatctcaaaaggggttttgctctgcaaaaatcgctgctagtggaagcttgcgaggaggcaggctgatgccaactcaggcaaaggggctaggaggagccaccacttgctggcagcccaggagcacccacagccaggctggccacttgaccaaccactagcaagtgtcatcctccccaggttagtggatgtcagtctccccacatccattacaaacggggacactgaggctcggagagtttgaggcacagagcttaaggaaaaccaacggtggcagatggaccagaatgagcaagggcagcctctccctgcctccctgcagggccccctcagctcaaagccactgacaggtcagcaaggttcaatggctcaagccaggcaacaggtcatctgcttcctcctccctacctactgggtaacctgggcagggcacccacctttataggtctctccatctataacctgaagcaaaacaccaaacaactgtccttgcagatgtcgcgtggcaggcctggtatcagcaagctctaaggagtaggtgccagctcagtccctgcaaggagtgtcctttaagctgactttcctgttaatttgacactgagcagcactcctgtcctttaagaaaaatgcccaacaagctgactcaaaaataacagatgccaatttgcatattatttcacacatcatttgcatgctgttcatttagtatcatcaaggctctgctcagaatacaactctggttaccctgtgcccagggcttgtgaaacagatatggcttccacaaagggcaagccctgggcacgtccctcccctgcccagctgctcttgctgcctgccccctggcacctggctgggaacgtcacccactgccacagccctggtgctccaagcagggtgaaggggcagaaagaatctttagaattctaggaagcaccctgactcaagtcttgaaggggaaattgtgttctcttgacgacgcatcaggcaagctgtggcaatgcttttcttccctgcttctgtcccaggtcagcttcctagttcggctctccctgtggccctactctctcagcctttttctgcctggtcatcgtgtgtccccctgaccttcctccaggcctctcagcctctggcctggccccacgggtttatttttgttctctctccacctgtccgatttgcatgtccacacccggttagctctgcccagaccacaaattgctaactgagtgtagaataacagggccccatggggtaagaaggctccagaagtccagcccaggccaccactgcagccctgccctccggagaacagcccacttcctttttactcacacagattcacccaacaaggtctatccagaaacatgactggggagcttgtcacggacgggaagccatttggctcatgagaaaaggggcatgttccacacgtgctctccaggcagggacacctgcagacagtggaggggtgacatgggcgcatatgcccctcctgtcttgatgctccaggtggcatcttctaaccaccactctaataaaggcaacagttgccagctgctgagacccagtgtgtggctggctctgtggtggctgctgtgctacagccagtagttgtgattccctcttaacactgaggaaataggctttgggttcagtaagttcccagagcgcccatcactggtgtgccacccaagtttttttttttttttttttttgagatggagtctcactctgttgcccaggctggagtgcagtggcgcgatctcggctcactgcaacctccgcctcccgggttcaagcgattctccagcctcagcctcccaaggagctgggataacaggcgtgagccaccaggtccggctaattttcttatttttagtagagatgaggtttcgccatgttggccaggctggtctcgagctcctgacctcaggtgatccaccctccttggcctctcaaagtgctgcgattacaggtatgagccaccgcgcctggccccaagtccttaactaccaagcctggccacctctaaaaggaaggatatcaggtcttcggggcctgagtgtgcagaactctgcagccctggtggttactgatgctaccaaatattccatccatcactgtgccctcgccctgggcctgtgttcactgcctgcccaaagcctctccagacgagacagtctcctctttcctccctacatgcccctgtgtgcaccacacggcagcaacctgaagctgccctcatgcctgctctattccctacacactctgccccctctccccgggcttctcacactcagaattgagcccctgcccgagcccctcccatcatggcttgtctagtccttcagggaccccccaacctcctacagggaatccacccagcatccccagtctgagtcactgtctccttcctcagtcctcccaagcaccaacaccataaaccaccgtccgcctgggatggatgccatctgggtgctgtctgacacccctaagaacaggactctccggactgtggctgctcatcctcgtgatgaaacatgatctggaatcagattgcgaagcctcggcacaggaagggagttcagctcctgtttttaggccagagaaacgaggcccagagaggggaagggactcgacaaagatcacacaacaagctggaagcaagaggcagaagcacctcctgaggggctcaaagcagagacgggccttttctcggcactcactgcccatgacagagctcaacagaggcatgaggcacagacagggacgcaggaaaatgggactcaagaatgaaaaagaaacttctagaaccaggaatggagaagcccttcgaggtccctcactcaaatccccagcagaagtttgtggtggggtttggaatagggaaatcagaagtgtactgagacctgagctctcattctagaaccctctctttcctgagatgggcacctggagtgaggcactcaaccctgggaacccctgtgcagccgagttttctcatccctgagatagttggtcatcatgagccctgggccagccaccgtgagggtcatgagggacccaggggtgaaaatgccttgtaagatgtaagatgctgagctcatgtgactgtcccccgataaacagccacacagccagtgctggaggagaaaggcagcctaagagaagagcaaggtggaggtgaggggtgagagagttatgtatggacatgtccagtcaggtctaggggtcctgctggccctccaggggtggaaggtgggggtgctaggggctgtggaaggagcttttgcaggaagggctttcattttccctgtattctccacacctaccctcctcacaacctgcccggtatcaccctgagggcagcagcaccagaccccagagaggaggcatcaagaactgaccttgggccagtccacaatctcaccctgatcccaggccaacctggggtgcccacacttgccctggccacccctccagcactgtcttctccaggacctgcgccagcatctcccgccctccatcaagcccttcctgcccagctcgtggtaaagttcctcctgttccaacattttgcatcacgggtctcagtgccataaactcaatttttctcttttaaggatatgggcagcagcaggcaagggaaagggcatgaacttgggagctaaacgggcttgggttcttatctcagtgccaccaccgctggcagtgtcagtgtggcccggtgacttcatctacacagggggcggtgagcacgacctgctccttgtactcccgggtgtaatgtaaagccagcccagcactcagcaaatggtccttgccttcccctctcctgtcactcagcaacatcccggccagcccagcgaagtgctgggtgaccagaaagtagcgtggtccctgcccccagctgctcctcccctcctttccctcagatcccagctgagctcctgggggtggaatgacagggtcgggggagggggcacttaaaaacccattcgcctcctccggactttcctcacccgaagaaaaggcactagaattttcctccctacagctcctgggaaaagcacagtctcagaattccccaccctcattatttaaagaggaataggtgccttgctttcttgctctccttttggggttttgaaagaaagagaagaaaaagaactacaaatgaatgtgctggcctgcctgtcactgagctgagtaaagtggtatttcatcaatatacagccgcccctcacaacccccgcacacactcattttctcccccaaatgtgcttcacaaataactgcaacagagctgaagcgctctattctgatcttacatttccatccaggccccagattctctacagaggttactcaaatttcttttcattttgactttctttaccttatatttttttaaagcagatcttttgaccatggccttacaaatccctcttcctaaaagcacaataagagaaatacgaggcatcagccgcctttctacttaggctgtgcaggagataagtgccccagccaggatgcccctggcggagcacctgggtaatgccgcctgtggggaagggaagtccggatgtgtgatgaagtctttccccaggacagttataaatagtgtgatgacacgcaaaggagaagcatatataaaaagttagctgtccccctgtgggttacagatgtttgactcatttacagactgtccacaaagattataaataaagtcaccaccaccctggggcgggtggcggagaaggccattttcacgctgtcaaaaggccattttcacgcttgccctcctgtgggccgacacactcagtgtgacctgtgaagacaaaatgtgtgcctagggccctcggcagtgggctcgcaggctctcagccagtctcctgccttctgcatcctggtcctgcaggtcaccccacagggagggtccatggaaagggctggaaagggtctatcctactcctacttttccaccatggcctgaaacacaggcaccagtacccagaggcatcttctcaaaaataccaggacactgtgacagccaacaacctatcccaaagcagcacctgggtccaaacagaaggtgcagagccacttggctagccaagcctgcactgctgctctgcccttctgcagacaaggcttccgtgaccagggagagcagaggatcagaactggttccagtgatactactcaatcatttggtctagaggctggggatggactcagggacctctgtgaggtctgcaaagagacagacaagttggccttggccattctgtttaaagagtgaatggccagacgaccaggctcccctgggcatacggagaagcggcctcccatgaggttgtctgaagaaagagtaactagaagtgggaaaagaagacactgtgggagcagacagggcagcctggataagcatcttcacaccaactcctctctgccacctgggttaccccagcaacgaggccaggcaggggccacagagaggagcagaggggcaggaaatcagtggggcaggcgagacaggagcatggtgggggagtgggcagaggactggttctgcctgggaggagagatgcagaccagtttcaaggccgggcatggggaagtggcttgaggttgtacagattggtggaaaagaagagccatgctgccacaccagcactctccagcctcccctgagaagatcccacagcccaacgcctgagatcccgagaaacaaggcccctgggtgccttgccagccacacagaggtaccagctcagccaccaacatgatggcagggtcagggtggtgaagtcacagcctggggaaaggggagggcagccaggcctttcccttccctaattctttctgaacccagggaagagagcatacaggtaatttaatgcaatggagtgggtgtgccccaaaccagctctaaaagaaaataaagaacactaagaaggactccccaggtccttgctggtctacccaggtggcaccgatcagtacagatgatgtgattaagattctcaacagaatctctagaccaggcctcgtcacaatgtctaagacttcagagagtaaacctgcctattaaaaaaaaaaaaaggactcctcatttggttcaagggtcacctggtacctttaggagcccactggggccatctcaggcatctctgccgtttgatctcatgtcccaggcataataatgagaagctctcctcttatctgagctcacccaggaatcaagccccacctccctgctccaggctgatgcctcctagcagagcttacttccatcatcagcacctacaggcctgtgaggcaggagctggggatgttctgtcccggttgctcaaccccctcacattggctcccatttgcattaactgaacatgctcagggcacatgccaccctccttttcaaaagacccaggcctgcatgacaagttacttccccagcagcagccacccgccaaacataggtgaacagcaaggccacaaccccacggaaaaaaaagcagagaacttcagaaagcagcagctcaggcacaaggttagttaatcttcaatcacctggggaaaaaaaaagtttgtcacctcccaagggcctttgagtgggagctgccactggatgggcagaattacctaatctgcctggtacccctgaggttgccttgtccatccgcctgcctccagactggtcagcagggccaaccaggcacacaaagctctccagcaaaagagtgtcacccatccctccccagggtccactgaatgtccctgagctctcctgggctgtgactaacccagaccatggaggagtagagaccacttcctccatgaaactgggacacagatattcacctccccccaagaataaaccatgcttaaaggtggtctctagtcagacccagtcccttctcaggacttcttccctcccagatacaacttctcactccgttgacaagtcttagatcccaatctgttaaagctccaactaattttacagccagagttagataacaggaaaaagatatctcctttcctctcatcattgtcatcatcagtaacaatcacaataggtcccatttgttgagcaggcagatacgtgccttacacgtctctaatttaattctccctactcgacagctggggaaacaggctcgctaaagctccatgacttatccaagatcacacaaatagtagtggcagagctgggattccaactctggcccagttccttgaaatgttcccatttgcctccaggagagagggatatctatcttggccctgcagtgtgtacaaggcctggtacataggagacacccagaaaatacttgtttcataaatgactcaaaacatggatggacagtgcagggatgggtgaatgagtgagcaagttaaatgagctctgcttatctcaagaccagccccaaggcacacaggaagtggccgctgaggcaagaaggacctctcagctactgccccctcggtgcacgccactgctgctatgagggtctgtgattcagaaatgcggggagccaagcacctcaggtggcctcccctttcattcacctaaaatctgccttccgcatctctgggaaagcccctttccctgagctccccctcaggggtggcacctgccccaggcagggaagagggcctgatcctgcagagtggtgactctcccgtcgcgttaagacaaatgtgcatagatcccacactgggatctgtgcacagccactgtctctgggaatagccgtttccttaagaactctgactacgggtgtcactgaaagagaaggtgctgggattgccccttccccacaccccccttgcatttgggccttcatcagttttccccagtgagggcccctggtctccaagggaggactggagagagccagggctgtgaccagggcagctgccagtcctagcgaggctgccagccccatatcctggagcgcccagcaggagaggcggttctgagaaggcagcgagcagaaggacccgcagacgcagaggctcattacagggaatgactaagtgagctgcgcttccaagggaaaccccactcgcttctgctcgctgagacgctcatccttgagctattttgactaaggcggcttccaggtgctgccctccgctggggcagcccactgagagagcagccgggttgctggaggaccctctgcctggaagtcttggtcctggctattcaggtcgtctgacaggtctgccccacccgtttccagggcgggaaagtctgcccatcaccgattaaagtgagatgctgggaatgggggaaatccgatcagcacctcctaggtttttgcggctggatttcaataaggaatgtgacagtctcgcagcagctgtgccctgcctgaaacaagctctatttgaaacctccaacagctgaacccctcccagctacccgatggccagcccgcccagccacccccccaccaagccaccccctgccccaaatgacaaataaatagaaaaacccaagcaacaagcaggcgcatgcatacgtacaaacattacgcacatacacacacacacaccaacaaattgggggtgggggtatcgtggagccacttgtccaccgattcccaggtctccaagccttccagcccacagcaggagagctccccggcaagcagagcatcggcagaaacccaccttcctccatctccactccctctgggagggaaaccccctcctccgtcttggggctggactgagaggctggagcagtggggccagctccccgctaaagccagtgcctgctgttctccatccgggcgcgcactcacacacacactcatctttatttatcccaaggaggagttgaggtgggaggggagaactggggctgagctggggcgcgggcttgtggggaccgcctgggaagccctgtcatcccgtcccaaggagaggtgctcccccagctgattccaaggcggcgcccagctgctctgcccaggtaacacctgtagccatttttatcaggagatgtttacgaagcagcagcaggtttattctgagtcctctctcctgagggaaaggaccactgatttcctccacctatatttttaccccatgccctcaggagacccaggtcatggatggttttctattttgcccgagactctctgagaagaggagggaaacagaaacttgggaagagatggagaagacagggagagaagggacttgggcaatggtacggaatccccaccccccacccagacatttatttcttttttatcctcaggaaaatggagtggagcagggaggggaggaaagaaggggaagtcgcaggaactggcaaacacatgaaggcggagtgtaattaattggtgcgttaagctgctgggttatgctttagtacgagtgagccaggaggaaaagcgatttctcagaagggattattgaatcctccctaacagagagtctgcaaattagacacagtgtgtggggatgtcccctaccccccagaggaagctaggaatgaattctcccgggatcaagaaggaaaaccacgggaagttagagtgttgaatataactgagcaagcgcctctcaccaccaccaccacctctctctcccagtctccctcccaatctctcaatctctctctctctctctctctctctctctctctctcaatctctctctctcacaatccccctctctcaatccctctcttgctacctacatattccttttgttcaaggtataaagagaaaccacagcccctacctttgagtacaaaccccaagagagctcg

SEQ ID NO: 353 - DNA, 4718 bp, Homo sapiens
cttagacctccaagcaagttctttaaaggtgacaagttaaacagtagtttttaagataatattttgatgaaatttttaatcatattattacaagattttagaagaagcaagatcttgtgaaaacaaaaccttaatgtccatatctagctctctaaatctatagtcagtctttaaaagagtgacacaaaaatgacacagatccgccctctggttcgctccccatatattagagcctggtaatcttccaaagtttttacagcatgaggcatacacagaatagatgcaaaaaaagtacaccttctgaaatttcctgaatggattcaaacttttactattctaagttaatcaattggtagtctacttactttataggattattgtaaggataggatcaatgaagtgaaatatattttattttcactggtcaattactcgtattaaagcaatttcatgcactttatctccctctcttggaaactggagagtagtactttttgtctggttacttaagattaaaaaaaagacaatatgtcacttttgacttgagtgtcatggtatctatggccttcaacctgcatggttttatcgtttcagtaatcttgggaggaaggtattattaagttcatttgataaataggagactgagcctccacaagggttaagtgaattgctcagggttatacaatgaacacttgatagaaatgattaaatgacactttacttgatttgttgtgggttactaaataaagcataggtgtgcataagtcattcaattattcaagcacattcttcatccctagtcctaatatcgaaagtctttgctcttagtttttataactacaaggatattcatcaaaagacccaagctcaggaataagcctaaagaggtagtcagactagaacaaaagacaattcacagacttaaatgaataatttgcattaatgaagtttgccaggctagtttccacttgaatcttcagatctttcttccttcattgtcttgttaactgtccagatttattacctaggagtttttgaaaactcacatattaggcaatagagtgtattctggaattgagagcctattttaaacttttgactaaaaagtttacccattaaatgtcatagattcaaccatcagactgaaaatcctcagtgtatttgaaggagggtattgtctcaaaaatccagagctcaaagtgaagaagaaaggcaaaatttggaatttagctctaagaccaactcatcagttcaggggtcagagatttatatagttaaaggacaagtgtgtgtttacctgagtttaaagagcaaagttgcctctggaaagaagccctcactggaggctctggcatttgaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctggtaagcttgaggcgctgataaaaactctctaccctaatgtttactccatgttttttccaaatgaaacttctgtcagctagaatccttgtcatagtgttttagaggtttttttctgctactctcttctttttttatatatattctttttgtaaataaaaatggtatgaccttcctaaaggccccacctttagaaatgggttaaatgaaaagatctttactaatgtaatagaaaagaactgatgaacatagtgcactgaatatggttacatttgacaaaccaaagttagtcctgttcttatttgagtttaagcggtaagattaggtcaaactccagacgagggaaagatattcttaaacagattttaagtcctctgttttctggtaactttaattgtcttatgctgctagtagtcatattaaatatttatttagagaagtgaaaatgcctactcttgaacagagtttcttcccctttcattttatgaaacctaagaaaagaaagttgatacactttttaaaaatatactagattttcttttttcctttctgcttttattttgaggccagtggggtgttatttagtagtaacactgaagcaaatgtattgattttcttaacgtgttcagcaagtaattcatatcctagatatgaaatatacactcgtagcagagtaatgttacccatttctcaatgatatgcttaaagaatcttgctcaatatgcatattgtttttccttttttctttactaatgaaaaactacacgctttctcaacatatttttaagtcaggttctaaactttgaactcctatgtacaatttgcttatttcaggcatgaatgtgaaactgtgtaaagattaactaccagacactcagtcatttatttaactatttagccctaaatcagtgggtgactaggagattctgaattctgtgatttcgttaaaatcaatcagtttttaattattatacaagctttttactttaaagttgtagctgtctaaataaaattgtgaaagcacaatttccaaacctaaatcgaaggcacattgatgctgtccatcagaaggtattgataatttaaaaaaatattacaaactatcttttatctttttataaaggacctaatgtcatttgagcttaaccataatcctttgaagaaagtaaaatttaactttaaataacattgacatacagagcagttaggtgatttgtctgagaccatatggtatgtatgtcccccgtcttgataaaattaacactaaatatgtaacatttgaaaatttgtaaaatatgtaaaagttgaagtttttaaaagtttggatttaagttcttcctttcagaatatgagcatgtcactttatttgcaaactaaacatggcataacattatggcttgtgaacactaattgtcttagctgctggggtgaatgcagaattaagcagcaattagtatgagtgaataaattgcatccttagagtgagtgcactatgctattctgggaactaaagactatatttgagaccatgcgaagttgtgcaagtggtggagtagggcagggtgcagtcatttggaagactatgcccatcaggtatctcaaggtaccccagatgtgacaggcccaggagcggaaccagccactttaacttttgcctggctgaaactggactgggaaggatggattaaaaaggtaaatcaattcatacgtagcttgtggtcctttgcagcttaagtgtaggactgaaaaaagaagccaaagaaaaagggaatgagctgaagaaatacacacacgtacacacacacatcaggaagcaacaggcaaggaaaaataaagtgagaggttcaaggcttcgaggaggaattgagctctgtgcattccattcatgggctttgccaaagaccagcacaatggactcagcatctcaggcatggttaagtaccctactgtgcactctgctatccttttagtccactggtttctactctgtctgtgccaggttttcatctcaatatagaggaaaaggattctgatgcctcaggattattacaagcattaaataagatacagatagaatgacgctaatgagtatcatttttaaaataaggaaagttgaattttattcagaatctgttggtaacaaactaatctctttatttaagtaaccccacttagagtttaaagtcacctccaatcaactcaaagggctgacctcccaaagaaagtctcaaatataaggcaagctctcttgattctgaatttcattagaaatgtttgtctaagtctttctcatatggtcagaatgagagagggtgcccttctagtaatatgtcattatgtcaaataattcatcaaccaattttgtttattctctcgaactgccactttggcggcaggggtactctgtctaaatgagatgtctataaagataaattaaacatgattcaggcccccaggtagagttcagttcagtagggtagaacagcaactcagtccagctaccatcagtaatatgtttgtagtaagactaatctgatagtaaggcagaaaaacatctcatggaattttaggaatagccaagaagatgggtcccctggagacttgcacatagcatgttgcatgaaggattcagtgacttgcaagatgggcttgtcttgtcaccttttcaggagacatagctgttcaatcccttgccattgtgtaactaagtgactcttacttgctgctggaatcacttcatgcttttcatgctttaacaatcagtggttctgttttactttgaaaaatgagtcattctatgacagtattcctcctagaccctagcatttcatagcttctatctatgattattttaaattctagctcctgtatctaactgaatgaataagcacatcccacagctcagattcctgaaagaatttgattatgtactcagctaaacatcatcactgtttggttagagcttttatagcaaataattcacagatctttgatgaaactacattgtctttagtgggtaagtgtccaacagaggtctaataaactatgaccaggcaattgataatgccaagcggtagagacacagtgatctctcttcaaaatgcagtttccttcatcagaaagctatgtgtgg

SEQ ID NO: 354 - DNA, 767889 bp, Homo sapiens
aataggaatatcatggtaaacgttgctttaattgaacagtggaatctatgctagtcttcatgacgaaccttgaaacacaagagtgctgcagtaaccatcattcctgaattgtggaacttcacagactcaggttagccccaagtgatgctttgctgagcaatttaaaacccagtcatgcaaagccaagtgctttcatgtttgagaaacaaaaacatttcaactgctcagcacatctaaatcagtactcccttaacaacccaccttggttcttccccttgattctgaaagccaatttagtaagaaaagcatattaataatcttgccctctcactggccttccctccctccctcctattccagcatcttgcagctggtaccttgggtcatttgttttgtttttgtcccttaggctgaagtgcgtccacagttttgaaactgctaactagagtttatatggaaaattcagattagaaacaaattcaaatgcactctctcattttcctgtaatacactgggtttcttcccccaatcagctagaagacttgctgggtacctcctcattgtgtcctgttggaaagtgtctcttctggtcaccttgactgttaaataagtaaacagactcattggggttgctgtgtcctgtgacattggcacagactctcaccccagccaagcatgcacatatcaatgggccaccatctgtggcagaattaccagacccaagatggaatttgatgcatctgtcctggtgaaatggcattatacttctgccatattcttctggttcaagaacattgtcctcaagcccaagggacagccctgtccagcataaacatgattaaaatgcccattgcccgactgccctgctgaccaagaaacatggccaagcacagagtctgcaagcagcctgcatgtgggtctaaagaagaggaagggggaaagtgtttccagaaagtaaggttgccaagatttgaatctcaatgtcacaatctggctttatgaccttgggtgagtcccttaatcccacagagcctcagtttccccatctgtaaaatgaagagtaccaatatcctgatgtgttgtgaggattacatgagatcattttcgtaaagcaccctagcacagagcctgatacagtgtcattgggagctaagatttaccagcactcatcatataccaggccttgtgcatgaaccccacctacattatgtcattaagcatcactgcatgcataagaaatgggtgttaccatccctatgttacaacagagaagactgatggtcagaaaagttaagtaacctgcacaaaggcaaggaggtagagacgagtgaacttaggattggaactcaggactctcttaaccacatgaagagaatccaagtggaaggtgcctcctaccaacgctgagatgaggttcgtgtctgtgggcccctgtctgaggctggttgacaagaagctttagagagacgcttggggatggcaggcttgcagccagaggccagggtttgactcctgtatgggctgtgtgaccaggggcctctttaccgctcgggtgtgcttcacctccttcctccataagacaaggacaactgcatcttccctgtaagactattgggaataaaacaatagggctttgtgacctttgacctaaggtaggattcttatactaccccatgctctatgacatgataagaagacagtaccaacactcagcacagtgttaaaagattccagcaaataataatggatactaacataataatagctaccatatatagaatacattatatttcagaaactgtactaaaaccttaattaaagcacttaatcctcaatgcaaccctgtgaagtagatgctttttattatccccttttacagatgaggaaactgaggcatgtaatgattaggtgacttgctcaaggtcacaaaactaagtgctgaaaacttgggattcacatggttgcatcaaaactttattgaaaggattggtcaatccaagtgaacaacacatctggactgtgccccatagaaacaagcattttagtttcactagaatcaccgggataaacagaggcaagctaacccctttactacaggacatctatggtctttaacttgtaaatacgaggaaaccatcaagagggagatagagtatgcagcctttcctgagctttgaggggcaacagtgtgctctgacatacgattcgagatgtaccaagtctgagtcatttaccctaaatagaacagccttccattggctgttggaaacacaaagtaaaacccaaagaagagagaaagcaaaagtgaagaggccattgtcctcgatcctttatcttttgttctctgattcagatcaggagaggtgtgtatgcctgcagacctggacacccgcaagccacatgctgaatgaaggcccacagaagtcccaaaaaaagatggaaccagggaaaggaggtcagcctggaacagtcctgggaagctgagacccagcccagaacctgctggaatcaatagtctttaacacaactgtgacattagcttgggctgctgggatccgtcttgaaagaagaagctttgtatatttctgctcttattccccacaggatccagaaatatatttctgtaattcttttagctgataagtatgaaaaacagaattttaaatattccagtagggacctgacagaacagggccatcttcattagctgctgaatttcccaatgactcctagaaattgacacaattagacaaaattaagtgcttctgtcctgaggataggccgccactgttctttagggcatatctttgcaaaggaaggtgctggaattcctcacaaaagccacatccctctctctctcacactctttctctgagcaaatctaaaatctagtgccaaattccttggagctaattctaaaaccaggaaagctttttgtaagattataaagattgtattggactttgaagatgagtccctttgctcagcaacttactttcttaatgcaatccctgaattctccttgctatgctctgaatgtttatgcctgcccacccccaattcatacgttgaaacctcatcaccaatgtaattatattaagagatgaagcctttgggaggtgataacgtcatggagacagagctctcatgaatgagattcatgcccttataaaagagcctccagagagctgccttgccccttccaccatgtgaggacacagcaagaaagtgccatctatgaaccagacagcgggccctcaccagacaccaaatctgctggtgtcttgaccttgaactttccagcctccagaactgtgagaaataaatgtgcttatcagccccccaagtttatggtatcttgttacagcaggccaaacagactaagacattcctccatcctcccatcgactgggcaaaaggataatattacttccatttctatggtgattatggaaactcagacccagcaagtggctcccaacccactgggtgagtaagcagggaaactgaggttaggaaatgaactcagttccttttctccccatcatcttttctcccctataagaaacttatcagcagttcttttgcatgtagagtcaatcagaaaatcattagccaaggtcagacaagaaaccacagctttggtttctttgatttcaaggttagaataagagcaatggaactttaaagagcatggatggtagtaactgtctctgagaagccagccactcaaactttccaggcccagaatcaacatttatttggaaaaactttttgttgtccatttttttaaagagctctaaacttccagtgagtcttatgtagatctatttatatgcccatttcttcttttattttttgagacagagtctcgctctgtcacccagcctggagtatagtggtacgatctcggcttggctcaccgcaacctctgcctcccaggctcaagcgattctcctgcttcagcctcccgagtagctgggactacaggcgcctgccaccacacccggctaatttttgtatttttaatagagatggggtttcaccatgttggccaggccagtcacaaactcctcacctcaggtgatccaccagccacggcctcccaaagtgctgggattataagcatgatccactgtgcccagcctacatgcccatttcataggcaagaatactgatgcatagggcacaccacactttacaggcacaagaatgaacaagtctttagagggtaactatttcttgtgcaagaatcaaatgcaactgctgacacttacagttttatcactggtgacagcatgagtggctgagtgagcaggatgaatcttgagcctggggtgtagaccagagcaggggcttccaggtgctcacacctctggaaagcaagaggaactggaacagttggagttcagaataggctaaaaaatctcctgccagtcttcacagcagaatctctgagtggagcacacagccattttgaagttggcctacttggatgccagggctcaaaaattctaatgtggccaaagaaaccttcagagaactacagcaaattcaactgataaatttgttctactctagaaaagacactgccaaaattccagtccctatctatcagggaccttggataagtcccttcccctgcatgcatatcatcacagaccatcctcatatgggggtggggagggtgtctctctcccctcttcagctgccttcctacctccaggggtgcaccaattcactgtgatgacctcacaatcatgcctggtgattatgaggacttagtgggatgatgctctgggcaaccacagggattgctcaccggtgactcagtggttgactcaaaggctagagggtggtttgggggtggaggcagaggtccagtgagctgggctccaccctttctctccctgcagtcccaactccatttttatctgtgctatatgttggagtctagccaagatgtcatttgaacaaagattctgaaagatcaaagaaaaaagtttgaaaaccaccaggacaatgctttcaggggactttatccaaaagactgcaacaatgtaaagagatacgattgcttttattactgtgatatgtttaaagtattataaattttttaagagctttgtaagtgacagaagtgaagacatgctcattttaatgttaccagtcaactctgagaagactaaaggtcaagggacaatgaaaatgtgacccttaccaacgacagaaactcccaggaagccacaattaactcaagaccaccaggatatttggggaagtttatccttctggaaaccagaatttctgatttgtggaaaattctatagatattctctgccagactccagcctatttggtaagctggccacagatgatttagaacacaatgaccctgatactcactagagctctgagtgtggctggataagcccatttcagcagcatgtcagcccctccctgaactaggctctgtcactcagatctcagatcttagggcagctgtagtctgccccttgctttcttattaccccagataaccaatgttatcctctgtttttccttcctcccagggggaaaagaattcagaaccctagtctgagtatatgaattagactctgcaaattgtttatatgagtcattctcaaaactaggtctggagggtccccaagagatccacaaatttcttgcaatattcatgtaacaatgttcatctctttagatctattaccattgagtaacccattgatatttaacaacaaaacaacagcaaacaccatcctgatagctttaaaagcaaccctgttcttctaattgtttctagtgcatgctttttgaagctaaactagtagactggattgtcctcaagtagactggctcaccaaaggtgtccacaacaagaacatttcaagttcagattggacaggaatatttatgagggtttgaccagtgctagacttgccagacaatgtgcctgaatagtctccctgaacttctctcttaaacacaaacaagatcctatgctggctttctggccacacctgtgccagccacaaatgggctaaaacacgtgaaatgtgctgtccgcgtgcagggttcaaatcagataacaaaatacacattgacggttctctatagaatgaaaaatatcctactttcattgcatgctggtgttgggtcagaaaacaacagtttcttatttctcctggttagtggtcctttggaaatcacagaggaaatacatgcagagagttaagaggactacttcacatctgttgtcccgtgatgctacttaactgaacactacactcatgtgcccattcccgttccctttcccctttatggtaaatgttgtcccatatgactttgtgattgatggaaatgttctctatctgtgctgcccaatatggtagccactaaccacacatggctattgagtactcaaaaggtggctaatgcaaagagaaactgaacctgtaatttcatttaaacttaaacaaccactcgtgtctagtggctaccatataaaacagtgaactaagtctaaaatttaggatcttgcagtacagggtgtgtgtgtgtgtgtgtgtgtgtgtgtttgtgtgtgtgtgttaacaaaacaaacactgctccttctgtagtgagcactggcctatggccagggtctaaggaatatgcaaaagaaagtgactggaagttttaagcttttaaggttttatcaaaagacatttcttaccactccctctgggcagtactgtagaacatctactagggagaggatgatatgaagatagagaagcaacaaaagtacagacacattagaggcaaaatatagatgccaccttgtaaactggttgataattcagaaaatgacagctctccccgacttagttggaaaggcaaaggccaaatgggaaacatcagtctcttcacgtccatggaagacaatcccctgaatgcaaaattagaacttggtggctatttcctgatccagccccttgtatttttcatgaagcttaaaggagattaatgggacaatcaggatattacagatgagaagcacaggcatttcaaatgaggctgtgacaaatggctgggaggcctttagaatgggggaagagaggatgtggaacaagccctggactgggaagctcctcactatgattcacaccctggtcctgctaatgaccacctggccaggagaccctggagaggcatccaacccttccctgagagccactggacagaggaataggagccccatcactgagtggttgtagggctcaagaaggatcatattggcagcaagaactccagaaactataaagctctatttagatgaatcacattattattaaacagttcaatcaacataataattattaataatagctaagatttattcagtgtctgctattgccagacaatatatatgcaaagtctctagggcttacagcaaccctataagatatgtctatctatccacatcattcgtgcttactagatgctgttacaagtgttttccatatatatgaaggtatatataatatatacatatataatgcataaaatttgtaaatgagttaaatgaggattaatccttacaacaacctataatgtggacattacttgtatcaatattttacagatgaaacaattgaggccaaagagataaagtgacagccaccatcatcccaactaagttggaaggccaaatgacaaaaggaaacataagaacgcaattacctgaatgacagattagaactcagggattatttcttgatccaggcttagtcaatggaagagctgggacatgaacgcaggcacagttggtgaacagtagagccaggattcagactcaggcagcctggctacagggcctgttttcttcaaccccatggcatcctgcctctttttttgggggggggggtggtgggggtggaggggtggggatggagtcttgttctgtcacccaggctggagttcagtgagtggtgcaatctcggctaactgcaacctccgcctcctgggttcaagcgattctcctgcctcagcctcccaagtagctgggactacagatgcgtgccaccacacccagctaatttttgtatttttagtagagacagggtttcaccatgttggccatgatggcacgatggtctcgatctcttgacctcgtgatctgcctgcctcagcatcccaaagtgctgaaagtgacagggtaaggatttgaaactcaggcctgcctgcctgtctccaaccactcagtcttttcttcagccaccctgcgtccgttacaattcacacactgtttgtcaccactggctaatggctttggatatttcttcctcttatcagtgtgagacatctggggaggctcccctttttttcaccatttgaggactgaaagtaaatttagcttcctcagcagaaagaaaagaagctgttttggaggttgggaagagctttagaaaatgcggcatcacgtctgttgccccatttgaagaaagcagctctggaaaaggcctaggacattagttgctacaaagttctagatcattctgtgtggtaagtatgccatcatgcccatagcactcttctctgtccacaaaattcgtcatatactaataaagaatgggtgtctttggacaaagtcaaagcaagtttgtccagagtactaactaagaagagactacagagggaagcaaaaggtagttcagtggctgaattatccaaggaaaggcctagaatttgagttgtcatagactgagcatcaaagattatgtcttggagctatatagaacctttactgcccaaaaaagagagactatggaaacttcagtgctctggtaaacatttctttgatgccttaccaaaacatatgccttctgagcatttgatatggtttggctctgtgtccccacccaaatctcatcttgaattgtattcccataattcccacgtattgtgggagggattccgtgggagataatctgaatcacggggtggtttcccccatactgttctcgtggtagcgaataaatctcatgagatctgatggttttatcaggggtttccacttttgcatcctcctcatttttatcttgctgctgtcaggtaaagaagtgcctttcacctcccactgtgattctgaggcctccccagccatgtggaactgtaagtccaatttaacctctttttcttcacagtctcaggtatgtctttatcagcagtgtgaaaacggactaatatagcatccgttgtccacttcctccttccatcagtctgcaaaattccatttggggatccatgtggcttcagggaaatcaactttatcaatgttctctgttccgtggcagcagtgatgggttcagggatgggcatgtgacctaagccagtccaatcagagtgactctcaggtcttgctgaaagtgcctggaaacgatgccatttccttcctgttgggcatgatgaaggaagcatctagccccaggagctccttcagtcatattagggcctaaaaggtgccagcctttgataaagacaccaaaggatatgaaagatagcataagacagaacggagagatggaaagaagccagatccttggtgatattgttgagccaacagatcaagtttggccttaagtcagccctaattctgtgcttttcaattagataagacaatacatgccctttattatttaagcctatttgtgttaggagttctagtctttgcaaatgaaagcacctaactaatactaatgtagatctctgtggccatccttctggtaaaaggagaaggcagagtcaagggtgacattacatttcctgaaactggcagctccatctcatagaaaactcacgcattactcagtgaaaaaacgaccccctgtacacaatatccacgtgggaaactcctactcactcatcaagacccatctctaatgtcccttctgtctcctagactacatttacgtaaaattaatcacttccttctgttttacttccatagaggcatattactcattcttttatgtaactataaacacagagcaattacatacagctcaagggcagagaatgtcttattcatccctaaatgcatcaaacccagcacaagcacatagatgctggattctccaggttgcatggcctttaacaagttctctaccattctgaccctgttttctctcctgtaaaatagggctaattgtatatgtcagaggattgttgtgaaaaatatcaataacggaagctacaggaatttcactaaaatgtgtttaattatagtaaaattaaattgatacataattttgtaaatcttcaatagtctttagctcaatattgatagccaaaaattaagcctggaggatagaaataacttcttaactctacagttggaaaagtgtgggcatagaacttgtctttgccttctagatcaggtctgtgttggtaaattagacaccgtgtggcctttcaacatccaggagcaagatggcaggagaatcatgccaacaactgaggtaccttgcaggaaatcaaacaggaagaaatcacccaatgggatcagctgggcaaacatgggtcaccccaggtctggtccctcaagtctacccaaccaaaccatatcatagtggatagctattatctttacctgactagcattcattgccccttctggtatgccctattccccactctcaatccctctgttttaagaatgcgcccacctccaccttccatctccaggagtgatatccacccaggtttgctcagtaagactatgagacctatcttcctggctgtggtgattggttcagaagcaacatgccaaccaacctgatccaatgagagtgagttctaggacttttgctggaactactgtatgtctatatataaaagagaatctatctttctattgaaagccaaaggtaagaagccaatatgatatgcatttgattctgttacggaaatccacataaaagaaggctgcccaagtataaaaccaacacagaagaaagcagaggtaagagatggaaaaagaaatgagtgaaccagtgacagcaagagactgaagaacatcatttgattgcctggaatcagctaagcctgaagagaagcctaaccctaagcttttcagttacccaagccatcaaattcccatccccatttttttggttcttaagcagcttgaaccatagttgtctcacttgcatgcaagagatccctgaagatacatgcagttcctcaggtgaagattgccatcagttaacagatcctggcacccatggaccctgggacagtcattctggtagcatcctctggtagagaataacatagtcaaatctgacagtcagagagtatctgccagcctctgcttagatatagcccactgaaagggagagatgattaatttagccttgatttcaaaaccttgtcttgtatattccattcagcactttttatcttcctgtattcccctggttcctctctagctgaataaagaacaatttttaaagcaaacatcttcactgtgtatctagcaaagctttctgcttcattggaatatgtgatttatttaaaaaattaaatttcccatgagacgcaataatttaaattaagagaaaagcttgtctttcttaaacttcagtttctacatacaaattgatgttttatagattccagaaactttcactgttatgaagatggctctcagttttcctgctggattcagattctcttcatgacttaaaacaacatgaggaggatgagtcacaactgtaagctggtgaaatgcagaaagaaccacctaggaattcaaatgtcagcttaagaaagacagaatggcttaaaaatcaaagatgagatgaagtggactgggggtctcgggaacaccaagtcacaaaatcagcttacagtcagagggaacttgcaaatgatctgattcaagatacaaagaaaggttttagttcttgaggactttttccagataaatatttgagccaaagcacaatataagaaaaagatgcaagtggaacagctccttcaagcagtgggggatgttaaggaaaagcagggaaaatcagctgagaatcctccgtcccacccccaagactcctgcaacctagctgagagccacagaactggtcctctctctccggctgttctccaacatcccagagccttaggtggggctacactaagaggaagtcctccaaggaaactctcaggattagaccagtctttttctgctagtggtctttgataagcctacatggtaaagagtgggattcactgacttatctgtagtagatattattaaatatgtctcaaagcatctcccccaccttctcacacccacccattagaacaggatgttatctacaggctgatacctccccactccctccacctcccttctaatacatggcaccaagacactgcctaggacctaacaagtgattggcccctccttctccaagacattcccctcttcctttttctcttttaagcccagagggcctgaccctctaacgcctgtcccagaccactctctccctccaggagcctgccaagttgaacacaaagtcctaccacccctgccctcaacacagacttctccaaaacaagtccacaaacaccattcaggatgattcctgctaagacccacagggtgggagtgataaaatttccagtaacatctaccatgatattacttacaatcctaaaagaggaaatgttctgtattacataaaacatgtccaaggtcctcctacaagtacgagtgaatccgtgcctggttcttctttgtcttcggatcctgccacctcatccctgtcgtcatctgtctaagttttgctttagaagccaccctcggtcaaaccttcactctcttacacaatgagctgggcatcctcagtttccccttcatgctaaaagtaagccccatgttttgtgcatgtgcccacaccatttcctcaagttcttgctcctaaaggtaacagggcctgggtaaggcacttcctgcagagatcaaaggagactcgttcacacccaggaggaggaatattcttcctgttctaccccatttaaccctgtcccctcaacccagaggtgtcctcactgtccagcaagtgcttcaggcctgcagttctgctgttaccctattttgaatctcataggtgtggaagcatgtgttggcggggaggggcaggaaggtttgtccgccaggaagaagaaacgagtgtgtcggtatgtgtgtgtgagcgccgcaatgacagtgctgccaccgctgctgctgcatgtgctgggtctttgaatgtggcatctgtcgggctcagtgaggatgacagatgtctctctgctttatgaacaaacaacacaggcctgtggggtgacaaaaacagcctcagcccaaccagagcggagaggtgcagttctctgggaataatcagaagacagcagcgtaggagtccagagtctaccacacacctgctcccctaaaaaagcatgttctcattatgaaaccttagaaggcagctcccacgccagggacaagtataagggagcctgtgtggcctcattcattaccagatgaaccactcattcagggaagtcttgaggcatgtccaggaaatggcgccccaaagacccagttaacccacagggtgagtgcccacggagatgggagctctgggggtgacactgttgagccagtggatcaagcttcaccctgagtcaaccctaattctgtgtttttcaaataaataagccaatcaattttcctgttcatttctgtatccccagcacctagaacagtgcctggcacacagtaggtgcccagtggacattcgctgaaagaacaaacgaatgccaaggcagaaaatgggggtgagaggcaaagatgtataaaaaaagaactaagcagagcaaagcgataagaagaatattaataatatgaaccacaaagacaggaaagtcatctgatttcaatacacaagagtataaactcattatggatgctgaattacactagtgatagtttaaatatttcttggaactgaatatgcacataagaagagcccatcccaggcttgaatgagtgcacattcttgtcttggagaaaaggaagaaaaatatataaagcaataggtacaatacaatgcaacagatgttctagaacaaaggcctggagctatgattccagggcagcctgcaaagatctcccagtggagctgatgattagcaggccttgaagcaaggatggaagcctggcaagaggcaggtcagtcatcacaggcagggatgacagcttccaagaactatgtcgtctgtgagcccaggggccagagagctgctgggtttcccagtctttccaggctatggccaaactgatgaagccatccttgtttcagtctctgattccttcagagaagaagaaagagttgagtctagcagagtctcactctgcctggacgcctgctgtaccaggagagcactccctccacatgccactctaaacagaaatactccccggagcacctgggacgaccggcatcctctgcacttccaaggccttcactcttcccagttttgcttacttcttctcatcttcccattcacttcccagatgtgtttctcgggtctccaaagggaaactcaggggagaaactgagtcaagctactttaaatctcctttcctacctggccctttccacagcactcagcccagaagaggtgctctgggtgaaacaaagcagcagtcggaatctctgcaggccacagggagggagggacgggtagaatcaaggagtggggcactagcacggaggcctgagcctcctcactgccaggatgagggagccgcaatgatctggggtactggcagctctgggagcctctgaatagtgaccctggggctctcagaagtactaggtcaaggtgtcccggtgggcacagctgggcttagtcatcaagacatgggtacaaacctcagctcagtcaccatccagctgtttgagtctgaaagttacttaatctctctaagcacagatgttctcatctatgaaaggactataatgcttgtcttgcggggatgttgttagaattacatgtgatgaggtctaaattgctcctagtacagaataggcaattggtaactcttaactactattagtgtagtattatcatgatcgtcatcgtcatcatcatcatcattggggcagacaaatctcagaccaggcctgagaattcccaactctgaattcagagccttttgctccagcaacagaaatgagaaggtaaggcctaaagtagaacaagactagaggaggccctgaacagtgctgggcgcccaaacagggacttcctcccaggaggcctctgtgccactggcctggggtctcatcatcaccgccagcaacagggtgactggctgccccctggattttctgcaagcaaagaacaggagggcagagcagaaaagcccgggaactaatgagattcagagagctcgaaaattagaggtgcacgaaaggagtttccgcctaattgctctgacacctcccactcccactgccgagtcactgcaaggagcaggcgagtgcaggagcaagaggggatccataggtctgctggtccaggtcactgctctctccaggagcactggctccagttgggagtggcccagggcctttctgcggcctggcaggacagggtggccactgcccgtggctggcccagaagagtccaccttgtgggtcaagagctgcccaggctgatatgtgccttaaaaagcgggaacgaaagcaaggcagcacacagcaagcccaggcacctcctcagccttgcaaatgggagctggtgatatgggctcaggaactgccatttctgacccagcccagacaaatgtggcccaattctctgttcccttggagctgagcccatttgtagccatgccaggcccagggtctccctcagtggctgctggcagttgatagcagctgtccttagagcctcagctgcctctcctgcgctgtgtcctccctaaggggcttccagatcggttgtctcacgcgaggctcccagcaggctggaggagggcaggctggcaaggcagccacactgcccctgcatcacagaggagaggagggtggcccactgacaggccagaggcaaactgagacccttccgatccattgtcccttccctgcacccccaagaacaatgacttagccccaggacacatccttaagaagagggcatccctaaataccaccagcccccaccccctatccccccccaccccccccaccccacacacacacacacacgatgctgggataggctgtgagacaatatggaaacagccagaaagatttgcattcaaatccaggttgtgtcacttcctgcccatatgtctttgggtgctttatgtaacccctctgagcctcaactgctccatccataaagcggagcatgactgggagggataaatggaatggcaagaggaaaacacagtgcccagaggacagcaggctttcaataaatgtgaaatgctctcagcatggccctgcctgacgtcctgcctcagaccccgccgtccagctcacaggacaagccacagccttgtaggacactagaattgctgccagtctgccttcagttccctttgttgtttaggagtctcccctggactatcagcttataagaagacatgtatccatcacaagggcctctgataaatctcttcacggaccgcttgcttatatcaagaggcagaacatttagaaaagacatagtgcctgctgctgtctgggccaagccatcccacaagcaggctgaagtgtgagagaggcagatacattccctttcaaaatgtctatggtcccctggtccatgatataataggagagatgcacagctggcttagcttgcgccgtctcccaatgcggacaggcacctgggagagccaagatcgttagccctccaggcaaaccattcaagtcctcgtgctgtcaaggtgacttacaatattgagagtagtttgagattgttaagaattattattattttttttttctgaaaaatacacagtgagtttctcaactccagtttactccagctaacaccacagctttactgttcctcttccaatcaatagtggaatgaaatgatccagttggaattccagttcaggccacagagctgacatcttctggattcccactcctggggattctcagacccaaaggcaaaatgggccctggtcatgggaaagtccatggctttagatgggcagaatctgcagccactgaggctgcagcacacagcagggaccaaagccaggaacagccaaggacactcaatgccactcctgccttatgccagccctcagggtgagtgcataagctcttcccataaaaatggcatttgcacccttagtaaccttttattcaattcaacttcatctagtcctagtaaatagaattacattacttccttgcttaaaacacttccatggtgcctatgcaaaaatgtaaaatactttctctggcacacaaagcccacatgctcttgccctcctctccagcctccttcatgccagtcactggcttggccatccaattcagactccctggcttcacttctccttccttgactgtgcgtagctctttcttgctttgtagtgagacatacactcctccccgtctttgtccagttaattcctgctcccttttctggtctcagctcaaatgttgcctcctcaagaaaaactcccctgactgcttcccagtacaatttattcccactcctgcccccttctctcctatagttccctgttctttttaaaatggacttgtcaatatgcatgacgatatgtttttgtgtttattgtcctcgctctctgaccatgtaaactctatgaagccagagagaatatcttattctctcgaccagtttgcacaatgcctgacacctagcagatcctcaacaacctttgttgaataaatgtgtccatttattcagttctccaatgtctgacttcattcaatcacttataattaaaatgccaatttttataatctccatgaaccataaattaagaaatcactgtgcggccgggcgcagtggctcacacctgtaatcccagcactttgggaggtcaaggtgggcggactacctgagatcaggagttcaagaccagcctggccaacatagcaaaaccctgtctctactaaaaatacaaaaattagccaggtatggtggtgtgtgcctgtagtctcagctacttgggaggctgaggcaggacaatctcttgaaccccagaggcagaggctgcagtgagccaagatcgtgccactgcactccagcttgggtaacagagcaaagctccatctcaaaaaaaagaaagaaaaaagaaaagaaaaaaagagaaagaaaacactgtcttccaagctgtgactggaggcttacattaactcatttatatttgtagttagtaacatcaccatttttaaatgagtgaaccctgaccccaagaagctaagtaaccttataagtcatagaatcagtaagtggcaaaaccataattgaaacctctggctcataacttctcacttttcctaccaaatgacacaagtggctacaacctgagtggccaggcctgaatgggtagccagtctagaactgccttggtccccagccccacagcacctgggacaagacccagagtggcatcctcctcctccacagcagaggagactacttaggcaatgagatgaaattggcacgtttacctgcctctgattaaacagagtttttactggacagcagttgttgaaataatttgggctataaataaataggaaccgggctagaatctgaacctgcttacaaagctagtccttttccatttgagtcataacaaatccaatccactcggggaaaaattaggaaacaagggggaaaagctttcagtttctgtagcattttaatgaaggattgattgaggttttatgcagcaagaagggcacagctggggagtaattgccaagaaaattgaggtgcaagagccatttacatagaagaatcaactaaggttcctcaccagtgctcaactgaaagcagtagcaattggaccaaatgacaagcatcacaatctcactctctagcaccccaccctaggaaacaaagccaccttgtcactgtctccttcaaaagtaccacaacccaacccaagacaggcaatggcaattcatgtgcatcctccactcccaagccttcagcaacctagatactttgtctggggaccttctgaagaggaggctttagttgacttcttcaagatcacttactaccatagacgatggctaaagcaggactgaattccagatgttatgatcctagagagtctctcaatcaatggtagaactctcatgcacaatcttctttggttgggggcagaggaggggtaacttggagcaggtgatagtgtggctcccgacaggctagccactttacaaggattcaccttctgtcccttcactatgtatcagaagctacactttatggccacgttttgtttcctcttttcttcctcttcctctttactgtacctccatccatccttttatagtgccgctttcaccttggtgtgtgaacttgccgctgacttcccaaatgagttctgagaaccgatttcctgtgctttgtgctctgtgatggttcagcccactcatcacacctctcatggagatctctggcactttggtgggccctacttagaaaccatcttcctccttgatccttcactaacaagttctataatcttaacctcccagggtctcagttatactacctgcaagatgggcagaagaattccagcctagatccccacacaaatgtaggaaatccaaagacaataatatataagggcttggagaaaagaataaaactcagactgcagtgaggtgaataattcagtgcatcctccttatgcagctggagttaattccaaggaagcactttgcaaattctcaggtactatgcatgttctttctttctttctttttcttttcttctctctctctctctttctctttctttctttcttccttcctttctttctatttttgagatcacgtttctgtcttgtcacccatgctggagtgcaatggcacgatctcagctcactgccacctccgcctcccaggttcaagtaattctcctgtctcagcccctggagtagttgagattacaggtgcctgccaccatgcccagctaatttttgtatctttattagagacagggtttcaccttgttgaccaggctggtctcaaactcctgaccttaggtgatccgcccacctcagcctcccaaagtgctgggattacaggcatgagccaccacgcccggccacatgtgctttttaacatttttattatttcatttttggagtcattattatttttgttacaccacacaaattgcaataacattaagagattgagatgatgatggtatgagggtggtgttggtgatgacagtgatgatgacagcaatgttgctgatgttccatagtggtaatggtgaagatgatggtgatactggggagatatgatggtggtggtgatggaagtgatgcttacattacaagtccactctacacacacatgttctttacaaatgtggatgaaccctatctcctgcatggagtgggcagcacagattgtggaggaagctgttttccttccctggcatcttctgttcttggaaatcaatgaatgtccttcattattttccccatagttcctaagaggatactttcctgcttctgaaacattcactatttctataaagtcagtttgtcttcattctgtaagctcctcagcaaccctcactatttgccatgatgctggtcaccgggcctacaagacatagatcttgtctttgaaaagcctgtgttcctagggagagaaacatctgaaaagtgaaagaacatgagagcaaaatagcatgcatactgcattagaaggtgcaccctcattccgcacgggtgtgtcagggactggcagggtcggggatggcttccctgggaaggtgcctttcaagctggccagtgactaaggggtcactcatcctccagggaatgggtggatagagagcactctaggccacaaacaaagcagagaatatacactgctgtagggtatgatctgagggatatgggagatttcaggggaaagagcttactttaagttttttgaagtgataaaatatttgaattttatcttggaagaactatggatccgttaaaggtctctcagcgtaggaatgaaatgagctgaatctgcatgttacgatgtttcctctgtagagcctaaccccctccacttgtgttcccaagagccccagcatcactcaggagcttataagaaatgcagagtcccaggccccattgctaaacctcttgaataagaatctgcacttttcaaaagtttcattttctaaattactatacagtaaatttaattttttatttttggtgtaaagttctacgaatgttagtatatgtgtcaatttgtatagccaccaccataatcaagatacagaacaactctgccccaaaaactatcttgcattatcctttatgatcacacctatcacccctacccactaataaccactaatctgtcctctgtcactacagttttacctatccaaggaagtaacataaatgaaattgatataatatgtaacctattaacgctggcttttttaattgagcaaaatgttgttgagattcatccaagttgttgcttttatcaatagttcattcttttttgctactgcatgtattcatggtaaggatgtatcacagttgttttagccattcacccactgagattcttcctagttttgggtaattatgaatagagatgctacaaacatgtatatgaatgttttttctgtaaacttaagttttcatttccctagggtaaatatctagacattgaatttctggtaatatgctaagtatatgcttaattttataagaaaacttctaaactgttttcctgaatagcaacattgttttgcattcccattagtaatgtctgagagttccagttgccccccatcctcatcactacttggtattgttggtatttttatttcagccattataataggtgtgttcacatctcatcattgcttacacttgcatttccctaatggctaaagatgctgatgttctttttctgagcttatttgccatccaaatatcctctttgatcatgtgtctattcaagtcttttgcccattttccagttgggtagcttgttctcttcctgttgaattttgagagttctttatatatcctggctataaagccttctgtaatatatgtgatttttaagtattctctcccattatgtagcttatcttttcattctcataatagtatctttcacagaataatagtttctaattttgacgtgtctaagtgatccatttttcttttgtgaatcatctttttggggtcatgtctaacttacctaagttcagatcagaaagattttctcctatgtgtttttatcaaagctttatagttttacacttatatctgtgatccactttgagtcaatttttgtataagacatgaagtttaggttgagctttttgttttgttttgtttcatttgcccttggatgtccaattgttccaagaccattgtagaaaagactccttctccattgaattgtctttgtacctctatcaaagcaattgaccatatttgttgtaggtctatttttggactctagtctactccattgatctatgtgtctatccctttgccaatatgacactgtcttgattactatagctttatagcaagtgttaaaatcaggtagggcgattggtgatttcttcaaatatacacttctttttcaaaattattttacctattctagttgctttgccttttcacataaattttagaaattggtttgtttatatctgcaaacagtcctgcttagattttggttggagttacattaaatctgtagagaaatctgggggtgagctggcaccattactaggatgagtcttccagtccatgaacatggtatgtcttgccatttctctaggtcctcagaatctgcatcttaacaagaatcccaggtaatttccctgtacattagagtctgggaagcacagctctagagtggaaatgacagtgaagtcatctgggaggatttacaaaatatggaagcctagacctcactcagaccaactgaataagaatctctgaagggggacctaggtgctggaattttttctatgtcttgtaggtgattctaactggcagccatgtgtgaacctctactctaaacccagtctgggctcttgtggctctggccctatgctcattaaatcaatctgattaaggccatcagttcattccttttcaaccctagatgtatattggaatcctttgaggatagaggttacttcaatgagaattttcaagaaaaaattctagttgacagattcaccaaacttcctctgaggccccacctatatttgaggattacctttccctgcccaaccccaggagctagaacaacattccagaagttttaactctcaactctaaaaacctgctctctttttggaagtctctctacaagttactgaggcaggaggagacagaggagagagggaacatgtgtgcacacaagagaaatgtccaattgaatgagtctgatcaataagatctatgactcaaaaatacttgcttcatggcaagggaacatcttttgctttcatatccatctcacatacctgctgagtcaaggaaacagctccatatttaggagaaaaatcctcttctaatctctaaatgcaatcgaaggttttctatgtctttttctgtggctccttggaaatgttaaaggcatgtctcagctacagcaaggtggggcatgacatattgccccccaaaatatgaaccaattgaatgtcgtctgaagtcagctctgtttctgttatcttttaatggattttaggtaaagaagtgttgatgtagataaaatagatataaaaccaaattcttctgctttggatgtgcaccaaccccagcaggctaaaaatagattcaactgcatcaataatatttctctttaaagttgcaggtcctttgggggtttggaaacattcagagaggataaaaggggagaaagatatgaaaacagcagaagctgcagtctaagcctccaggtgggggccttggggacagccatgctggaatgcctgatttttacatgtccaagtacctatttcctaccaaaaaaaaagcccttccacatatgataagaacacatcttttcttgcagggctgtcaagttcattctaaacacccctgccgctgcctgtttgagattgatgcctctccaatctctagctctttgtttgaaattaaacatccaaagacctttagaataaaaaaagtcaacatacaaatgaaatgcatttcaacatgcatctcaactgcagaaccacagcatgttgagactggaccaagcaaaccctgaagaagtttcccctcttgctcctctgtggtagatgacctatccaagttcacacaacaggtaacatggagcatgtggagagactcagcataggccagtgcagtagcggggtctactggaaaagacttggcctttgaagtctcattccaatcccagccttgcattgaccaactctgtgaccttgaccttgaaaaagtagagtcacagtgccctctacttcacagggttgtttggagaattactgaaaatgtgcacaaaatacctgatacacagtggggcactcagctaacaccagtcattcctgtaatccaggtctcccaacttctagtccagtgctctttgcacaacaacaccatatgaagactctgagctatccaaataagtgcacttgaaccacaggttaaatccccttcctctcatcagaaatacaggctagcaccgcccagcgttctttaaagacagccaggaaaacaaaccaaattcatactacttacccaacactgaacgagacacgctggctccctttcctttattttgtttcccttctatttgtcctgggtttgtggttctcgggcaaggtgaactctgctcagtatgatatgtgacccctggccacagttgcatatggccctgcctcagttgctgcctgctccttacttgattctccaggtccacactcctttcctgtgccatcttcccctgtggcacctgtgtgtaggaatcttcaacagctgcaccgccaacagagaagccacaagctggagccccacaagtttccccccaggccccatgcatgggtcagcagtcttgacccctgggctgattttaatattttaattaaattgacaacatgtaaaaaatctggagatttcacaacaatgcagatttctgacttcttttgacaaattacaaactggccaaatgtccacagctggccagagctgtgaggcagctgctcccttcatctggaaagactcttgctccactggtcaaagtccccaccggtcccctcattgcaacctcaccattccctatcaacctctgagttttccacccctgttatgatatgcacttccagttctccagctggacactcaagatgtgtcaccacatggcccactgcacttattcaatctcttctcctgggaaccctggaaaatctctctgcttctaggctctgctgggagcaattcccctcctacaatgtcctccttgctcttttatttatccaacccaatcaagagtatctctgcttaaaaaattcttgctgaccacccaagccacaaagagctctcctttccttaaagcatggagtcaacagttatcttacctaccttcacatagttggttcttcctgtttgcacatcctgtttccctagctaaattgtaaacttcttgagttcacatttgtttgccttccccagaaggcagccacagactttccaaagggaaagttctgaacaaagattaattgtttggtcaggagctatcaaccatatcatcactcagtgcaagaccagtctctccagcctcttttgcctccactccacttcccttgttcccctctcaaatccacccaaacccccatcctcctggaatcactccaaaaggactagaatttgtttcctgttttgcccacgattgttcccatcgctgccactccccagggctaaacacagaacctgccacataacaaaagctcagcatatgcacattaaatggaaagtgccttactttttagtccctatatcttaacatctgcagttcaccaggctgaccatgcccttctcccttttcaccaacagatctacgggtcttggaaatcccagttcagtgttcctctctcaatctttttctcttcctttactcagccaagtcactcctctctctaggcgccgcagtcctttgctcttgcctgccacagccattgccaaatgttggtgcaattgtttgcccacacctgtttttcccttggatgccaaggtcttccggatccaggattgtgtgatcttcttccatgcgcttgcctggttccccaagtcataactggacataattagtctggtggagaaggcaagtattatggccctcatttttccaatgagaaaatggaagcaaggcaccaggctccctgcatgcagcagagagatggaagaggaagagaggagcagcttgggtgagaagacttggttctattagcaggggtcaagcaatggaatggaaatgtgtcatgtcctttcaaggtcatctgtggagcaatgtttaacagcctgcccaagaaatatttaattacctagaggaaagtaagtacctttgttgacttgatatttgctaccaactaaatagccagattatgtgaagttacacattaatgtgtaggattttgcctagtagaaatacaaatgttttctgttcaggagaaaagataatctcaaagtttattaattgactcccgtgtaggacattaaccagttttgtttctaatttagcaatctcattccaacactcttcctccagtgcctatgtaaactcatgctgccatcttgttggtttcctcattaatgagctaaatgcatttttgacatgtccacattctagatttgtatgagtcacaattttaactttttgaaaattatactttgccacccaggtgccaccaactctgggagtgtgagcaagtccctccctcccctcttctggactcagtttcttcaacagtaacatgagggcgtaggtctgcatgggaaattacaagccccaggaatatttgattttaagcctgaatcttaaaaagaataatttcctcatagggttgaacatcttacggagttattttccaaaataacaacaataatgggacagtgcttcatacctggggctaagtattttaattctcacataatgagatggggctattgttcctagctctattacaggtgaggttaggaaagctgaaacagtattttttttaacgaggagacactatgtttgtccttccactcatgtttccttccattcttcttttcacctgtctggtcatccatgtttccagtcatccatcccactgatgcaaaaagaaggtggtttccattttcactctggatctatctaattgactatttaattgatgtggactttagtagaggcagtgattgcttccagttggtgggcccaggaagactgtgaaaaaggtaccactttcagcttgaccctgaaggttcaagcagaattatttagggataggttgaagaagcatctttgcctgaaggaaccatggcagggacaccagaagacaaaggagggagacatgcacagtgaccagtgggtggttatggctgtgggaagggtggataatgggagatgagatgaaaaagattgattggtcttggcatatgtcaatggctgattgagaatcttaagtttccttgatctgaagccctgtccacaatcacccagactctgagtacttcatgtggtagtaagaggcagagacaaacccttccccaggtgccctgatctggccaagcctgggcgctctgactaccagagtcctgaactcttagaagggagagctgcaaacaaccatggcgggaatctactccagcctcccttcccgaacatgtgggcctgagctaatttaagctagtctgagctcactttgcaagcagttgtcacaaggtgctacatcaaaagactcccaaggcccaaatatttaacaaccagaacactccctccatccatcagtttggtaattctatccacacaaaaaaactattggggtttcatttctggcctgctcatttcttataaacatgccagggccatttacagctcacaactcactgctctctaaacatttacacatttctccctcttaacacatccttggctatttgattaagtagtagatcacaggggatggaaggcaaggccttggcatctttgggttttctccaaacctatcttgacatgggttcaatgccagcctccccttccagtaaacacaaggattattgcactcctgggcacagacttgctgatgccttggtcttttctatcccttctcttgcagtttctttaggtaggagggaatacaaaccccaaaaacaaacagacatgagtccattttaccagctgggtttaatgggaaagctggtagggttccccatgacccctaggactgaatgagtgcccacatttcacaacaccctgattccagacaggaagcttggagaagtatctatatttgggggaaggaagctgccccagacacagcttcctggactgttagcaaaggaatctcacacaaggcctaaaccagtttccatacaacttccttgccttttgggaaggtgcaatctcacaggactggtgggacttacccaatgcagtcatccaaaaacagttatggccaacacctaagtgctgagaaaagtcaagaggaagaggaagccccaagggcagagaaagtggtgaaggtcacagaaaaggcatggagctgtggcaccattggcgggggacagctagagtccaggcacagagctaaaactgggtatgagcaagggtaggagaggggacactgctgaacacccacaatggtcctgctcctgttggctctgccttcaatctcaaaggcaattatgaataaaggaaagcacactgccttcagagtccgacctaagtttgaatcctggcatctttcccagctggccgtattacccctaggagctactcaacacttcagaacctcactttcttcttcagcaaaacagaggtgcaggtatatatctcctaggagtgacaagggaattcacgcggctgttaatgacctggtgcctgcctggggctaccaagcagccaccacaagagtcctccataatagcatccaccgcactgcagtcagggcaacagcactgcaagcacttcatggacagagaccaagcctttccaacttgatctgccatgtttcaacacagtgcctcagccattgagaaaatcctgtgacaggcacagacccccttcaagaaggacttgctgctcagctcgtgagagggttgtcagcagcttcttcagggcttgctcagttgcagagagctacctggccagaggtcatgcccttcaggggcagcccacctcctctgagtgatgggagtgatggaataaaggcccatgtcagcccatcccagcactcattccagcacaatgctggcaggccatcttggtgctcttggggctggctgtggctgcatccagcctgcatcacgactcaacctctgcacagtcctgctgccttcccctcctcccgtgggtatgagcctccagcacactcaacttcgtgtcagagcttaccttccaagaaccctacctgcaatgaacttggtatttgttgatgagtaaatgtctgaaacaagatccccaatcttctaaatccagagttaaaactcagacaggccacggtccttggtcattctaggtccaagaggctcttgctgctggcatggccaagagatacaggtaagtaaaacagtatactgtggtgctatgaccacccagggggctgccgtgtcccactcaggaaaatcaggtacctagttggcttccaaaagaggctggggaaattttaagttgaggttgggctctgtagaccttctccaccactaaagcccccaggtttatcatttcccgggagaataggtcctgggggagagggggagataacaatggaacacaccaaaagggaaccctgtaatggaacagtgcccactaatgtttattttatcccaggagtcacagaaggcctggaatggctgcgatggagataaaggatgaagggtagtcccctcagggtgttatccaaaaagtcaccttggaagaggaagaaactcctaccaatatcagaagagcaacaaacatttttttttctagaagataagtggctaatttcaaaataattattttatcaactgccacataagtttttttttttttaattcattaaaaaaaaaaaatgaggccgggcacagtggctcatgcctgtaatcccagcactttgggaggccaaggtgggtggatcacctgaggtcaggtattcaagaccagcttggtcaacatggtgaaaccccatctctactaaaaatacaaaaattagccaggagtcgtggcgcatgcctgtaatcccagctactcaggaggctgaggtgggagaatcacttgaacccaagaggcagaggttgtagtgagccgagatcgtgccactgcactccagcctgggtgacagagcaagattccctctcaaaataaataaatacatacatacatacatacatacatacatacatacataaaaatgaaatgcttcccttttcaaatgaggagtgggaacacttagattacagtgctaagttctttttgtctgtgaggtaaggagaagagcctgcgcctaggtgaccttggcctggtcagagatgctgggacagcctggacgtgggaaagaagggatctacgcaggtctgtccacagcacattccagggcagcttcctcccgggctgcttctgtgccagaacctgctggcctcaggagccccagctcacctttcactgaccttcagcccacaggagaacagcatttcctacctcccccacctgctgacaaggcctctctctttcccacgccaaggacaaagatgacctctgggggattccttttagctggctcataaaaggaagagagatgggccaaagagaaagagctgctgggtccttccccaactagaacatgggaaatgatgattttccagtagggaagtggtggccaggcaggcaggcgtcgactagatgggtccctctggggtgtggtggaaatgacctcaacttcaaagagacagacttccagagaaggctggcattagcatcctgatctgctctactgagaatcccaagggttttgcggaactcttgctgggccatgaggatacagtctcctcctgaccccaatcctctaaccaaagcagctaggtttcagttagtgtacacagagctccaggcctctaagagtgtgaaagccactgcctcaggagatatcccttgctggagatcctgggaagtagaggctatggaggcagaccacttaatagctgtgcaaccctcagcaagtcattcatccactctgagcccgagttccctcctgtgtaaaacagcagttatcacagtgcctagctcctagtctgggtgtgagagttcaaggtgaggccaaccagttgcttcactccgtgcctggctcatagtgagacctcagtaaatgtgagctattttctttcaatgaatatttgccctttccagcatcacaaatacatgagcttccaattctagggatacaaagacagaggggctttatttctttcaatgagttcagagaagtccctagcacttaaactgctatacactgagagagtaagccatagttctgaaaatgctctgtgtgctcattcacctgaagcagcactgggggtcactgcagcctcaggtgccaccgagccgacaggccatgaaaagaacacccactgactcactcatctgggtggaatggtttcatggggacccaggtgaggtggtgaggttgctgcttttttatgtattggctttttctgcctccccaatgccccacttccgtcgcaaaagtgtctgagttctggagcaaaggctcagctaggaaaagtttcagatattttctttgtcttaacccttcagggagaggaaggaaaatctgtctcttgccagggtgagggccaccaagcgggttagctcactctgccacattctgcattttctaccttcaacacaatggacagtgggatgtctctctcttgccatatgcattcaagagaaaagccctggtttgggtggggctctggtttgggtggggtttgcattgggtctacagccactagcaacttgctgtagtcaaggcaaatgacataagctctctgatcctcagcttcctcattgtaaagagagctcttagctccaggtctcattactttcagggtatttaggatgtttagatgccaaataagacagcagaaggcagagcaccttgacaagcataaagcactgtatgcaaacataaagcatggtgcaatctcacaggactggtgggacttacccaattataaacaaatttataatcacatggcaggaagggtggaatttcaagatagaattattattcattgtaagatgacttgtgtaatattgtaaatgactgctcttcaccccatcctctgattcaaattaaaatcctcattccatggcccctacatgtacgctcattttcactgttcagttacaagcaacaagatgagacattttgacgcccttggtaattgtctggtttctagaagttcttggttcacaggcctaagcatgtttcatttgatgtttggcaccatagaaaacagtgtatgtttaatgatttctgtgttaaactgaataatgaataaccaggaaagacaacagaccaaatagcaacttcttgatacacctgcttgacggaattctgagcctttttcccactctatcaaggacaactgcctaatggagagtcagaatatttttctaatacaaataaagtaaaaaagcaatgtaatgttattatcttttaaagacagaaatactattaaatcctcaaccatttttaaattaaagcataaaaccctcttctacccaataagcaataagaactcacttgaattccttttcacaggcatttaagggatactaatgggtacagacagaagagggaaaagtacagaaaggaaaacagcagataaatatatagaagcagaaaacaagagtaacagaagagaagcagaagagactaaggaaggcatctaggatgcagttgtgaagagaaaatcagacatatgtaggcagaaaagaaaacaatcaaacaaacaacaataataaaattagaactaaagagaaactttcttaaaggaacccataattttggaagcttatcagtagattttaaaagtagactacagatttatgactacaggagtaaagggtgtgttactcttagtaattgtttccttaatgacataaaatcacatcaagactatatccagctcatgggccagcagctccccatccctgccccataatgctgcactgtattatgtttcaatacaaaacatttggtgtccacttgggtcagcacctccatcagactgccatcactaagggaactgagccagcctcccacgtcagtttcctcccctatgggctccactgaatggggatgaatgcggtacctactctcatagtagggatatgaggattaatgaggtgatgtagaaaaatcacctggtattgtaggtggcatttagtaaatccttcataaacactagtgttcattattagttggggttacaaatagttactctcagagggggaaaaatgaatgaaagtgtgtgaacaggttaaacaaaatattttggaaattttatgttgtcgtctgaaagttctttcatgtgcatctaaaggcatcacactcactgtcaccctcttcacatggtgggtatcaatataaagaacattcttcaatttctgcttgactgctacatctcatttctgtctctaggtttccactgagccctccagctcaaggggcctccctccgcatgagtcgtctttaggaagcccagcctggtctctaattttgagaagcatttcccttatttcaggtcttcattcagccagtggttcaaccactgaaccacttcagtttccttccttcattttattcacaaaggaatcctttcatctacagcccctagctgggctcctttgaagagactttctcttcttgcattattttcttggtcagccttccttaggaaggaattaagacacatttcaggaaacgggcagaaaatgttaatccttctctccctcattgtcctactcataaacgcttactccctcaaatgcacccataaataagctgtagatccacatctggttctgagcccagcacatagtaggagctcagatgaatgatcacgcctgacttctcagccttgcttctgccatcccttcccctgaaaaatctgctcctctctacttaacctagtagaaccctcatgaaagctgttgtccctgttgaaggaatgatgccccaagcatccagcgtgtctgctgtttacttcatgcaccttagtggatgtggtgaaatgaaatgacttttccatttccaaagagaaagtgcaaagtctccaaacttatgacctctttctcagaatgccaatatttacagcttagccctgggcaaccctgtgcttttctgaccttagattcccatttggagtggaaatggcttttctatttctccccaaggttctctgaattagatgaccaaaggagaacttacttctaccaagatgggtctatgagacccattcaggctctcatccattcgttcaacagattcattcattcagcccctactgtgttccaggaaataagtgtcaaccatacaggagtgacccagacaaaaagccctgcttttatggagttagtttggattttagtggagacaggggaagatagatgataagtaaaataaataaagtatatatagtatattagagaattataaggtttataaagaaaaaatgaaagatacaattagtagggaatggggataatttaaaatagggggaaatttataaacataatggaaaatatgcatgtaagtaaaattccttccaaaaaatggaatatttaacactaacttgcggtgtaaacatgaacacatcatgggctccctccaggcctcggtttccttctcggcagtataaggtggaactacaaggtatctctatggtagcttctggcactgaaattctctttctctacccaatagatagcaatttgaattaacactagagcctgttgggacccagtgattgtggtctaagtttcaatgactttttttttaaatccctacattccttggggttcccagcaatgtctccagtgggctgctggtccaaattaattgtgagagcaaccacaaattcccttgtttatatttttgaattgttgacttagaatcagttttaaatctgagcccttcttccccacagatactctcaaaacagcctcctgataggcactaacccctaagaaggtcatcaagtggggctctgagagcaaggatgctgggcaacccggcttccaatgccacttatcctagccacatgagtactcataacaggcttgacgtcaattaaatcatactggccctgagaggcgccacccaacaaactgtttcttcttcgtggactttttgttccctctttatttattttccactgagctacaacaaggctcaggaggaggcccttcatctaggaagagtcatcttgggaccatctagggaggaaaaggcatccatcaggcactcatcagccacctctgatgaaaagcttcctttggggtaatttctctgcaccaccgagtaagccttctgcctgctggaggagctgtggtgagcatgtgaagggaggttctgaaggcttcagcagcagccaccagtccccctgcagcccctaatgagaggtgatccttgttcaactcctgctatgtgctagacacattctaagcactttacatgtattaactaacaagtctatgaaacaggtgttatcattattcccattttacagatgaagcaagtgagacacagtgaagcagcttgtccaagatgacagtttgtaattggaggagaagagcccctatcagcatcgctgtccagaagaaacataagacaaaccacacaggtcattctaaattttctagaaggcacatttctttgacacttattttatttacaactctatgcaaatttaaagacaaataatattccaagtggggccgggcatggtggctcatacctgtaatcccagcactttgggaggccaaggcgggtggatcacctgaggtcaggagtttgagaacagcttggccaacatggtaaaaccctgtctctactaaaaatacaaaaattagctcggtgtggtggtgggtgcctgtaatcccagctactcaggagcctgaggcaggagaatcacttgaacccagaaggtggaggttgcagtaagccgagatcacaccattgcattccagcctgggagacaagagcaaagctccgtctcaaaaaaaaaaaaaaaaaaaaatatatatatatatatatacacacacacacacacatacatatatatacatatatacacatatacatatatatacgtgtgtgtgtgtgtgtgtgtgtgtgtgtgtgtgtgtatatatatatatatatatatatatatatatatattccaagtggaggaaagaagttttcagattgctctcacttgtaactcccatacattaattttcttgtacatttttctttaagattataatgttgattgcctcctaacagtcatttccatccccctccctcattcagagaaccctgattttgttcaggggtgcaggtacctcaccaaaactgatgctggccccactcctgggcagacctcgattagtctgagcaagccctggtgctctcattcttatgccaacaattggcttaggaccgacctgtgactggttcttgacctgtgaaataaatgtgcaggtgtgctgggggcttctagaaatgtgggccagactgctgaagaagaggcctggagagatggttgcttaacctcgagatttttttttttttttgctttctttttagtatgataaaatatacataagataaaatttaccatttaagtaatttttaagtatacagctcagtggtattaagtacattcacatggtcgctcagccatcaccattatccatctagaaagcatattttttaaaagtaaaaagaaaaaagtgaaattaattttaataatggagtttaatctatacaaaatattatcaataagtaatcaatataaacattataataaggtttttttacagtctttttttgtactaaatttccacttacagcattgttgcttttttagagacagggtctctctggagtgcactggcatgatcatagctcactgcacagtccttgaactcctggcctcaagcgattctcctgcctcacctccaaagtagttgggactacaggtgtgcactactactcccagctttacagcacacagcaattcatatttcagatgctcactgaccaccggtgttggactgcccaggtttaaagtttctcaggcttgtgcgtgctcagccagctcatgggcatctccaagggacagcagcatgctgtatgtttatgaaagatttgtgcgtcaccatcagctctctggggcagtttgcgattcaccgcaggaccctagatggtgtctgactctaatggttctagatcagcctctctaacccccgcggagatcactggcatcacgctgatggacaatacaagatctgaagcctaaatgagagcttttcctggtggagcaaataccgtgcctccatcacccagctgtgatttcatctcccagttgagaacatgacctcaatggcagaggtagggacaacacctatgcagctgcacaggcactcccaggttggaccaataataaataaacacattcctacttggaaagagggcagcatgtgtgcagggttgaggcaagccgtggttgccatggaaaccagccagcatcactccagactttttccctggtgctcggatcattggtggctgacgaagcccagtggagaggcattgttcctgtacttatggaaaccttccaaataggcccattatgatgaaagcacatcaaagagggaatgatgacgtacctttaccatccatcgtcacatccactgtttgtcctgggtaatacccaaaagagaagaaaataaagccactcttgccacagagggaaataactggagagcactgaggtatgacactaggggtagcaaggtggtccccaaaggggaggcaatgaaactgccccatctcaccaccatagtgaatgctcgactggacaaatggttatggcttcagggatttgctacctgcccaagctgacttacaactcactttctatggcaagcctctggtttgctctctttctggagccacgtatgtttgagatcttcccattcattcattctttcctatgcccattcattccttcactcattcttgaatgagaagcaccatggtaacatgaaaacagcctgggtcatcgagtcatgagatcccagatttaaatctcagttcagatgcttattggatgtgtgatctcacctaagctattaaagattctctgagccttggttttctcacctgtaacatggggacaagagaagaataatgtttgccacttgtcttctacacagtcatactcaatgtgtttatacatgatttatatctcattccattttgatcaacaattacccaacagagagcctggtctctccagatactcaataagattattgaattattgattattgaataaaaatatgacaatgtgctttcacatatatttcttctctctctctctcttcaaatttcattttcacagcaatctggttcaaggttgtttcagcccagcacaggacaaagaggattataaaattaaaccacatgtttctgactctcagtgaacttacagtttactatgttttattaacaatgtatacaacacttagtctgccccagctactgtactaagtactttataaatattaggtcatgtaatctgcataataaccctatgaggtaagtactacgattgtcttctgtcactggctcagggtcacactagtacatggcagaacaaaggtcaaactcagccagtctggctctatagcctgtgctcttaaccactcagcctcattgcctttagagtggataagtcacattcacaagtgtatgcgaatactctccaagactgatggattcagaggaggaaacactatgcactgcatcttaaagatgaggtaggatttgaacacatggagtgcatggaggagagcagaagaaggacaggttggaaagaggataggggccctgaccatttgcttgaagtgtttgggctttagaccttggaaagccactgaaggtctctgagccatggggaaacctaagcaaagctggctttggggaaaattcatctggcaatagcatgaaagatggactgaagcggggagatgggacaaatgaggagagtgacatgtagctgctataatgagtgaaggaaggggtcacagggcttaagccaggacaatggaaaaagaagcatcaagggcaaatccataggacgtgcctcctaccaggatgtaatatgtctccccgagtttcccaccaaaactttcacatcagaaacaagttccaaggagcactcactgggcactttcgtggccatccagagtggcacatgggtgctctatagcactgctttcctcaaaggaaacatggggtcatcttgagcagctggaaacactggctgagcctttcctagttgcatgcagccatttactgaggccaagggggcaaaatctaatcctgacaaagaatcctggccacctcaaatgcaaaagatagccaagtacaacgaaccatagtcccgtttgttataatgtcctataaatcacagcctaggccttacagttaatagggctttctattccaattcccattatgctggaaggggaagaggaagaattgaggaacgaatgaggagtctgagagtgagttacggcccaagaatatgacttgtcagccgtcttccaagctctaccaattgcctgaaattctctatccagtcgtaggtttgcataaattcctggagaaggctttgtctgataccacagtgaaacagatgccagggtgcaggcacaacaggtagactcataaaactggtaaagagaactttgctttgacaaaagctggagttttccttgttatttatctttcctatttgaagccttgaaatcccattttcatcttgatggagatgataaactcttagaaaacttttatggctcccaggatgaaactgaggactctgcctctgctccccactgcaattctggcaggcttttaaattcaagtcagggcagaaactgtttttggtcagaggcaaaatgtatttatctctgtaagcacagccattaagatgtgagcatgaatagctaagagaaagaacattaagggagaaacaggaagaaatagaaggtgaggctatgatggaaggaaatgatgacgcatcaacccccaccaaaagctttttacagtgccgggggagtggggcacagggaaaggcatctgcagcgattgggagaaagaacccgggagtgggctgaggggaaggctttgcagtgggagggctgtgatcagcgtgtgcttcatgcaaagagaattttgagagtggacataacaaacaggaaaattgtgcttgcatttctgtttgtctgtagaatcactgtggctctgaaatccaccccctctgctctccaaacactaaagaaagtctccagatggaaaaatctgaagtcaggctgcaatatgaaaaaagaaaagaaaaagaaggctgctacaggaagctgacaaatttgctgtttctctgaggtctaacctatgcagctggggtatcaaatactagacagggtcaggagacatgtctgaaactgaccaaatgaccttggacaagccccactttaatcacacataatgtaaactttagggaatgtgacctagaacaggtagctaaggcacaaataacactagtactaccaccctccaagctggcactcatggcaggcatcattagtcagtcatggaattgttcttttcttttcttttcttttcttttctttttcttttcttttcttttttttcttttctcttttcttttcttttcttttctttcttttcttttcttttcttttctttttagatggaatcttgctctgtcacccaggttggagtccagtagcgtgatctcggctcactgcaacctctcactcccaggttcaagtgattctcctgcctcagcctcccaagtagctgagactacaggtgcctgccagcatgctcagctaatttttacatttttagttgagacagggttttagcatgttggccaggctggtcttaaactcctgacctcaagtgatccacctgccttggcctcccaaagtgctgggattacagacgtgagccactgcacccagccctcggaattctttagagcagagccattatgactgtttgctgctgaaccttaaatctttggccaaatattctctgtagctgctactgatcaatcagaatgaacccagaagatgaaagctgatgaaagatgatgaaagttcaccattgctagacttgatctcttctaatccttaaacactagagccagataagattgcatgtcatgtgtaatctcattatagacatccttaactaagtcctaccttggttttcttttctctttggccttctttccaagtcttagcagccaaggctgtgaaataagaactggtatgaaggctcttcattcaactccacatctgaagctctgaaagtgaccttgtgcacttttcttgagcctctttactttacgttcccccattctgccacaaagctcctggtggggctggtgtctcctctactctcctgctgatttcatcaaggtaaagaattctattccttttcaaatgctttgagatcatgggatagaagacagcctggggaagttcaaagacgtttaatcattagcctcagttcttttgaaaattattaaagagcccagaattagaaattcagatttcctccaaatccctgagaacaaacaactctcttgtaaatggcttaatgtgtctgtttaatgtacacaaaattatctttcaggaaagtggattgttttttatatcattttgcatctctaaaatataccacctatggcaaaaggattgggattcaaagtctgacaaaatctacagcagaaataattagcaccagaggctgtttctgagagttaaatgaaagagaaactggttatttatttatttcttttctctctatctgtatctctccatctcagccccgggaagaggaattgtatctcttggtgctagaagggtggcttgctgaattgcctttacaaggtttttttctgtaagacaacaactgagcccccaacacacaactccctgtgggccgcagtgctatggaaacagctgcagtgctccaactctggggaaaacaaccagataaacccactggtttgcaaactaggcacaagggcagaggaatagtgatgttttctaatttagcatccagggaggcaagggggagtctttgcttaaatcatgttaatgaaattggaaacacttgaaatagcccattgagggtctgttgcccctgttttttaaagttcatctaaaagttaacctacaaggaattttcatttggggaatttctgcaatgtcaactccactgatcacccacagtgtttaacacccttgctataaatttgggggctagcttggcagctcctgccacccccctgagtctgctaccttgctccagaaataaaaaatgactttggccacagtaatgtttcctcgatcctcagcccctcctgggggcctccggcagtcattattttaaataaacatgccttttattgttttcaggtacacagagatggaggcgcttctacctctggaggagggatggactttcaggggccccatgatttgcagcagttcagtcaaaagcaatacaaagagcaaaggataggggctgttatctcacccaagagctcctcaagcagaggatactcaattggaaaggaggctcttccagtcaaatttggggctagtggggtcaccacgtttgataccaactaggaacaacatccccttagaggcttccaactgaggaaggttccaaaagagagctccatggctgaaatgattcaaaagaagccaactccttctcattgagctggccctttggaatatggccccctcctcccacggcatccttccccctgcccagtgcctcaggcccatctacatgcttctacctataggctttgcttcttctctagaaaggagcaaagaaggaaaagaatcattggaggtgagtcaaaagcaggcaccgtaactcacggggccttgtaagccagggacacagtttcagattttacttcaaatggaggcaaaaccatgggagagccatgcagagacaccccttgatgaactctgcttcacgccaatcactctggcagctaagaaaagtgcattctctctccttttgcagttctcctggtgcctagcacagggccaagggcacagtagatgtgagcctaacacttgtggcctttgctgatgaaggacagtgaaggggataagaaaacataaagatattttgggctgcaagggaacgaactactgaaaaactactgcggccccctctatttatggagatgctgaggccttggagagggaattgacttgtccaaggtcaaccagaaaagtgatagcaaagccagggttagtatccaggtttctgctgattgcagctcctcagataaaagtaagtgacttgcctctcttctcccatatccagaattgatctcaaacactgtcatgaatccccaagggccagagagacacacagcatagaccaaggtgagtaaactgttttctctctttctgatgatctgagctttttcctggagagatctcaggtggccaagaaaccaagttgcccacctcatggttcagaggaaacaataacctcctggcagcttccctgggagcccatgcaggtgcctcagggattaaggagctcctgaaaacaactcctttcctttgcaggaagtgattttccacccctgaggcataacaccaggcagaggctctatcagtgcctgctgatataattagctctggacagactctccaaccaaggcagacacaaccaggcccttgctctagaaacaaaaagaatgttctggacctatcccagtacacttccaaaccccacgccttcctgggcaagtcggggctcagagaccaacaaacccaacagacttcagcagcagccagggagctggcagcctctgtcccctgaaatgccacttttttttttgtgattcagcctctgtttcaagctatttttagtgtaagcaaaggctgcatctgagggaaggtggtgtgggaaaggggtctttactttctctctccttttcaatgaactgtcctgtttcccttaggacagccatttcaccaaaagccacaaaacatgtggggagggaggattaaaaagaaaaatgggaaaaaggtcaaaattcagcctgtttgctaaaagtctgggaacagttctaggaaggtgatagtttctcgatcctttgcgttaacctgctgaatcctgggctgctcctgccagtggggaaccaatatgcccagtccatctaccttccgaattaaccaacctccagtaaacaaggaaggcccagaagtttgctctcccagggacgtggtgcaaacaggtttaatggtcccccttgatgccccagggaaggatgtgtgcccttggaggcttgtgaacagagaagcaagcttccgctcacagaggaccctggcttcccaccctcaccccgtctccatcatgtcagcacaaggccaattttacaaactgaaattaactggatgagcaaaaagatagccttggtgcttaagaggcttgggtacatttaattgagtttccaagtgccctgattccttaagaaagccagagaagccactgttatgtcctagatccctcactactcaaacaggagagaatagtttttacaataaaaattttagggcaaatggtggctttctgttgttgtcatttccctgaagtaggttttttgtttgtttgtttgtttgtttgtttgtttgtttttttctggaaaaagcctcactctggacccagagtctaaaaatgaggcttttagtgcaccaaattgggctgtttggggcccgtaggcacgagtcagtctgcctcctcctaaacatagcctcgtaaactaaacttggaagcatcagcttgcgtgtggtcccgagtgtgactttccaagcatgcactcccctgcaacgacaaaggctgatgactttgtcatcatcatctctatttttgagtctccctgctaaacaaactttctcgcagctgaaatggaggctctaaggatatttttctgacaaaaacggagtgctaagccatcagcaccctctgaaggccttgggggaaaacctgggtaagaaaagtctcccagcccaactcagtagccgcaaatacagacatttcatttcctgaaatgcctccagggggcgccagctttcatgggttgggaaggagggagggaaggacggaggaatggaatgaggcgaggaaggaagggagggagggaggaagggagggagggaggagggaggagtgggggaggtgggagggggcagtggggaggaaggaaggaagggagagagggaaagaaggaagggagagagggaagggaagggagggaaaggaagggagggaagggaaggaaggtaagggaggcaagggagggaagggagggaggcagggagggaaaccaactactcacatatttgcccaggcccctgggattcagctgcagaactgcacaggatgtgcaatcaggactagaatgtctgagctcccaggcctgtccaagggactgagagatgggtcacaggttctgacttatcactaaaccctacttcagaaaccttgccaccccaaatcattctagaaaatgcaagcataacatttccaccttcaacactttggatgactgcactttgcagcttttgctgaatgaaccaacatatgtccagcacattgaacagtatctgaccccgagcaggtgctccagaatgtttgaaggaatggatgaagggatggaggaatagctcagaggagctgcctcgcatgtgcagtagaatctgggtctttatcttctggtgacctcacacgctttcccatctcctttcaatgaatgtgtggtcactacctgtcaaaatgtacatcaaacccacctccccaaatactggtgcagatgtgccctccgaaaccagcctgtccctgccctgtcagcctcgccccacctccagggagaagtggatacggagaccacagtaagtgcacttgaccctttttccttaagactcatctgttgtcctgccaaggcatttcctgtgacacatgcgcccacaacgtacagctccagggagagcccagcccgttctccagtccccagccagctcagggaggctatatgaagtgagaatttcctggccaatttgacaatggtgagtcaggctggcatgagccagctgcaaagaggacgcagcctggacaagcctgaattaagtgtgtgcacagagcaaacatcatcatctggatggatccaaaccagggcttgcctggggcattcagagcctttcagatggccctgcccagagctgctcagcactcttggaagatgtctgggtttggggaggctcaagggctgttcttctacccctgccccagaaaaggatttgttcttcaccccctgacccgtctgtctccataccagcccatttcctccatgacatggtgaccgggctcacacacacaataacaaaaataataataaccatgcttatcaagcactaaccatgtcagaggcactgttctaaatattttacatgcattaactcattaagaggcagggactattattgtccccattttgtagatgaggaaactgaggtatgagacaatgaagccactcgcccagggtaaaagccaagcccctgagacagatggagctgggagtcaggagtctgcagaggctgggcttccaactgcccagccgcaccacacacagcagctccttcccaagatgggtgtcccagggagagaggcaatgcaagagctgaagtgagttttgaggctgctatgggctccacccatcctccttgtttgttccaatcaagtgagaacgagacacaaggagcaagatggagatcaaaaaagagtaggagctctagttcagatcatgatgcactgacaaaggggcagggtttctcactcccaggccccaacagagactgaagcaaagcggacagagacaagacaggaccggcagaagcaggccggactggctgctgactgcacagaggctgcaagtgctctgcttgcttaccaggcccccactgacctgtgctacgctcagttctgtatactagggaacaccaatcaatgtcggtggatcacacaggtggatgaatggacatagatggatgggcagacagacaatgggatggaaggccaaagcaggcacccacatgcacctggaaacttcagaggagagggaaaacagccatgccagcacttgccatcagagccctgagggcctgggagccagagatgagtggccaggatcaagtgggctgtccctggaccaggaggctcttcctcactctggagccaactgagggttgatttctgaaactctccttcattttcacagcagccctggggagggcagaggagccaacacaccagctagtaaaattaacagctgctctttacagggcgtgccggagagcccagcacatggctcgaggcctgcagaccagaagctgctgcgagctgaggtgcctggcctgcaggccctgatcaggggtcctcttgggggtaaggcttagactctgagctgccagcagggcctggggtgtgggggctgccgaagcagtgggcaggtggatggagaaactcaaggaatgatgctgctacaaaattctcagacatattctcctgaccttgcgaagtggaaatccatatgttcaccccagctgggaatctgctatggaacttggggacccacctggctctggcctctccatctctaatgcagtacttagttgagcttggggaagtgaatgtagacacgtccccatgagaaggggacagatgttatatcttatctattacctatgccataggtaacttatggagcaagtcctgtaggccacttgaagaggaatattgacaggcatacagggagtggcaattgtttctttacagggacagatggtaattattttaggctggtgggtgttttggactccggatactactcaactctgcctttgtagcttcttacagaagcagccacagacgatacgtaaatgagtgagcatggctgtattccaatgcaactttgtttatggacgctgaaatttgaatttcatatagctttcacatgtcacaaaatacacttattttgatttttaaaaaataaccatttaggccaggtatggtggctcacatctgtaatcccagcactttgggaggtcaaggtgagaggattgcctgggcccaggggttcaagaccaacctgggcaacacagtagaaccccatcagtacaaaaaatttaagaaaacatagcatgtcatggtggcctgcacctgtaatcccagctatcagggaggctgaggcagaaggatcgcttgaacccaggagtttgaggttgcagggagctatgattgcaccaatgcactccagcctgagcaatagagtgaaaccttgtctctgaaaaaaaaataaaaaaatgtaaaaaccatccttagcttatgaaccacacaaaagaggcaatgagccagactgtcccacaggctataactaactgatccctgggctaattaaatgtttcccaaagtgagtgctatgtgatgcccacaggtattacatggggaaaggattccacagggaaatgaaaatggaaaatgctgggcaaaacagagcctttccgctttctgactgcaggacttctgtaagtatttatatgctgatatgcattggcaatctcgaggagggggatgagaaatgaagtctatccaagttcccagggaaccatttttatccgggaacaattcgtgggtctagtgttctatggaacctaattaaagccatgaggataaagtctaaccaactgtcagcaacagcactatgaaatgcgatcctgctgctctttgaatatttctagtaacaggcagctcactacctgtcgggggagactgctcaattcaattatttctctgactcatgttttctcatctgggtaaatgatgttgagtcaaaaataacaaatctagtgcaaatctagtgtatctttcattagataaagacaaaatttcatgtttaatagtaaaaaaagaatgtatcttctttgactttttgactgatacccataatgtgatttcagtatctatgcatgggatgaaatacagaaccactattaagtcctggaaggaaattatcatatggttcctttaaacagaagcctcccttaggagtgttaaaacaatgccaataaaactccaactgattcccaatagcagagagcaggacatacctattcactatgggacattcttactaaaagtacagtcctgtgaaacctctagtctttctgctacacaaggcattggccaatgatgtaagaattttacatagatttgcctaaaatataataaaagctggggcatagatgaggggggtgagagacagagacagagacagagagagagagaagtgtgtgtgaatttgccaccaggcaccactgagaaagaaaagtagaggatactgatgggaaatgtcacaacctccatagggcacctaacagaagtgaatgcaatgaatgtgatatatttgattatgtgtgtgcccatgtgtactcccactgggttcaaccagtctaatttcatgcgcaaacagcacatcagtgaatgtacatctatttaactctgttaaaccaataggattattcctatttgaaaggcatatttgacacatattttcttttgggcccttggagataaagatgaaatggtccaggctatgtatataacgttaatgtaaaatgccacacatgcaacatatttagggggataaagagagaggctgatatttttctttcttcttacatcgataaatcatccctatacattcaagcaagtagcatatgctttcagttcatagaattagctgtgtaagcttcctggagcaatacacagatgtaacagcataggaatatggggaaagtaactacaaagagtgattctaagggctctctctagctttgctcaggagctggtagctattttggcaagaccagtctttgaagagacacacaaaacattgaatctgtcagggggttgaggtaaagtctaggcagtgtagatgtcgctcccaagttgaggtgaggctgtccttcaccacaggacatagtttccctagggagacagttgctgtgagatcaacatggaaatgaatatgaacatgcagaaactaagtgacaatgtggatagtgagagtatgtgtgtgtgcctgtatttatctttgtgtgtgtatcactgagtctgtaacgctcctttacaaagagtgtgacactcttgctactcgaccttagagaatctcttcgcctccagccccagactttcaatttctttatatataaaacaaggggataaattagactgagtcagcaaactatggtgtgtgaaacaaatctggcccaccacctgtttctttttttaaaacgttgtattgacatataatagtgtacatattttgggggatgcatgtgatattttggtacatgtataatgattagatcagggtaacagaaaaccatcacctcaaacatttatctttgtgttgggaacattctaattcttttctagctattttgagatgtacaataaattactgttaactataatctccctattgtactatcacatgctggaacttattccttccagtcaactgttttctctaccccctatttctataaatacagtttatttgtataaatgtaaggagtatgagtgcagttttgtcacatggatattttgcacagtggtgaagtctgggcttttagtgtaaccgtcatccaaatagcgtgcattgcaaccattaagtaatttctcatcactcatcgccacctcccacccttccaccattctgagtctccattgactactattccactctctgtccatgtgtacacactatttagctcccacttattcatgagaacatgtggtatttgacttcgtttctgagttgttccacttaagataatggtgtctagttccatccatgttgctgcaaaagacatgatttcattcttttttatggctgaatagtatcttattgtgtgtgtttgtatatatataaatgtaatatatatacatatataatgtgatatatatgcatgtgtgtgtatatatgtgtgtatgtgtgtgtgtgtgtgtgtattttttttttctttatttaatcatccactgatggacccttgggttgattccatagctttgctattgtgagtagtgttgtgataaacataggagttcaggtatctttcttatataatgatttcttttcctatgggtagccaccaattagtagaaatgctggatcaaatggaagttctgttttcacttctttgagaaatttctgtgctgtttttcatagaggttgtactaatttacatctccatataagtgatccttttctccacatcctcaccaacatctgttattttttgtctttttaataatagccattctggctgctgtgagatgatatctaattgtggttttaatttgcatgtctctgaagactagagatgttgagtattttttcatatgcttgttggccattcgtatgtcttcttttgaaaaatgactattcatatcttttgcccacttttaaatgttatttggtgatttttgttgttgagttttttaagttcctcatgaattctggacatcaggccattgttgaatgcattgtttgcaaatattttctcccattctataaagaaagtttactggaacaaagtcacaccaaggctgtttgtggctgctttcaaactactgtggcagagttgagtcgtggagcccacatggtctgcaagcctagaatatttactatctggccttttatggaaaaacttaccaaccctgaatttgactaccactgttgactttggcttatgattctatacagcacaaccaaactatactaaaacctacaccatacgtttcttgccctctttatttagaaaccaccttattcttagggggatttaatttacctgacaaaaatgtatggaacacataactgcatacatgtaaattccaaataggagtaagaaaagtagggcaaagggaaaatgagaggagagatgatgaagacaagccagagcaggggtgcaaagacacagagcgcaaacctgagccactctgtattttccataagccaccgacttggctctgagcagccaccactgagagacatgatccctttctcgatttagcatgctcactggatgttcaccaggaaaaccacaacaatctctggtgcaaaacactacttatcccatgagtctgtgcataaagcaggtaacatgagatgcagtgaacaaagtcctcaatgacacccaaacagttaagagaaatcctgacgacattgactgctatatccaaatttccctccgcatgagccgactccaaatcccacagtggaatttatcagcacgtcttccagcacatttcaatttttttaaaaaaagcaaacatatattacttttataatcagaaaataaacatttgtttagttaagaaaaaaataaaaggaagcagtactcttgacagcctggtgttcactttaatgtagaatccctcagccacgtgctccaagagaaggctctgtccagtcctgctgtttttggccagttgagcctgagtgccagggtgagagaggaggcaaagacaggctattctgagatctggagccggggggtcaaggaatttttatcatgtggataatcaggctccaggcgttgactataaaaagcactggtgaatggcaattatcatttgtcatttcttaaattgagctctgcatccttatatctagtttatcaatataaataattcacacctggatctctgttgctcactgctttatgcccagtgccttgaacagtgccaggtacagatgagcagtaaacacttagtgaataacggatgtgctcgtctgggagatcctacagatattctgaggttgtattggcaaattcttccccagctggaccttactcatgatgtcccagcttcgagattcacacctgtgacaattagacaggtgagatagaggcccagatgaggaggccaagctcctgagcgtgcatcaaggaaaacaaattaaaaattgaaacgggaaactgaatagccagctgtctggtcttgctttggtcccattgttgcagggataaacatttggacggctcaagacaaacacagctttgggttctgaacaggcagtgctgctttctcttgcccgccattacttaattgtgaaatctcttctttgttcagtgcagggacctgcctgctcctaaagggcaggcctattctcaggataccgcctggagctctgagatgcctgctttctgtgcagcaggtcccacttgctctgcatggccccaacagcctgggcaggattttctccaaggagaccttcagagagcagctggcaccttgggcaggctcaggcaaagaggcctgagtggaccatgcttctacatgcaaatgtttaacaagcaggccaagcatcctcaggaccaaattggctaaaagatggtaatgtcaaaatgtcacagccaaagtgacagctgtcagtggcttagaaaagaaaaggcattatcttcgactgggaagtaatgacacaaaaggagcaccagactgggagacagggagctggcaggtactagcctggctctgtcactcaaagctgaatgtttttagacaaataattgcccttgctatatcttgattttctcaactgtaaaacagagatgaattcactgataagattggcctgttttcttgtaatgaacccctacaacacaacagcaataaggagatacggaagaaatacgacattgtccttccccttcaaactgatcataacatataaggttagcacagtgcctggatcacaagaggcgttcaacagtgtgattgccaggagagtctcaaggtggccgctgggtgtgctgggcccaatgagttccatttccatgatatcacccacatgggctacctgcatcttctgcttggtgtcagtgcagaccgtgccccaccaggaccacatcaggaatctgctcccatgccatcactaaagcagtagcttactgccctaacttgtcctatagcctccaagctctagcctcacccattcagtctccacttgtcccccagctctctctgtacaacaccccctgcctcaaaatctccttgttctacaaacttcaaaaattcatttttttttttttgagacggagtcttgctctgtcacccaggctggaatgcagtggggcgatctcagcagagccgctcactgcaagttccgcctcctgggtccgtgccattatcctgcctcagcctctcgagtagctgggactacaggcacccgccaccacactggctaattttttgtatttttagtagagatggggtttcactgtgttagccaggatggtctcgatctccggacctcgtgatccacccacctgagcctcccaaagtgctgggattacaggtgtaagccaccacgcctggccccaaaattctttagcatggcctttaaagccccaccaggctgtctccaggacacttccccagactttggggtctgcaccccccatttcccagagcgccaggctccttctctgtttttcctgctcctcactttgaaggctttcttctcctttaactctcaagatcctaactcacacttaaaagctcactgcaaatgcattctgtcttattaagtattcttcacaaattccagcccacctagtggtcattttcttgtgtttaagcctggatatgtttttattttttatatcttcccgccataaagcagctcatcttgaaatgggagttttagttcaaagactttcctccctatgaaagcttttctgatcagccctactttcccctacagcccctccccacactccacaagtgcacaccgtgtttgtactcatagcacttatcctccatgcattccttcaataacttccgcatatggtgcaatagaatcaggatccttccttgttttctccagagctgaaacaaatacacttggcccagaattagtgttcagtaactcttgcaatgctgatgaagaaaattagaactgtctataatggccacatggaaggaacaagtgtcacatttgtgcagctaaactgtctgctgctccccattcactatcaccaccatacatatagaatacactacctccattttgtccccatgaatacccagactcagaattcaacctctcttaagtttccaatgcagaatccactcctcttcaagcatgaaagagcaatggagacttcagtcaagaggcaggaggagagatagaggtgctgttacacagctcagccaacagcaagtcacctccaagtccccactagacactgtccctcctgggtcacaccagactgaattgtctccctctctgccttcctccaagcagccactgacctcaccagtttctctctcctcctccaaaactccaactttaaatgtcccctctttccattttgccatcaattgacatcagccatggtttcataaccagacccttcagcacacagctcacggcagatccctcggtgaacagaacctgtctttcttgaaggctgtgtggccagcacctttgattactcaagcaccacgttcattctctcactccttcccacaaaagtgtgtgtgatattgatcccagacataacattgagttctccccaagaaggattctgagaagtgaaattctcaccacctccctccatctacagtcacctcttcactgagtttttgctgtgagactcagagataatgactgttttccagtgtccctgcctggtctttgagcctcgcaggcctcaggatgtccctactccttccatctatgagccaaatgactcttgactgagccctagcttcatgccaggacaggtggcccaaacaaaacagcttccagaatcacaatgagaaatcactccgaatgcaatatccttctcagggaaactcctgacccagagcagacccaagaaagcaagctagggctttcctagagcatgggcctggctatggcgaccaattcatccctgtttgcccaggactttcccagtttttgcactgaaagactcatgtctcatgtacccctcagtctcaggcaaactgggatggttgatcactataagcctgtcccagtaatgatccttgacaaaaaccaagggctcatgaggccagccagtgaagccaagcttcatataagcagatcagagagatgttggaaacatacagagaaggggcagaatcagccctggttgcaggtgggcttaggagacaatctcatcagaaaagggcacacaagcgagctctaggtacacgggccaggcagcctcaggtgggctactgatgcatccaccatcagcatgactgatttctaccgtgcacagggcccagctcacacactgcagaaaattaggaaactgctgcaagagggggtccctatgggctaccacaggacaagaagaacatcccccgaagaccaccaaacacacactcactcagcactccccaggatccccgcatttgtagcccttccatgagtttctggtatatttccttaaccctcttctcctctccaagatgatggagggtgtgtgtgtgtgcgcgcatgtgtgctttagcagaggaaatgtgctacatcttcccaacaacccttctccactgcaaatcccactccttgaaaatccctccacaaaccactgtacacaaggaaccgagcctctcctccatgaccacgcgggagcacttgctgctcacccccacctcccaatagccagcctcctgcagaagaccctggggaatatcacgtctcataagcaaagccaccttggcccagacagcaaggcctcctggtgtgagaagtgggtggagactcaccaggactctgccagtcagtgtctgggcggatatcatcacccccgcccagtccttcacggaggtcatccagccgacctcggcggccactgcctcctctttttcatccactggtttgagagtgccatccgcctggcttgagccattgttaatcttctgggcctcctggcaacagagagagcaagagttaagacatagggaacaatggatttaaataacatgctctacccataaagaaccagagccagaaggggtccccagctgagatggaaactagcttaaaggtataggagtaaagcagaaggggtaaattatgcctttgatttttttaaagcctttatttaaaaaagaatattttctttatttcctcttaaaatatcttagtgaaacaaagaaggatggtattattctattctattttattttattttattttttgagatgaagtctcactctgtcacccaggctggagtgcagtggcgcaatctcggctctctgcaacctccacccaccaggtgcaagcaattctcacgcctcagcctccctagtagctagaattacaggcgcgcggccaccatgctcggctaatttttgtatttttagtagagagggtttcaccatgttggccaggctggtctcaaactcctgacctcaagtgatccgcccacctcagcctcccaaagttctggtctcctcccattttaaagaaaaagaaaataccaaagcaagaggaaacgcaatctgtctaagattagggcatgctgaggagggaggaggaaagtgtgggagatgtcctgtggtctttgcctacccagcctctatgccccttttcacagcagcacccccactttcctttaggaaaattatctcttcctctcagtctatgtagttcaaaggggacagatggcctcacattggctccaacattggagtcctttctaccccctgccaacagcaattgggccattaataatcacatgatccatgccaagccaataagactcaagcgtggaacatttgcaggaaagaataggaaaagtcatccttccctgagaatgaagccactgcagagaaaagtaaaagtaatagactactgatgtcatcatttgaacacccggatccagctgtgcctgaaatctacaccagacctttccagttacaggagacaatacattccccttctggcttaaaatgtgcttgaggaaacaaggctgatttcatcagataactgagccccacacaggggccgaaactgtaaacctttgcatacagtgagtgttctgcctggaatactcttctcccacagagacttatggcctgctcccttaagtctttgctcaaatatctccttttcaatgaagtcttccctggccacctgtttaaatttgcaacactttctttccaatagcacttttctgctttatttttctccatagcacttaaaaccgctaatatacttaataattcatttacttctttcacttactgtctgccttccccactgctgcagccttggtgcctaatagagtgtctgggacagagttggctcaataaccatgaatgaatgactagaaagggctatgagtatcagcccctcgttagctacaaaggctgggtttagtgttgccagataaaatacaggatacccagtaaaatttaaatttcagataaacaacaaataactttttagtataagtatattccaaataccacatgggacatgcttatactaaaaccttattatttatctaacaatgtacatttaactggaccccaacacaaatacccactgcaactatgactgcagatgaagatgtttaaaaagatgccagcaaattatgttcatcatttaaaactctggaattaattcccaaggcaaagccacactggggatcattgtgatttggagtaaggggaagaaccaaagacagtggtgaaaagctttgtctgcagtgacaaagggggcggggcagagggaggccaggcacgtgggaggcaggtggggagggtgcactggtgagtcatcctcttggggacttggccacggcaggcaggaagctggtcccgattcctgcttctctccctctggctgcctgtggctcagggaagctggggaagagaaaagtgggacctgcagccctggacgctaatattttctttccaaatgtgttaagccccacagagctacaatgatccaagaggaggcccaggagggggaggccactgggcagatgtatctgggggctgcctgctgacatgtgtgggacctgctgcccaagcctcccaggccagcctcagataggacctgttaggtcttgccctggtccctgagcctctgccctgtgagactctgaacaggagggtatttaggaggatggggaggccctgatacagggtcaaccatggtaactgaaggtgtagattcgggggaaaatccagctctgccaccgctgtgggacctcaataagatggggacagtactgccagcccctcaggcattgtcaggattaaacagtgtccaatagcacaaaacacaggttcaagcaattatcccagcaccccttgcttcttctcgtgcccctgacaccataaagcaatggttatcacaatgagcgggcatcataagcacaccagagggcttgttgaaacacagtgtgctgggcccatcccagaacctacattcgaaccaagatgtcaggcacttctgatgctgctgggcttggaagcctactttggggaccacagctcctgactaccctagtatggctcggtgactgctgaaatgagacatggatcttcacccccagctctctcctggcctctcccttcacccaaggacagaaccacctgcttgtttcaatattggacattggtggaggggtgaggaaaagaggagggcagggagatcgtcccacatctgaggctctagtgtttccttttgagtcaagcctcccaggatgtttctgaactggtccctggccaccacgtggggacctggaagatagctccctgctcctcagtcctgggggcccaagttccacagccccttggtagaccctggagaggagaaatcaacgtgaaaaaggctgggaggcaggggggccctccagtcacagtggttaactgcatcagtaattcatagcacaagaggtatgtggcagataatgctatttcgccagccctcttacctattgttttacaaggcattcattattttaattactttatgataggcaaggaaaaacacagactaaagggagataatgcccttgttattatttgcttacactagatgttgtgagcttaattaccatgtgtgggaagcaggactgggaggagtgatgggggagctatttaaagcctgatgccagccggccagactagccaccaggctagccacagatcttgtgcctggaggaagaggcccctctctccaccactgacttcactctggccaaagcacctcttatggggagcaggcattataactccatgctccaaagaaaaagcagagaaggttcagtagccttgctgggaacatgcaggggcagagtccattataagagtgttggccaccattgaacaagccagaactaggtgccagcaactaagaattaagtgttttctatgcattgtcttgcttaaaccttataatacatccaacaggcaagtgaaattatttccattttacagacagggtaactaagagcaggtatctctcagaaaaaggcacagagcctgagagctcaggctggaagcagagagcccacctgggcttgtacctgctccagaacttccaagctgatggctgtggcccatcaacccttgagtctcagcctcttccatgtaagatggggacaaacatgccgcctcattaaggtggtggggaagctgaagcttggcacagtcccgggcacacagtggttacagctgccctgatgaagcacccgctgatggggctggggcctctaagagtaatccactgaagctgcaccactttcatcaaccagtggccctgggaggcacactggccagagtgaacctttaataaataatcacagaatggaggataaggaggtgcaggttctaacactgttatcctccaatgagcaagaagtccctataaggcaaggtgctgtgactcctgcagggcttctagtaggcgctgtgtgaccaccacccaggacagctggggcagggattcccgcacagggtggaccccagacccagtgacatctcagaccccttctgactcgccccattagatcaacctcccatttttaagatgagaacgctgaggaccagggagaggctgcctcctgagtcccagcattccgttcttgctcctggccccacaggatactgcctcacaggggaacaaatggtttgttccaaatagcaaaggggatatgcagccacgcccaaaccttccacctcccactgcagaggaccctgtccttacacaggaagcacttcccagtaggggcagcccgatgtcagtcaggaaatcactgagtgcgtgtgctcacacatgtgtgtgtgcatgtgtgagagtgtgtgcatgtgtgtgcacgtgtgagagtgtgtgcatgtgtgtgtgcgtttgtgtgcacgtgtgagtgtgtacgtgtgtgtgcatgtctgagaatgtgtgcatgtgtgtgtgcatctgtgtgtgtgctcacacatgcgtgtgtgtgtctgtgtgtgtaagggagagaaaccccactggctgcagcctccagctaccccagcttcaggaggacaggccaccagatcttctgaaatgcaagaaaagatgtcttgggaaaagaaaggaacatggagggaagaatagggagaaaaatgagaggtgaggccatcgcgtggggaggccatctcagaaagaggaggtcctgcaggagccctccccctgcccttggcagctccctgagaaagggattcggccttgcactggaggccactctggatctgcctccaaccctgccctctctccccactagagccttgtgtaaagcaggccacagctgcctctcagtggcaacagtgacatctaatttcagtgcccacatcagaaggtggggaggaattcagggcaagggtgcaggcacaggaggcagggaacaccagagagaagagtggccacagtcccctcccgacacccaccctaccaggcaacctctcacggggctgtgcccagccttacaccctcacccctttctatgccttctccccattccctttagtggtgttccccacgatgactttttgttgacatggccgcagaggggctcacccttcctatgtcacctggggccaagggcctgactgcaccccatcacctggtgctcaagatacaaacctcatctgatgcgtttgggcatttcccgctgaatcacaagatcaaagaccaaagcttgagaagggaccttagcaattcctgaggatccccaccaccacccaactaccacacacacagtgtacagatgagaaaactgaggcccagagggaaagccacaagctcagggccacccagcccagccaggtgaccaccgggccaggaagcaagccccagttgctctgtttcccttatctcttgttgcctccccgataagacaattgctccaaatctagcccaagtgacagtcactctgctgccccagcctggaacctggagttcagggtgttcctaggactggcagaaggctccacctagcctggtactgggttcaggtgtgagggtcacgacaagggctaatcctgcttgtcttcaaagggcccagccttccccagccacgacagctgctctggtctagcacaggagagcaagcttgtgctaatcctaggaccccacagccccatccctcagatttggctgtctccgtctctcatccttgctgaattagacccagtatactgggactctcaggtctgtggtgtggcaggaagaactatgaaaatcaaaagatactctggaccaagtccaacttttctgggtggcctccagcaagtcatgtcattcctcaaaccctccatattctcttctatgaacagggatgagtcctgccttgtcaccctgcctgattcttgcaggagccctaatctggtaacagagcattgcctttctgaaagcaactgctttacaaacggcaggcaagtggagtcactgtcctctggttctgggcaggaagcagggctgctctggagaaagaagtcctgtgccacaaagccagagccctcacagaacgcagggctcaacactcagattcctacccagctgcaacttgcagggcaggtcccccgttgtcaccctgcaccctaacaggatgtcaaattgccaagtctcagcaggtgacctgtcatgctgggcacaccctccctgacagggtgagctgctgccacacctgctctcacccggttggactctctcacccccaggcacactcctgacacctgtcaagctgaaccaggcaccaaggtcactgcaggcaccacacctgctggatgactgcctcaggcatgagaagctggctgggcccgccttgaggggatcccagggcccctccctgctgcctgcctagagccaagccttgaagctccaagtctgcctcgggtttaactacgtgtcagttctttggacactggttcctcatccaggatctgggaagttgtttaggcaaaggccatctgggaagaaaaatacttttcaaaaatgtaactgaaatcatgtcactgttgtacccaacaccctcctatggcttcttggcccattcagaggacaagtgaagtcttcacacccaatcagccccactcgtgcctgtcatcctgcgagtctgccgctcactagctccacttcagatgcaatggcctcctcatgctgccaggacattccagacccagtcccgtctcggggctgtctgcactggcctctgcctctgctccagagatccccgtggctgcaccctcatttctctcgagctttggttcacatcctcactttgtccatgagctctccacctcatcccgacctctccctgtctgtgctgtcttctccggagtgtgtctgccacctgcttcctttacttcatcattgtgtgctgtctgcaagctgcatgagggaaagagtttttgtctgtttctttttgttttgtttgttttgttttagacagagtctttctctgtcacccaggctggagtgcagtggcgtgatctcggctcactgcaacctctgcctcctgggttcaagcgattctcctgtctcagcctcctgagtgctaggagtataggcatgtgccaccacacctgtttagtttttgcatttttagtagagatgggggtttcaccatgtctgtttcatttatggctgtatcttcaatattgaatccctgtgagctcagagtaagcacctgacaaatcttggtgggtgggagggaaggaaggagtgggggaaggaggagaggagggaggagagctacagcaaatggaaagtcagttcttaccatgcacaatctagaatagatattactagtaaatagtactactaacaataattatactatcgactactgttttttagcatgatcatagtaactctatgacgttggtactaatgtcctccattgacagatgagaggttaagtagctggcccaggaagacacagtgtgaatttaaatccagctgtctgatgccaaaaagggacacgtacccatcctgctgtcctcccgggaacagtgtgagcagcagacgggagaatgcatgtgcaaggattattggctgctgcaaagtgcccacgaaaggtttattaacatgaagagcactcaattcatgccacttctgggtactgcttgtaccatcacgacccttcttccagggccctgtgcctatggagggcagttccatcaaggacagagaaacacagttcctttctctgccaagaacctgcccggaaccataaattcacccttcgtggagcagagtatcacattggaaatgagcgtggccaagctgacgggctgtgaagccctcctgctaagaaccacggttctctatgcagatgctgctaaaggaagatttggcttcctccctcgccatgcgtatccttggagtccttagcacgctctgcccagcggtctccagcactaagaggctgagctctgccgggcctgacgcacctgagtgggaggtagggttctgacagggaacaggagagatcaggttagcacaaaaccatctccgctagcccttttgggaccagagtaggggctgggaagcccctctcatccctggaagctggatgttctgcccagcaccctggaaccatgggatagtcccaggatgcttgacccccagagggctgtgagagaaggaagggcctcatgcctcacagcccctttgtcctcaaattttcctggtcaacatcagaaggccatttcccctgagccttcattgatggactgcgctctgagttactcattccatctgccaggagccccaccccaccctctccctggccactccattgccccatctcctctcgtctgttgaaactgacccagcagccccacatgctgctgtcctcaactgggcacaatgcagaagggctccttctctcctaccaaagggtgggggcagggggaagccttctggaccagaagctatgaagccaggcacaggctgtgtgccctgggccagtcacctaacctctctgagaagagtccctatctgggagacgagagggggtggtgagttaaatccacagttttctgtaccttgaggcccagcattgtgaggtgccccaggggggctggttaccaagggagggcagaggaggcagggccccggaccccgcggaaataaaagcgcctctgcattgagcaatttcacctattatggttctgtgctagactgcatctgagtgaagggattttctggggaaaaacattagaaatcccctgagtaaaagtccataggcccatgttagcttttttttgttttgttttgttttgttttgttttttgagaaagagtctcactctgttgcccaggctggagtacagtggcgtgatctcagctcactgcaatttctgcctcccaggttcaagtgattcttgtgcctcagcctccctagtagctgggattacaggcgtgtgtcatcatacccggctaatttttgtatttttagtacagacagggtttcaccatgttggccaggctggtctcaaacttctgacctcaagtgatccacctgcctcagcctcccaaagtgctaggatttacaggagtgagccacctcgcccggccccatgttagctttttaaaaaatgctttgtttcatgacaataactatgacatcctgtggcacagtttggcctaagatccagaagtgtctgaacctcaataccttaggaagccctggggctgctggtccctccccgcgggctgctctcctctccttcgcctcaggttttcaccagccccgaatgctggggctgggtcttccgtgtcccccctcccatgccaaagaggacatccacccagcaacctctttcacctcctgggcgggtttcccagccacgggcattctcccaggtaccaataatcctgcatattagggtattaggcagattacccaaagcagctcaagcaaatcaagcatagcatgggcaccaccagctggggttttcatggcaagagttctgcaaagggaatggatggaggaggtggttactctgagactcaaggaccagagaaatagggcaacaggggacccaggtctttcctagagctggtgtcaggagtggcagagttcacttctgcccctgggaagttgcatagtccaacctctccctggctgccatcacttctcctgctctgcaccccggagactctgcaccagcagggcttaagacatttgcactgattaattcacctagcagttactgtgtttgctaactgtgggctgtacctttagggaagggacacactgtccacagattcaggcaacaggaacttataaagaagctgggacctaaccgattaccccgagctgtcagaaagccctgtgagtttactgggtgtctcggctggacctacagtgctccaccattgaggcatttttagccattgctttctgggtgccctgtccagattctcactcttagaagcacccctgcgctgggtgtgaacaactactctttggaagtcttcatggtagaaaaaggccaggtgacctttaacaagtccttaccatcttgtgcctcaggtttctttgtctcaaatgcagggagccatgtaaacactccccaaggtctgtccagctctaaactgtctgacccggaggcctggattgttaagtcccttactttgcacgcactgtctcagctctgtaaccctgggcaagtcaatcaagcatcatttccctcccccgggaaatgctgcaggacagattccttttcagctcttctcagagccaggttcaaagctgctctcccattccctgaggaccaagggggtcaactggtgctcaggagatcactgatcccctcttacatctactgtgttctgtccttggtgattttacaccaacttaatcttcacaagaagcctgcaagataggaatgttttttctttttttcttttttctttttcttttgagacagagtctcactctgtcgcccaggatggagtgcagtgatgcaatctcagctcactgcagcctccgcctcccaggttcaaacgattctcctcctcagcctcccaggtagctgggattacaggcacccaccaccatgctccagtaattttttttttcctagtaagatggggtttcaacatgttggataggctggtctggaactcctgacctcaagtgatctgcccgcctcagcctcccaaagtgctgggattacaggcgtgagccaccacgcctggctgcaaggtaggaatgtcatgaggctcagagagattgggtaattttccaagattacccatcttgtaagtggcagagctgaaatttcaatctagtccattctaactctgaaggccatattttttctctctattccacactgtcttgggataggtccaatgtgcaagaacagagatggaatctccatataaaattctgtttactactactactgaaacaaccatctcacaacctatggcttctaagtaacaaaatcctgtagtacagacatctaaattcagttataatccactatgtacggacagagagttggagaaatgggctaggggacggggatccaacctgggaatacaatgctcattagacattagatatgttctcaaatggccacatatgctgcctaaaattagtaaggcaacctccaaactttcagggctaatacatacatcctggccaatgtgccgtatttgtaaaataacaatctccttctctttcaattagcttaataaaattggaaaatataagtgacagtccagagtccactatcagagccatagagactttgaattggattagtagagtcctcagccaggatgaccctggcagggtccaagacagcctgctgtccatcagagactcggagactcagctgccagtctgcagggcagcccatcctgccccagaagctcagctcaagacctgcccagacaagaaaactgtggcaggggcccagcaggaaggcaaaaattacatttgtttctcatcagggcagactgggatatggataaccaaacacacaggaaatcccaaaccctcatgttcataaaagaatgcagaaatcttcgtgccaagttaacttttaccggagggagcccattgccatcctgtagaccaggaggaggatccagcccccaaggagcctcactctcctcagcaaaggctcctgcaggtagctcacaggtgctctgttcccatgggtcctgcatggccacagggcagtgctgcccctgatgtggtacggaatgaaaagcctcagtacagcgcactgtgtgtgtcagtggaagacaactgatgaagggcctctcccaggaagaactgtccttttctttgacattatatcgttactcctttgttgggtattaacatgtccttttaatgaaatgacaatggtggcagagctggcatttgacagtttctttttttatgtttttgcttgtcaaaataaaaagctggtggccttgtgatattctgttttataaaaattcattgattatcccacaaaaagtctaggaaccactcccctagcccaaatgcctcattctacaggcaggaaatttaaggccccaatattccacactcatagtggccaggttcccctcgaaaaatgtggctttcagacttcaggggcccagggtgtgtctgtcacactagccagaggcagccttggggccaggaaaggtagggtctgagggatggaggcatggtctctcagggctggaggagctctgcaagctgctggcccacacaataggggaaaggggaaggcaagcattttcagagctcagggccataccaaccgcctgagttcctggcatctaatgccttcactaccactactgcaggaaatgcacagaactataacaacctcccgggaaatactacaagtgttaccgtggccccaagccaccacccaaggggcaactgggaagaaagaattcaaccacagatagcagataggatgaattgtttatggttgaatattcccttcagagtcaacagaggactccaagcaatttggagtaaaaagatgagtaacccgagagcaatgtaagtcacagcccagtgccccacacggaagggaacacggtcatccccttcgctgctgttctttgcttcccaccactaccaccttcatcacacacgtgtgcttattctctagcagtcagggcagagtctgcctgatttgcccactccacatcctcaaagcctgaacagcacctagcacacggtgagcatttcacagtgcactgaaataataaatgaagaaattctgttttttgttctgtcctgctttgttttcactcttcgctcatatcttctggaatctcaaaaatcctgccaagtccacaatgccctaagcatagaagtcaaactcctcaaggcctgatcttcaaggcctggagctgaggctgccggctgccctccccactcgtcactgacctgctcttccacctgacttctcggctatgacttggtcctcctgactgccacacctccgtgctggctgttcccactcctgggatgctctccccattgctccccaaccatcttcatcctccctgatcaaatcccagaggtgcagtgaagttctccttcctggctagatctccccaaagctctccctgtcctgtctccagggcccacatctgctcccccaattccacatgggacaggtacttagctgtcttttggtccatgcatgttgcattgccccagttagcctggacaatccttgaaggcaaggcctatataccttttatgcccaaagtgtttggcatacagcaatgtgcttaacagacacgtaccgattgagtaaattaaatctctgctcagtgggcactggaaaagcaagagctttcccaggcatcactgacgtctgggtaaaccaggccagtttccatgacttgaagcttaaactgggggttggctcctaactgctgttcctcagggcagctacattttcaaataaaaacactaaatcccaaatgagatcagatgacatggagcttctgagaggcacatgccctaccaggcatgtcagtcaaaagaaagatgaatgttcttgtttacaaaaggatttgtcccgtgccaggaaaatttccaccatgatttaggacctaatccagtctgtgcctatagacctcaccaactgaacatgttcccgcttcttccatttgctgaacttggatggggcttggcttcgggtcaaaagagctgtcccaattaggtcgtcagacagcctttccccacacttaagatgatccccattcaggaaaccaagggctagcaagacagacagactttgggaggcagaaagatggccaggttaccaggcatacagcggcagtcaggatctaccgctccgagcacagcccagcctgaggaaccaggctcccagagctgccctgctccctggactctgcctctgacctcaccccttggaagaactggctgggttccaaaacttcagcctctatgtccctgggttcccacacaccctagtttggatctaggtctccaacacagcagccaaacacaagagagtccagagcagttgctaatgtgaaataaaaacaattcaacagcccagggaaaggagacaggacttctttttccattggattcagagaactccttctccttttccttctcgatccctaatgggagttaaggatggcaagcgcctggccctgcaaagcctcaactctctacttggctccgctagacccatcaatcttctctccatggcctgggacccctccaaccctggacgtcgagagagactcggcagctgtgagaaccttctttctcaagtaaggtttttttccaaaattatatcaggtttccttctaccccagcttgtcagtgggggactcttttgcctaacatggttgaggaatgtcttagaaactggtgtgattcaatctggcttctgatgaggttttccacccagacagagctcaccgagtgtctggaagtgtcggttccctacacccaggggcatccacaccctgtccccatctccagacctcagtgaggaggatacccttgacaaagtggctggtccagccctacgatgaagttggatccagaaaaagagccaagaggaagccaaaaggacttgcccacacacttgcatccacgggggcctccctcctaccatgtcccctctttcccccaactttctaaattggtgaatctacttgcaacacacccagtataaataattgaagagctcccgatggaagtggctcaataattgaaatctcaaaaggcacacacctttcttttagaagagagggccacctcattcagacttctccaggggaagtcgttcttcccctcattccttttcagactggcctccttctacaaatacagattttaaccagagggtaattgttagaaagtgcagtttgcaaaaatgtcagtaacctgaatgccaagtttactaatgaattgtgactaggctgttgttagtgccgccacactctcacctgaagacccacaatctcccctggacagagggaaactggctgtccctctgttactgctcagctactgcactgaggtggggtggcaccagggggactggcatgaaggtcacatgaggggagagttccttttacatctcagaagtctcttattataaggatctgccaactgcaaggagagaagagccctgcagagcagagggacctgccagagcgctgcaggcatcaactttgctggcgtcttggaaagacgccccacgtctccataacaactaaccatccagcccttagcactgacagggatggagaccttttttggaggagcagatccggaagaaaggtcaggtggttacctgaatcccaagtctctttgttttgttttgttttgtttttctccttttgcagctgtttttcttactagaagctaggcagaaagagttgttactcagatttcttgaacttgagacgtcaaaggtgagacgccagccaaggagaagggatggtcagggaagcttctggggataccgacagtattttattttttgaactcagtggtagtgacacaaattttctataataatttgctattttgtaatttttcattttatagacttttctgtctatactatttttttaaagtctttaaaaaataaattgggcaaactgctcttcagggacccatcgtcattgccagcatttattaagtatcttctggcacaggacagaaatcagtctgcaaatcaccctgtgtcacagccctggaaagcaggactgagaaccagaaaacttcagtggaagtcattggtcccagtggccaaagcaccaaactgaagaagaaagtgaagaggtcaggggcaatcacaacaagtcataggatcaatgggctagaggccccagagaacttgttgatgcagtttgctgttatcccagctttagagctctgcctataaacaaagtcatagagaggggaatgtgattcatgatttgtacctgccttggaagggcctgaagtgaattggggtacgcagggccctggccatcagtgaaagagtgggtcttctgctgccctgctgatccactgctgagggtaactcatggtcccagcacagccttcactgaactgtcaggcacatgaagcaatcaggagtctagattgagtttccaaaacaggagcacctctttgctctctgtaagcctccactgatggctcatgccagccacatggctcccctagcctcccctgcacccaccggaggctgttaatagacctgtcattgtgctcatgttggattaatgaccactgttctccttcccaaatcctacacattgtttaagagaaagcctaaacgctgcctctgccatgaagcctctccagacctcttcagtagagctaacgtctccagggctgtttgctcaatacttcctttcaggtatcagtcccctcagatatcacttgtttctctgcttatcagtcctcattacattctagtccagtggctacatccatcagtctcccggctaagaacctgaggtcaggagccagggcttattaattcttatatttcatagcatctagcactgggcctggtggatttgtagcaggtgtgcaacaaacaatcaatatttattaatatatcagggtccaagagcacagacccagtaaccaggaaggaaggttctttaggttgtcagagaacacaaagggcctggcaggagggaggccaagcatcacagagaaccttcacctttcaaatctacccacttctctccatctcagcttctctcccctggttgactcctaagcttcataatcatttacattgtatcatgcaatggtacaattcccacttagttctgcccctcattctccacactgaagccagagagataccacaaggtttctatcagtcacatcatgcctgtgcttaaactcttctcagggactcccccttgctcttaggcaaaagttaaggccctcagcatggccgtcgaagatgctctggcacatctggcctttgccaggcatctggccacatactgaaatactcttggcctcacctcccttaatccacagcaatactggacattcttgcattccttcaatgagcactcctcttttctaattcagggatctgcatgtcctaggtttccttttcctgtaacaaccttcttcacacagtcatattccagatgtcctactcatatttaagatctctccccaggaagcctttcctaactcaccctccacctccactccaccaccaccattgctatcagtcaataaaaccttccaatcatgtggtctttgcactgctccttcataacactcaaggcatttgcaagtacttgttcagggcctctttgcttcactagactagaggtgggcaaattgtttctgtaaagggccagataggaaatattttaggctttagcatatggtctctgttgcaactattcagctctgttgctggggggcaaaagtggccttagacaatatataaacaaaggagtgtggttgtattccagcggaattttatttagagacattgaaatcagaatttcataccatttcatgtttcatgaaatattcttcatttaaaatttttgttcaactatttaaaaatgtgaaaaccattcttagctaatgggccatacaaaaacagatggcaggccagacttggcccacagcctgtggtgtgccagctcctgcactagactatcagtttcctagagacggaagccacgtcttgttcacagatgtatctctccagcacagtgtcttgttctcacaaggcggttcataaaaattcactgaatgccttgatatgtggactagagccatgtttcccagtgtaaattcacggaacaccagtctgatgggaaactccatacaaaagggacacttctctttgcagtgaaatctggaaatgccatcattcctcttctaacaaatgttcaatgctcactgcatacagcatagcaaaagctcagagatagccttcagtcaaggaacctgttcaacatagaccaatacaatgctgcccacactcattttgaccaaataactttcttctttaacccaaaatatctgccagtgtccaagggcagccccactgaaaagtgatgcagtgaggagagacggcagaatttagaggaatgggtctcaaactttagtgtgcatcagagtcaccaggaaggcttattaaaataagaaactaccccagcccagagtttccaattcagtaggcttaggttggagcataagaatttacatgccttacatgtttctcagctgacgctaatgctgatggctaggggaaccccgttttgagaaacactgatctgcagaataaatgatttcaaggcttcggtcctctagctggagtttgctcctccatccaaggatcttattcccaggtgaactccaacttgtccactttctcacactggcagtagcagctctgacccatctttctagtcttaggcacctgtaatgggttgcagtgtttttttccaaaagatttgtttcaatagtaatccccagttcctgtgaaggtaagccttatttggaaagaaggtctttgcagatgtaatcaagttaaaatgaggtcatactggagtagggtgagctcctaatccaatatgactggtgtccctaggagaggaggaaagagacacacatagggagaacgccccatgaccaaagaagcagagactggagtggtggctgcaagtcaaagactgccagccaccagcagaaacacggaagatgcaaggaaggagaaaccctacaggcttcagagggaggctggccctgctgacatcttgatttaagccttccagccttctgaactgtgagacaataaattaacattgttttaagtcaaccccgttgttatggcatcactaagaaacattctagtccaaggacagataaagctctggccaaggccttattcttggtaggtgtccacatgaactctgaaggaggaagccacgatgtcagctgtctgttccctttgtcatcactgctagacagtgggtgtctgcgctggggtctgtttttggaaattagattatctaattaatgtgatgttttgttggatccatgccttagggctggatttggcaaaaagcatgtgattattttttactcttaaaaaaatgtcactaaataagataaggagacttggctttgccctatcttgggctccacatgtcctgtttctcactgagagaccctggcaaggagtttctcagtgacaaagaaatggtttcttctcctctagttctgagctataaacaccttctctaatcgacatagaaacggctaagcagtagatattttcagtcagagtaccccagttttagtcataaattatatgcctctccttttggaaatataaggggtataatttttattcttgggcagacatagtcctgtgcccgataccttaggaaagagccaaaaagagaatgtggacacagcttgtcatggtggatggagaggaaggagacaccaggggtagggactctgtattctgaagctctgaggccacaggatgaaaaatcagagccaagtgaatgccttctctgcctctccaatccatgccaacccagggctggctgctcacatggggtctgcacaaacttgaaaatctccagatgttttataggggggacaaagccacgctttctgctgcaacagactgtgagacttttaggatgctcaccccaaggcccttgaaaaatgagagaggggtctgattctttgagatgggtaaggcagaggcaccccgtggaagtcaagcattccttctctcttccctcccaaggccagcatgtaatttcaaatgtccagtccatccatgaacaatatgttagcctttggccaggcggtgagcttccaaaatgcaaacatctcagcctctgtctgcagaggtgagaattcagcttggcagaggaatgggacactgtcaaggaagacaagcttttggagtcagacaatcccaggtttgcatattggccttgttttgttggtttgttttgctttgtgttaaaatctaatttattctgcaaactacagcaggttagttaatcctttgaaacctcaggtttctgagctataatacaggaataattataagtgctttgcagcagatttgtgaggattctgagagttgttggatgtgtctagcacattccttctaacttataaagcattatatgccaagtatgaatctaagtaatgcacatgccctaatcttttccatccttacaactatttatagcactgcccccatatggcaaatgaaggctcagagaggtcaaggcacctgcccacagtcacaaagtcagtaagcagctgattctggagctggtgctctcaccacagggactgctatatacccatagtggaagcctggggctaggaatgaagatctgtgttcattcattcattcattcattcattcaacaattcacctgggcatctctgagagaggattactcacaacaggttctcagacaaaaaaaaaaatacaatctctccttccaggagttgaagatctctcaggggaaacagacaagtacccaaaactaaatcaaggtagaatatgacaccagggaggaagagagtatggcagaggacctgttaaatggcaggaacagactgatttaatgaaggtggtggtatttctgctgagcctcaaaggataggcatgattttgacagatgcactcagcctggttcagtccaaattagggcccccttgttctttctcatcacaacccattcatttcctttgttggactcactgtgattttaatttcacagctatttgctgatttatttgttcaatgctggtctcccacactagaccatgagcaggaaggagaggcagcatgcaactgtgctcgttgtctacacagggcctagcactgggcctgggccagggcaggcacctgggaggtatgtgctgaataaatgaatggatggatgggtggatggatgggtggatggatgagtggatggatggatggatggatgagtggatggatggatggatggatggatggatggatggatggatggatgaggatataagtattggcaggctggtggcagcttgcagaaggagagcacattatctataaacacattgccccgatttatttaacattgtagtcactccaaatcttggttaccctcacctgaattttctcttttgggggaagttttacacaaccaccccagtttccctaaatgccccctccctggattcctgcagcacttgaatttaggcttctgagcactggtatctccccaaatagatgagactccccatgtgggcagcagccctgccttctccttcatgtttgtccacagtgcttgggtgagatctggacatgtagcccacactctgttgaaacctgcccatggcatgcagctgaggggccctgccttctccttgtcctcatttattgccatcagtcaaccaccaatcatcccacatcgaccccagaggcattggtcttggggtctccctggtgcggcaatgtgggctgccttcccagccttgtccaggtggcaggacttctgctgctgacaacagggctgtgatactcagctccccaaggctgaactggatgactaagagtcctaatgattctggtattttttcaggacctgtctccaaaggcaggaggacatttaaaaatgcatgggtctctgctaggtgacacatcctgcttaggagtctgctggcctccagtctgggacaacagagcacttcaaataggcacctgtgttcatcgcggtgctttctgtccacacagggccttggtttctgaggctgagagaggataagctaagcaaggggcagaacaggacaccaaccatctccagaccccagtacaacacagatggcaggccaaagagggactgtgtcgtctgattcaagagtacagactacacagccagaataatcggggcctggcttggactctctttaaatattcattcctcatctgtaaaatgagcatatgagtcccacttcaccagactgtaggacatacgtgaaggactctgcagtgtctggaacatatttatggcccctgaaataaacagttattgatgacagagatgaaaagaagaagatccaatggagtaatcttcaaggcctgcttcaagtcttgccttggtaaagctttctattgggcactcatataaagcttatatgacttttttttgtatataacagacatgtatatatgatgactgtctactgggtatggttctgagcactccctaaatagtaactcattgaatcctcacaacaagtttatgtagtatgtactattattatgcccattttacggatgaggaaaataggcatgaggggttaggtgaacgactcgaggtcacacagttataagaggttgagctgggatataaatccagacagtctgcgctagagttcgtgttagttaaagatggatacagtgtgctgctgttattattcttgtagatgttgactattatagtctcttgtcttgcggagcagagctagtctctctcccactttcttgacaaatggtaggggcctcccctataacatctctgaagcccctgcagcacttcatagagccagtcagagtgagtttgctgacccacttgccaggacttgctgtgccctctgccttcttcaaggcatccccagcagagccttaaagggcaaagcctgcacacctccctctgcagcactgctgcatgccccacctccttccagggccacgctttccaacttgtgacctggacccaaagtaagaaatacattttacatcgtgacccacacatacctactatacaagtaattgcaacacaggattcatgaaacaatacctacactattacatggaatgtactttgatatcctgtattttttaacattgattacaactcactaaattgatttcataatccacttagaaaattcctcttaggggagttcagctccaacatctagcacatgcaatttctgagtgcagtgcacagcaattcttcccaaaggcagcccttcctggtgcacatcagcatcatggtgctgtcccagcccagatggtcacttatatattccccagagccctgagcctggctggagcacccaggcagtggaaagtcaatacaggctgggaatcaaggacccattcaaaacaatgctcacagcagacacagagtgaagaggcttgctttagagtatgatagaactgagctcaaatctcacctctgctagttactaactcagatgttattggacgggttcttaacctctgtgagcttcagtgccctcccctggaagggggcactatcaatatgcaccacagagggtgttagctgagatgtggagatgacttggcacagcacccagatacagatactgaatcagtgccagtcagtggtggtgggaggtctttgctaacacctcacaagggccttccctcccctctctttttgtctctatatttagagattctacaaccttcagaagaaatagcagtacttcctagcacataggtaacactcaacaaatgtctgaaccaattaagcaagggcccaggcttttgcccaataagtcatccaatcctgagcatccatccattcatttatttatttatttatttatttatttatttatttatttatttattgagatggagtctcgctctgtcacccaggctggagtgcagtggcatgatctcggctcactgctgcaacctccacctcccacgttcaagcaattctcctgcctcagcttcccgagtagctgggactacaggtgcatgccaccacgcctggctaatttttgtatttttagtagagacagggtttcaccatgttggccaggatggtcttgatctcctgaccttgtaatccacctgcctcggcctcccaaagtgctgggattacaggtgtgagccaccatgcccagctctaagcatccttttgaaggaagatgtgttttataatcccttctaaattcagtggccaataaagtctgctccgtgaattacactcattcaatcacagctgatatctctagatcaaggacaatgcccctctctacaggtgggaagacaaaaccaggaggtcccaatgtggcttctccaaggttcccccaaagttactgtcagtgcagagctggggtgacagagcccctgctcatcactgcctatgttgccttccaagagagaagcaagttgctcaataaatagctcatcaccctaaaaataacgaggtctctgatgagacttagtctctaatgaaactaagcacaggactgagggggtgaagagcaagcagaaaatggatttccaccatgggctagactgttcacgtggcccagtggtggagagaatccttagggaaagcctaactccgaagcccagagaaggaaggaaaactaataaggagtgtgttttgcaggctgatttttctgaagttatccataggaaaattcatttatgtgagaggctaattagtcatgacagtgctttgctccagacataattgcattggtcccatgcagtctctgtgggtcagcctgtaatggaatttccattacctattgtgttttggttactggagaaaaatgtgtgattggggaagaaagagggatgaagagaaaacatgaaaggctggaataccttgaatatccataaaaaccatctgtgattttaaaacttcataaagatgatggatctctaagagccagatagtcttcttggaatctgagctctgtctgcgggaactgctcctggcaggcagtgggttttgaaatccaagtttgtcagaccacagagcaaagcgagctgccccagcttggccactaggggtggaaacaagacccaggaaagggagactaaatgttcttctcaactagccaccagctctcaggctgccaggaatgctgggctgtggtaaatgaatatatagatatatagatatatgggtctggtgccagaaatgtgcaggtctgcagggatgagtatgaaaggcctcacctctcctgccttctagagaataatatacagttcaagagccaaagatgcctgagggtgaactggtatgccaagttcggaagggtcaccaaaccacctaatcccccaagtgttagagccaggaacagaagggggttttaagttcagggtttctcaacctcagcacaattgtcactttggctagatggataaactttttgttgtgggaggctgtcctgtatattgcaggaggtttggcagcatccctggcatctatccagtagctattctcctccattccacccccatccttaattgtgacaactaaaatgtctcccaacatggccaaacgtcccctcgagggcaaaatcgccaccatttgaacatcgctggtctacccttacaattcccaaagtagaattccaaggaatattaatttcataagcttctccccaacacaagtattctatggtcaactaagtttgagaatcactgcatattgtaccctcttttggaaattccccatagtagtctattaaaggccctaaaaagttctgcaataagaagaacactatttaattgttttgtttgacctaacatcttgcaagctttctcaaacaaaacccctttattcctatatttgcatctttcagagttcctgttccaaagaatattgtgatttatatatatgttaatatgtatctatcatatatgtatatatatgatatatcaggcaacccaacctttccattgaacaagaggaactgaagcaataagcaagtcagggttcaaaatcctactaagagatgagtgtcagagccatgcatagaagctgaagtcctgattcccagtctacctccttctcttacacaaatgatttagattaatcctcaagaagatacaagatacaagaaaccatcctctcacagccatgtcacaatttggtttgtgaaaggaaagtaaaatcttgggaccctcaactcactatgccaaaagaaagagtgaactttgtcatgcaaaagctgctttctctttgttcctaaacagattgctgcaagagagaaggtcacctatctccccaggtagcctctctcaccctgacaatgtatcttcacaggtaagggacaaagacaagactagaaatcatccctctgcccacctcaagacaaatgcagatctgacttcttcttcctctactctatgtttactttatcttatgtaaaatacaagatttactgagcaggagccgaatgcactattgagtgtccctctttttgctccttcccactctcctgcctttaaatactgaagttctcaaaaccctctttggaaaaagcacaggccacagagtctactgtagcctttatctctttttcctgggctcatcctcaaccttggcaaaatgaacctctaaattgattgagaactctttcagacatgttttggtttataggctccaccaccaccatccagaatactcacctaggaacaacgcctagtgaaacatcagcatttctgttccccaggagaacagacaaagcaggcactttttgcagacatagttgagaaggacctcacagtggtcataacaagggagggtgcaaggaggcgccatccacttacatcatgtccatgcacctgctaatctactataagtacaactcccatgagaatcactaaagctgattcgtctttgtatcaatgcaatacatctttgtattgtggcgagcacagagtgggcctccattaagttaggtggaaggaataaactgttaggcaacacatgctaaggacttgtccatcaacatgccttgattataattcacagatcgtcaccaacacaataaagcctccccaatcctctctgtcctcttcatgattttcttgggaaatattctaccctggcctctccaggctgcagggaactactccttttaggatggcagctccccgcttccctgacacatctactgtcatctcttcacttgcgccagttcagaaagataaaagatcaatttccagctcagatcagccagcccaatgtccctcctgaagacagtacatcaagggaccagtttcctatcattctaggtagaaaacatgcagtgactggtcattcagtctcttgatggtctctcttgccaaaagcaggcactggagaggccatagattggctcccattctcagattgcaaacaatagaactaatattgacagagaaactggatggtatgacattctacaattttgcatggggattgaaatgtaatcataccttgaggcctctggtattccaggaatcctctttcagccctgggaacagaacagtgtcctagggatttctctaatccttttatgacattctaagcagagtgtatggatgcaggaacagccaagagtctcagccagagggcagacctggggccccctcttggtttaccttggctccagccagtccaaagaatacacaggcagcttgcagaccactgagttgagactaagggctcagccctagggcagctgcaacacaaatgcagcagcaactgctagatatttgcagcatgcccctgaagtctggtctgttgtaaaaaaaaaaaaaaaaaaaaaaaaaaaaaaaaaaggccgggagcggtggctcacgcctgtaatcccaaaactttgggaagccgatgcggatggatcacgaggttaggagattgagactatcctggccaacatggtgaaaccccatctctaaaatataaaaaattagccgggtgtggtggtgcacacctgtagtcccagctactcgggaggttgaggcacgggaatcacttggacccgggaggcagaggttgcagtgagccaagatcgtgccactgcactccagcctggcgacagagcaagactctatctctgaaaaaaaaaaaggctcacagcaaagggtgtggaggttgggatgctcagcttcggggcaggagaagcatacagcaagcctctcacacctgcaggactccaggctcccagagccacagctgcactctacctctctcctttcctttccccttctgagcaccttcgggttactgggataaagtagtgcttaatgagaggccaaagggactttgcctccttgaggctttttgattgctttgcacaaaactcatagaatcaccttatgttccttcacttaatcagtcacttatgagcactattctaggcactgcgtgaggctgggaaggccctgctcacctgttactcttactctgttatgctcttcgtaaaatccatcaaaaacaagcagtcatcctgcttctcttatttccccatttcacaactgtggaacccaagtacagccatccagtgtcagactcatgaacttcagaagcagaagcctgaagatgagctttggagtcactgtcacagcaacaagccaactggcatgcagaaatgaagagactcactcaaatgagggacctaaatcccttctatggtcaatgagaaacagaggcccatgaaagggaaaggccagatacaccctcacacaaggaagtggtggcagagccaggcccagacagcagagatctcaaaggtccccattttcaatgttgtgtttcttccatactgtcatttcaaaagagccatttaaggctgggacactctggtcccactcaaaaaaaacaacaacaaatcattaaactttcaacttttaaaaaactaccaaacaggttgcaaaacactttcttatcctacacctgggcgagagagacttacagagggggaaggggcagggagggaagaaggagagggtcatgaatggtgagggggaagggactgagtgagggtggaagtgttcatgattgggatggagtagagattagggagccttgaacctccctgaaggtgagaaaagatcacggatatctgttcatgaatttaaaaagactccgcaacttcatattcagagaggagcaggactcaggaatcaggcaatggtcatgaggtaagtttcaatttttcaaaacaaaggtgatttcatttttaaaaatttgttgtttatttgtcaagagaaactatttatttttatttttattttgagacagagtctcactctgttacccaggctggagtgcaatgctatgatctccgctcactgcaacatccacctcccgggttcaagcaattctcacgcctcagcctcccgagtagctgggactacaggtgcacaccaccacatctggctaatttttgtatttttagtagagacagggtttcaccatgttggtcaggctggtcttgaacttctggcctcaagtgatctgcccaccttggcctcccaaaattctgggattacaggcatgagccactgtgcccagccttaagaaaaactatttcttaagccacatattcatgttttatagttcaagaacacaggtcagtgacaaatctctaggtaattcttcccaaaggaatactttatattccaaaatcactttgcactctgaaagatacctcatctcctcaaaatctttcatagaatcataatttctgtagaatccgtgtatgccttcttttttagttcagccacagcaaagttacagagggttgcaacccccagggaaataacaaatgcgccaacaatatgaaatcacagatgctcagccagaaggccatgtatctgaggttttgtcaaagcaccggaagccacagtagttattatgctcaaaaggtatgtcagcctcaacaccagcatccttcctggctgatcgatttcattttttgacagatgagtttgacaccgccaatcagtggcaccaagggactgtatcataatatcctaatggtcccgaggctgattcccacgccacaagggtaactgcaattccatcaagccacagccaaatacagaatgcctcccatttaggaagctcagttaaactttttatgtcaccaacacgccccaacctcagagttgtcccttcctcactcaacacacgggacatttatcttcaacgtcaccacctagcttcaagcttccttcggcttccccaaccacagtccccactaactacaagctcaggccagcgctacagcctgctgaccactggcaaggggccttggcacatctagacatctgcagccaggcctgcctctcaccttctaggctattttctctgtagaagaacaaactgcttgaaaatcagactgcaccagaacaggcattcttcctgctgctgtggaagtgtgtctcgttcctgtggaaaggaggtatcttgttctggacagtgtgggctggagctgctggcggtcagaacagggaagatcgtgttcaggaagaacaccatccctgagagaaccagtctcccgacacacatctcaaggccagcctgcaccagctcaaccctctcctaagcgagaggctcccctattagcgtgatgcatgtcttggaccattatggattgacatacattcttttgtatgaagatattcaatgctgcacatggcatctctcacgacaggacccccgaacccagaacacagctgctgaggaacaggtgctccatcaatacgggtgaaatagatgaatacgtccaagtgccggtgtcgagcactggaaatacaaggacgataaagacaccacccctgcctccaaggagttttttggctagtgggagattcccccttgttatttgtcactggtggggtcagaaatggagtcaaggtcagcgggttttggactaatctagaagaaggactggatcagtgcttcttaaatgtgttattcacatactcccatcacaacttctgccctagctgcatgactcctatgctattcactaaacatttttctttcaatggagtcaaattttttaactaaacaaagatatcttttttggggagagagtctcactctgcctcctaggatggagggcagtggtgtgatcataactcactgcaggctcaacctcccacttcagcctcctgaaaagctgggactacaggcatgtgctaccacacctggctattttttttttaattttttgtagagatggtgtctccctctgttgcctaggctggcctcaaactcctaggctcaagcgatcttcccgcctcagcctcccaaagtgctgagattacagcaatgagccactgcacccagcttaaataaatatatcttaaggatactccgtaacattaccacatgtgaaaaactggtatcaccagtgaagaaatagaagataaccttcaaaataaacaaaatagaagaaaactttcaaaataaatgcaaaacaaaaccagggtatgaaattctaggtagatgcctccgtttgcatgcagtctcaatgggggctgttctgtgcctttgttcaaaagggagacaggcaagggttaagagatgttcaaacagtaaaccgagactttctccctgagataactagaaagactggaagaaaactggaaatgaactaaatccctccttggtgactcagggtcctgtccatatatcactagaaggtatctgctacaccacctgtggtgtggggaaaccataaagctgaaatgagctttaacatttctttcaacatccaggtcctataacaccataagcagattatttaatgtcaaagaaatcaagcgcatggaagaaagacagcacctaaacaacacaggtctgttgactgaattagatttccaaagtttctggccctcccagattcattatatcctatggtcttcgggttacaaatgaggacagaaaagcagagagagaggagggaatgtacccaacccatccacctggcagtgacagagctcagaggtcttcattttggatgaaccatgggacccagatgcctatgaaaggggaggacttgtaatctttttattcccgatcttagactacctgtgtgtgcaatatgtgtttccaccactttgtgaagttcagccaaatggcccttaagaaatgaaggcaatgacttggtggaggccctgcacgtagagaacgtcagaaaaggctgaattggatccccagatgttcctaagacctgctgggggaagcttgcacaagtctggtccaaaatccgtttgtaaggaaattggtgaaaatcacagcaaagctggccttcacaggccacatacccaggccctgctctcaagcaacatcaggcttggatagatttttccagaaccccagatagagctgggctaacttaacaggttgaattcaaggcgtaccaaactttaaaactggaattggagttgactatttatattacaagaagattcttcactctccaaaagcaaccctttgtcgtctgagcacccctaaagacttaagtgtttgttaacagattactaaccatttggcaggagtgcaagcactaaagaaaacttgcagagaaaggaaggggagggaactggaatctctgcaccattggttcgccaagctttgtgctacatgcttcacttacagtatctcatttaactaatcctcccagcagggttaagaatctccattatacagaaaaggaaacagcacagagaagtgaagtaatttggccaaggtcacacaggtactacagcactagaagcaggggctgtttccagcagcacatgacatggaacttcctaaggaagtgccatttgcattttgttatcaccatctactaaaacatacccctctggcacacagtgcaataactatttattgacatgaatatacataaatgctaagaatgccatacacagtaaagatgaccatatggagcttaaaatttattacaggtcagaggtatcaaaagaaaattatctgaatatgccaggctagcaagggaggggattcttggtgcctaaagtcctactattccagtcttctttctttacacacacacacacacacacacacacacacacacacacactccttcagccaaaatgttccactttagtggagggaaaagagagcctggagccataagtctagcttattgctgatgcctggtgttccccactctgcctcccaggatctggaatttatcttgaccaccagacagagcacagaactccattacctagggtgggccagggctgccacggagcagcattgtgtggctgtaccctccagaaactctggatgtaagatggaaggattgtagtacctggtggacaataggtgggaaaggatggagggtaaagaaaagcacaagacagggagaaaaaggaaggggagagtgggaggatgggaggcaggaagttcggttaaaatatactgtcagtggcaccggataaaaataatagccttttctgtgattgaaagcatttctaaaaatcaaagataggaacagctgctgtgctatggtggtgggattatgactgcttttgtaaatgtcttttaatgttcttatatagttttacagcaggtaaaattttggagcagaaagatataaaaacattcatggatagaaaattcagaacaagtcaccaaggggaacttggtttgtgataattttataaaacagtgttacatacattcctaacctatccccaggccccctgagagccacaaccaagacccattggaccaagcttctgaatttcacagagcttaatgggcttctgatggcaggggctagtcacccacaaagagaggccacaacatacagaggcaggaggcctgcaccggggccaggaccatgctctgtggacaaaatagatgatttcaggcaaatcccttacctggctgactcgggtcgtcttccttaaagtaagaggctgcatgcgatcaggagtgacaaactcaaatgctttaaagagttaggctgggatcacagaactgaatgggccatcagagcctatggtggcctggaaatcacacacccggaggccaagggtgcagctgctacccagacctaggtgaatgctgggccccatgctgccagtgtagagaagttgggaatctatacttttttaaatgtttggtttaattttaattttttttgtttttagagatgggatcccactgtgttgcctagagtgaagtggtgcaatcatagctcactacagctttagactcctgggctcaaagtgatcctcccgcctcagcctcccaagttgctaggactagaagcatgggccgccacaccagaagaaaactagactttcatgtgggctctaatttttctgttggcatccagtttctaaaaaacgtagtaccaagcacagtgcctgaatctgtaattccaacactttgggaggccaaggcgggcagatcacctgaggtcaggagttcgagaccagcctcaattaggagaaaccccgtctctactaaaaatacaaaattagccgggcgtggtggtgcatgcctataatcccagctacttgggaagctgaggcaggagaattgcttgaacctgggaggcagaggctgcagtgagccgagattgtgtcattgcactccagcctgggcaacaagagcgaaactctgtctcaaaaaaaaaaaaaaacaaagaagtacttcaaatgtattatctcactactctatgatatgttgtaagattggccccatttttacaaatgaggaaactgaggctcagagacattaagtaatttgcccaaggtaacacagctaaaaaggggcagagccaggattggctactacaaagtccttattccttctctccacaacattttattaagaaaatttcaaacaaggccgagtgtagtggcccaggtggctcatgcctgtaatcccagcactttgggaggccaagacgggtggatcacctgaggtcaggagttcaagaccagcctgaccaacatggtgaaaccccatctccactaaaaatacaaaaattagccggggtgatggtgcatgcctgtggtcccagctactcgggaggctgaaacaggagaatgacttgaacccgggaggccgaggccgagcccagatcatgccactgcactccagcctgggcgacagagcgagactctctcaaaaaaagaaagaaaagaaaagagaagagaagagaagagaagagaagagaagagaagagaagagaagagaagagaagagaaaagagaagagaagaaaagaaaagagaagagaagattccaaacatacaacaggttgaaaggatttcacagacaatacctgtatcccatcacctagattataccataaacattaaattttactgtattgctctatcacaaatctatccaaagattgtctcctttggttccatctgaaaagcaacctagaaagtacgttagaggtggagcccagatgttgccatttctgaattagaaataatttggcctcttctgaaacccactcatcccattccctttgtggctggggagtatgggggtgggaagggggcaggcaggaaggagagtgttgatccaggaacatctgcacacatcatcacaacacacatcccaaccagctctgatttctcccctggctcaaagcagggagagatgggtatttgggaaaagctcaccaccccaaaatatctccctaaaccctgaaggctaagtcaacccatgggctctctgaaagtggccaggggacagcaggagaggcagtactcggaaaagggcagcggtacctatcttcggagccctttcacctgctccagtgggattttattctcactctgtggccctgatacctcctgtgtcttttagctgcattcgtgggatgggagggttgtcagggaggtttcccacctggggcctcttcgtacacctcaaggggataccatgcccacagaatgcaatgtgaatggtcctcctggagtcctgcagagtggtggcaatcttcaagtccatctgattcatgcaaaagttgttcgagcataaacagcagctttctccagtgtcccacgcacagtaaagaccctgcaagagggctgcctatgaaaggccttggggccagggcgggggctgggagtgctggactctcaattctgacaccatagcttctccaccacttcttgctatgtgaccttaagaaaccttcctatcctctctgggtcagagctttacaaatgacgccacaccaaaggaaaaaaaacaagcaaattctggccatctcctatgttcaagacagtgggccagatgctgggtggaggggaaagaggcatactaaggagctcagcagatacctcagagccctggtctaagcgctttgcacgtttttaatactgacatcaactctacaaggtgggtgtgacttttatccacattctataggtgagaaaactcaggaggagagaaattaaaactttcctaaggccacagggttaagtaagaggcagagcaagggtgaaacatgggcaacagtttcagaagcctgcacaggtgaccaccacaaaacgctgcttgctagagaagcccaagaccccctctctgacctccaggaagactcggtccaggggagggagcaagacaaaagtgaagatttaaatgctgataaaatatttaaataattctttgagataatagtgggaaagatgctgccagggagaacatgattaattgtcaaatgaaagtgttcagacaaaattgctctaacggtccagaaaaggggaggaaaaaaacccctctaccgtgagctcattctgagttggaggaagcctgggaggttaaatgtcactggcttttgcagagtgagcaggacttgaacaggagagagtagggcagaaagcattccagcaagaatcaaaattctttttttgtttttgtttttgtttttgagacagagtctcattctgtcgcccaggctggagtgcagtggcacgatcttggctcactgcaagctccgcctcccgggttcacgccattctcctgcctcagccctccgagtggctgggactgcaggcgccagccaccatgcctggctaattttttctgtttttttttcagtagagacggggtttcaccgtgttggccagggtggtctcgatctcctgacctcgtgatccaccttccttgacctcccaaagtgctgggattacaggcgtgagccaccgcgcccggccaagaatcaaaattcaaagggccagctctcatgtttggaaaggtgaagggccctgaacgactgaagatggctcaggggtgcaggaagggtgagctgaggctgggtctgaactttgccttataagtaatagggagtcatagaggaatttcagtagagtagaggagcatcatgacccaaatgtctgctgatgacacactggatacactaggggtgcagggagaaaattaataaattccccaaagtgttggccaaggagtccttgggtcttgacagaggaaagcaagaagttaaggtcatgatactcctcagagactgaccaaagaaggaagaagggggatacttcagctggaagtcttcagctgggttccatcctaaggactttagaatttggcactctgcgtcatcagggaagcaagtaaatatgatccaaagtccccccaccccctcgcagggttatatccagagaacagaattttttaatgctatttttaatctttctgttgaccaaaaacacactgagaagaaatgaagcatgaacatcaacaagaggctctacaaactctctcccctctcttccctcctgttaaccactctgcgaccctgcagactcaccatatggtccaccagctagatggccccttctgatcctggaagggctgatccgcttaattatttggcagctataaatagaagcattggacaatagcctgagatcttttttttttcttctttttttggtcttgcaaacaaagagagggtccctagttggcaggattggagagtaggatttcactccctccctccaggccattgtcttccacctgagccaccacagcctcagggcggcttcagaactgtcctggatgagctagggacagccctgtctcaactgcgccagcaaggagatgtgctggggtcactcacagttcttagagtcagggtgggttttaggaaagagatcacccaggagactcgaaaggtccgtttgctttaggcatgtccttgcctatggggccaagacctcactctagccacccacagcttttcctaccttaccactcactgcacccacattcagccttcactctcacccccaccccattcccaggcgagagcagccacctggaggaatggactcctctggatccagagccaggaggtgagcagagcaaatgttcccagtgcctgcaggaggaagccaggcacccagggttccccttgccacctagacccccgccacctccccatctaggatgggctttctctactccacacataagcactctcctgccccagctcctaagctgttctccctacccctaatcttagcagggacctggcatggaagtcagatgagcctggcttggcctcttgggtctgctactttactagttgtaagatcatgggcaagaggtttcattgctcagtgcctcagcttccccacctgtacaatgggcacaataacgatactgacctctagggactgcttatgaggacctatcgagagagcaggtaaaggttgtcatctagagcctggcacacagcaagtgcttgctaaggggtgttactggcagcttttctctgagtccaactcccatcacctatatgcatgggactcagcacacatttgctaagttgttggtttctccacgctcccctcctcctccttcacacccaagaggaatgaccaggtggccacaggagtcagcatgtttgactttggtacctggggctcctgaccatccagtgtgaatccaaacgcatttccctgactgtctgacacctgctgtttaatctccatcaccttccctcctcctacctggctcagggtccctcactccgcataggtggccaaggtgtgggggagagccctccttcctaatgcttgtttgttttttcgctcatgtgtttgctcagagacaggataccatggtgacacccacgatccagggtggctgggtacacacacatagacagggaaatcaagtgaaagaaaaagcccatgggggccaccatcatcccacgaggggccagactggctcccaaaagagggggaaaggctgtccctcccaggggcctacatatgttttcccaatggaaagcttttctcagtggtcccggcaggcttccaggacactcctgcaggccagggactggtttctgtttgtctagaagccctgcattcatggtctagcatagccaccaacctccttgagatccatcactatccccccatcatgggcatctgcagagcattcatgggttgtggtcatgacttggaaaattattcttaggctgggagtatggctggactaggcttcacagagaacacggagggcagggtgagacgctgccagttggagagaatggcagcccctcatgaagttcagagaccccagcacacgaggaatctaccctgcctggcactgcattggctctcgtggaacatggagggagtgggctttggaatcagaggccagggatcaattcctagctgtgccacttcctagctaggtcaactgtgctgtttcctttaacctttctgagccaaattatttctaattcagaaatggcaacatctgagctccacctctaaagtgctttctaggttgcttttcaaatggaaccaaaggagacaatctttggatagatttgtgataaagaaatactgaatgctaaaatgaaaataaaaatatcttctgcagaaataagacctagagtttgatagatcagtagggtgactatagtttagaaaatattatatatttcaaagtagctagaagagaataattcaaaggtttctagcataaagacaaatatttaatatgatagatatcccaataaccctgatttgacctttacaaattatatgactatattaaatatcacatgtacatatgtacatttattatttatcagtaaaaataaaattaaaattataaaagggagagagacttcctgcatatgaaatagagattacaaatcctttctaagtacacatgggatactgacctgtatgctaagtcattaaaaaaagaaatccttctgcaaaggaccgttttgagactatgaggctctaatttagaaaggtgacaagcacattgcaggaccttacttaatagggctggggcttgccagcatacaaaattactgcagtgacttgttcagactcctgcactgggaaaagacttagtccagagacttacccaatgttttgccatagtaaattctccaaggatgaagaaaggaggaggagagaaagagaacttttctctgtcttcttcaaaagctgtagcagccagatgaagtacggtgtaggtggccaagcagccagatccctaaatagcaactaatgactttgattgaaattaataatgaaacgacacctgttagctcacttgtagccactttagtttgtcacatggcaattatattcactatcctatcagctggtccatgagctgtaaaatgctataatgccatgccatatgcctctcttgtctcccatgttgagacgggggctgtcctcagggtggttatcaattccaggcctcctaaccactctggagattgtcctgggaacttccccggcattcaaaaagacttgaggaccaccagccccagtgaacctgctgagtcccagggagcagctgggcagcctctttgaaggtggattcccccaccgagcaagaggaaaaacacacccaagagttaccgagtcccttctgtggttgggtccttgaaaagccttgttgggtgatagagggaattctccacttgagcagtgaacaacagtgtcaccatccacattatctccccagacagaggcaggacataaagaactaaacaggcccccagcaggccatgagatttggtttctatagcaacccaactgaggttgcatgagtgcctatgagatagatgcccaaggctcaccccagacagggccagaattccagaatcccaacggcaaggaccacccagcagcgtttagagatggaaagcaaggtttgttcatgttcagaaaaacccagggaagccacaggaaaaaaatggggctaggatccccactttctataaggcaagctccaagactatctggcagcccaaagctggcatgcagagctgaggcaggccccacaggtgagctgagccacgctggggattttaacagaaaataatcctccatccacctctgcatcgtccatattctctctctctctctctcacacgcacatacacagacacacacacacacacacacacacacacacatatgaaaaataaaaaaaatcttgcaattattcaaaagaaactatggttgatttgttgatcagaaaaatatcaatgaatgaccaattgcaacaaggtccaaggtcctttaatgaaagtttctaattaaccctacctttgaacacttctattactctatctgtagagtaattgttattttagcgatgcaatgtttcctaataagaccaagcattgggagaaagggaggaagggagggacctgaaacccaaacccagccccaggtacaagctagcacaattagcagccagtgtactggcttctcgaatgctgatatggaatagctcaggaaactcaatcccaccagggacctgcttactgtccacagatgtcatcacagtcatcggtcaagctgagagaggctagcgcaaacaggcgatggggccgctctatctctcctcctccatcaaatcacaaaatgccatgacaacacccaagccagggcctctgaggacacatgaaaggaaatccaacttcatgcaacagggactcaaggtatggcccttttcggccaaaaggcagtgtgggctggagagagagataaacacaagaggctggaaacacagacagggtgagtgggaaagcttagaaggcacttagcaggtaaggctggcatcgggagggagctggctggaccctaatccctgaaacctctctccctgaaacctctcttcaaagagatctacactttctaaatcctgcctccatgagatgaaacttctgttcggtgtcccactcttacagcccctgattcccccagggcctagctaaggaggcccttggaccaccagtgaaactaaacagagtcactgcctatgaagtcccttcagtctggagctgtctgaggaaacagataagccatccaggccaaagaccagcctttcaccatctgaggggctattagatgcccagcaaatatgggttgcctagctggtagcttctggcccagatgccagtccaagagctagagtggcctctccaagcttgggagttagggaagctgtacccagatccttggcacccaccccaaaagagcccatgaagagaaatgaatgaaagggcccagggagattctcaaggccccggtcagccgccctagaagtcacctcaatcttagtcaaggatgagctgagccttgaaaatccatactctgtgcaagaagatgcagataatctgcccagttgcccaaggcaataacttggaggacaaccaacaaaggccaatgggggtcacttgggaagacacatccctaagttgacctgacttccttagagtgggcaggaaagacaggcttcagaagatagctagaaagtaacaccagagaaggtcaccctagaggtggcccctggccatttctcaaggtgacagcctctctgcccaggcgtccacactgcaatgttttccatattggcacttccttacaaagtcctctctttctacctccatacctttgttcacactgttttgcttagctggcaagttcttcctgctcctctctgcctaccaaagccccacttgcccttcagggtcaggtcaaactcaagctcctcatcaagctctgcatgccatggagatgtgctgcccccaacctcacctcgaagaaggacttgaggcccagcttcagggagacggctttgcaaacagcccccagctgtcggttccttcaggctcagcctcagctacagcttcagccaaggtcacccttcctgggacagcctgcatctggtgacagagtgaggtggggtacagaagcacagcaatttgggcccaaagggatcatctctgttggataaatccactccagagttgtctgctgggttggccgaggttttgtggaagctgcatcagctctcgacttgtccctcttgtcactctggcctctgcctctcccttctcagaggtggattcctaataaacatcatgagctcaaactggtctccaccagtacccatctcccaccagaaattcaatcaatggtcattattattatagcccatgtttctgccacaaaaggtgctcaataaacctttgataaacacatgagataatttagcatttctacttgctgacggagctcttgcagagcctgccactctttcaggcacactcacagcagctgctgatcaggtagaccaaatgacatgaggccaatgaaataaatatgccatcacaagagcatggcttcctctggctccctaggaatcacacagcatgctggctcctgaagaacacacaaggagatgcctcacctgagaggttttggatcctgggatcaagaacaggggctcattggtacctctgtgtccatcctaaatgatggctcacttaagaagtgatggaaggtcagctttagtgacaccttctcatcagcaatgctgctactaggtgccaacagcatctctcaccacggcactttaatcaggatggcatgacaccactgtaaatattaaaaaggttataattagagacgcagttaaaacaaccgagggcttagtgttactaaagatatttgcagaatctggtgcaatataaatagcagggtttacggtgtcatgcctaaaattttgagcaggctgatgttccaaggggatgttcagtgaatgcccatccaagctgggatttctctcaactgattgttttctctccagtgtcagagttctcagaaatagatatccagagtgtgcccattctcataaaggggtgaaaagaccttgctactcaaaaagtaggacaaccttgcaccaggacacccgttgaagctcggtggggcagctgcagcccctcaagctgctagaaacactgtctcctgcatggagaggtcacagccttgtgattccatcggctccaaatttaaagcaatcttgcagaaaagggccaacatttatcagaatgaggaaattgttttctagggtgatatcaactggagtctgctgggtacacatgacacagagaacaggcaatcaacctaccaacaaagacgataattgtcacagtgcctgccaccggccaggcctctgcacacattcactttttcctcaccacaatcttacaaggctattgttgacatagtcactttacatatgagacaatcaagactcgcaacatcataaaactgatcagcagcgacatctaaatttgaattcaggtctgtccaattccagggttctttcagatgtgagaagggaggttcagaaagggcccctttttcttctccctccgtgtacttctgtattatttgaaatttttatcaatagtatattttcttgtattactttttaaatcttcaaatcatcaaaaagaatttatgggcaagagaaatggtcctatttctgttgaaaatgtatcttaatttgatgtaacaaaatactactaacaggccgggtgcagtgctcatgcctgtaatcccagcactttgggaggccaaggcgggcagattacgaggtcaggagatcgagaccagccagactaacatggtgaaaccccgtctctactaaaaatacaaaaattagccaggcgtagtggtgcatgcctgtaatcccagctactcatgaggctgatgcaggagaatcgcttgaatccaggaggtggaggttgcagtgagccgagatcgcatcactgcactccagcctgggcaacagagcaagactccgaaaaaaaaaaaaaattacaaacagccattgaaataaaaaaaaatctgttctttgctacaataatttcatttctggaaacctatcctgaaaaaaataagcagagacaccaaattatattaaataaaaaagctgcctttattttgaagtgttacctttaataagaaataaactggcaagaaactcgacacccaacaacagaaaataaagactggatatcctcatgataaactagggtgatgctattaaaaatagttttgaaatgtcagcaaccacaaggggaaatgctcattacatgtttctaggtttaagaatcaataaataaactaagtattcacacatgtaaatgctggtatatgcatccctcccaggacccacaggcatacaaaggaatttagaaagagtagacatctttggagagaggtttccaggattagggtgggtggggtagggtgggcagaaaacttttacttttcattttatatttttataagttatttcaatgtttaccatatgtgttacttttatttcatttcactttttcaattttttttttaatttttaattttttttttttttttgagacggagtctcactttgtcgcccaggctggagtgcagtggcgggatgtcagcccactgcaagctccacctcccgggttcacaccattctcctgcctcagcctcccgagtagctgggactacaggcacccaccaccatgcccagctaattttttgtatttttagtagagacggggtttcactgtgttagccaggatggtcttgatctcctgacctcatgatccacctgcctcggcctcccaaagtgctgggattacaggtgtgagccaccacgcctggcctatttatttatttttaatttaaaatagagaatgtgtctcactctgtcacccaggctagagtgcagtggtgcaatcacagcccactgcagcctccaactcctgggctcaagtggtcctccaccatgcctggctttattattcatttatttatttatttgagacacagtgcagtggcacgatcttggctcacttcaacctttgtctcccaggttcaagtgattctcctaattcagtctcccgagtagctgggattacaggtgcccgctaccatgcctggctaacttttgcatttttagtagagatggggttttgccatgttggccaggttggtctcgaactcctgccctgaggtgatccacctgcctcggcctcccaaagtgctgggagtacaggcgtgagccgctgtacccagatttattttttaaactaagtatattttaaagctttacatatattatgtatattaaccaatatacatattaacatttatatatattaaccaatctaagttttcagaataacatttcattatataataataaaatacacccaaatgtgatttctgcattgcagaattacagacattgctttctctttataatttttctgtatttgccaagttttctcccataaaagcataattttattatcataaaaagcctccttttcaaaactttaaggtatctcactagtaagaggatatactttctctaataagagtttgggtttcaccaccagtcatgtccagcctcagacccacccaaagagtcatactatcatgagtacaggggatagaagggccccatgagactcattccaggaggttaccaaagtagtagacctgaaatggtttggctctgtgtccccactcaaatctcctcttgaattgtaataattcccatgtgttgtaggagggacccagtcaggggtaacagaatgatgggggcatgtttttcccatactgttctcattatagtgaataggtctcatgagatctgatggttttattaaggggagttcccctgcacatgccttcttacctgctgccatgtaagatgtgactttgctcctcatttaccttctgccatgattgtgaggcttccccagccatgtggaactgtgagtccattaaacctctttcctttggaaactacccagtctcaggtatgtctttactagcagcatgagaacagaataatacaagacacaagccctactggcttagcctagagcctcagctgaagccacagccctcagccctggacccctgagatacaagaggagcctgaccagtgacatcccggaattaaacagggggagaatcttcctcttattgtcatcctgagcaatacactagacaaaggccatcgggcagataaaaagaggaaccctgtgcccctgaagttgatctgaccaccagcgagaggtcacatctgctatgtgcaatgccctgcaggggtcacaaagatgacttcaacctcgaccctgtcttcaaaggagagtccagtccaggcgagtaggtgagaaggcatgtaccaactcaaatcccaggtagaaagtgagcagagcccgaactacagaggtatgaatacagggcaattgaagttcagaggacgaaagctcgcttccagcctagggtgcaaggacagcttccaaaggaggtgattcacaaactgagtttgaagtctaggtgtattcaaatacaggccaagtgtgcccctgcccaggagtaggcagtctatgcaacatgtgaatcacatgttcaagcacctgcctcacctgttttatgggcaagtctgccagctacagtcctatcagggcacctatatttctaaggacctggatgcctggatgttttttctccccagggcatatatctcaattacaaacctgcaggaaacaaaaagtttgtggagagtcacaaaacatatttgaaatgtataagactttcaccacaggaaactaggcctaacaagtattttcctgtggaacacccctggctttgatgaaactccccattcaatgtctctttcctcctgcaaactttgctaatagcagtgaaaataaaagcacagatcctatatttacttaatgatcttggctgctttagacatgagatagcattccaagagagcaaagtgctttttaacaaaattcaacaagaccctgccctttcccccgccctcccacctggcctctggaaggaggaaggaatttctcattctctgatcttttcgcctgccatgacccccagggcaatccagacagtaagactggccatgcctcctggtcatgtcccatacctcatgtcctcatgtgagaccccagatgggggagatgatcacatttgagttacatttgaggcggagattcaggtgggggcccaaaacatggctgacatccagccagcattctttgctagatggagctgggaatggggggttaacttttgtgaaagtttattagagaataaagtaagtgagttaattaaattggagtgtgaaagacatttgggtggtgatgaggaggcgaggtgatgatttatttataattgacaaggttgcatctagctactgggatagtaattatacactttataaatgcgcaaaaaaagtcctttcatgcgatggaggtttaagggaaaatcctgtcagggaagtttctgtctgcccatgagtatgacaccacctcaagagctgttggccacttggcttctgccaaccacagctgtaagttggggactgaataatctctaaatacccttctaaaaatgaggccttttctgggaatcagtacttagcctccatctgcttctgatgatgttttcttatctcaattcagggacaaagagggatcctttatcttgtgtctgattctttgtttttgttttactgattcatattcaagttccagctcttggatcctccctaatcaagatgataagaaagatgctgcccaatgcggcatctcatttaagggtgagcagatgtgaattcagaccctaaatttgggaaagttccttaatctcatctggaaaacagggatgggggtacctagctgacggggttgctataaggacagaacctggtgtaaaggcaagcctggtacccagttaacactcattatcatgcaccttaggttaagtcatggtaaaggaaacgtttcaggttaacttcagtcccttgataactggggattccagcctgacctgtttgcatagagtctagcttggcccctgtgaccagcatttgcctctctaagggctcctaagcactcagttttaaaatccaatcaagagtatttccagagataagccacgacatcattagaatacagattacagcatccatcttctgacacccactgagaaattctaacaagcacaagaagttccagaatgctagaggtaaaaaataaataaatataaataaataaataaataaataaataatcttatctcaccattcaaagattctccaaagaagtagcatggactagatctctcctcccacctgaaacaactaaaaattcagacaagacaatgattttcagacactggagctcagtcaggggaagacagcaatccctgagagaggagaaacgaagtgagccctacagttgcctcaacttcctgtctggagagagcgtccaagtcacagcagaaagaaggaggaccccagcagggcccagatgtctccctgagttgaggagatgaaggctggattccagcaaggccaaggaggctggaattcacaggccagggcagcaaaaagaactgcccagtgaatacttgaggtcagcagagggacccccttgagtctttagctaagtattggtggacacaggcatgtgtgaaagctatccaaggtgggggagagaaacaccctaaaggagcagacagaacatttcccagagtttatacagggctgggaacggttcaccttcccaccagccagagtggaaacctcaagctcacagagcacctggtagagtactgagaatagcagcgtctctgtagtgggaaaaaattagccctagattaagagagctctggttccacctaataaagctcaaaggcaagacccaaaaaagatcaaactgtttccatacaacttgatcatgtcccagaaaataagctcaagaatgttttataggagtactaagatatccagcaaccaacaaggtaaaattcacaatgtctggtatccaatcaaaaactaccaggcattcaaaaaggcaaaaaaattgaacccataatgaaaaaatagtccatcaaaagactccccacttctgcaaccacatctacagtgtatttcaggacccagccatagagcccctctggtcctagaaatgcatttcaaagtgcctctctagctctgtgcaagagattttctctttttcattctaaagacagtaatcctaggtagaaacaagagagagaaaaaaaacagaaatgctcactttctagtttgtttctctgtttgctaacagtgtcacatttcccaagcagtgatactctcccatctcgttcatcttctaattctctgcctataattttacaaatgtctgtggctatctttagcagttttcaccagttttgtgttttagccacctgaccccctttcactctaccctaagttagatgactcctcattcctcattcataaagttctgtctgttaaacctagagttgatcagcgatcacgatacacgaacatgctctcttcttcagatgccctcacattttccttctttacttggggattaacaatttaatttttaattagtggagcatactcaaaatgtcatggttgcagccttccatcactcttgggctatattctctcttaaggtcttcatatggactgctgtctaaaacaatctagaagagcaagaaatccaaaaatgggcccaagtatcctagggctgtggatccaaggcatccatccaatgtgaactagataaactgcagtctgtctgcaccattgatctttctgagatgagggcacctgaaagagtgggccaagccactagaaccctggaccctccaccacaggtaccttgtggcagttggctttaacttcctccctatccttgccatattaatcttcattccctgtagtcataaagttctagaagaatatatcagctttgatctctttcagttattcatgcattctttcatttaagtaaacagatatttactgagtacctaccatgtgcttggcaatactttccaatcttcagaaccgggctctcacaccaagcccaagcacaggcagctacccttactcctactcaaaaatgtgaagaggctgaggcttctaaaatagaaaaagtcaccagctcagggtcaaataattaatggaactcgaacccaggactcctagacccaagcctctcctggccaagtctcattcactgcaatcacaggtccagcctggtcacgatgatgagtgggactgtaccctgccctccctgcccagcccattctaggcttcctcagaattccctactttgagtgctcctttgccatgtgaggctcagtgatttccttctccgagtccactcacatttgataggctcctatgaaatgtaggtgagcttcacctgaatctgcacctgtcctcattgctaaggtgatgagctagtgtcaagaaaggctgagggatccaaggatgaactcaggcagggcttgaggccactactcccggttcccctcctctcttccccatgaatcaccttcaaggacacttccatcaaacctgactcacacagaaggcccagacctgagaaatgaccagcccctgggccagagcagagagccagaaggcaattccctcccccatcactgctgcactgggtggaaattgggtcagagctggccagcccattcatttaatccaaacgccccctttccattcagctcttagtcctcagagctttcagtccaaggaagcactatttcctctgcaaaataaacaaaataaattaagcccatgctctttgatctcagggcttttgtgtggctgatgaattgaacagaaatgatctgccatcctcctggcatctcaaagacactgcaaaaattcagctgtagcttccagccacctgccaggcactgtgctgacaaggaagcatggctaaggaaggcactctttgccacccattctcccagggaagcaagaagagtctgcaggaggcacgacaggggaagtcaaaagagtcaaagactgtgaggcaggattcgtctttggccacataggcatggattcttcttcctctgctcattcccaccccagggactttgcactggcttttgtccccatgtggcatactttctctggagaccttggaaagctggctccttctcatccttctcatgtcagcttgcacaggacctccggagagaaacctttcccatcaaaagtagcccccagactctacccgcatcactgtctgccagccccctactctattatctccacacttatcataatcagaaatgaccttgttgctgcatttgttctcttgtttgttttctgtttccacttctacctccgtgacagcagggacatcatctatcttgatcagtgccatatccccggcagttagcaaaacgtctggcatatggcaggtgcaaggcaaatgtttgctgaaggagggaggctgcatggaggagactgggccctctttccagtgccagctctgcctgcatcgagcactatgtggcgcatctagaccaggatccacatccatggtgtggtttccccaggctgcagaagtgcactgtggaagcaggtctgtgtgcttgagatcagggaaagctgaccaagaagatgggacacagttgattctggagaggcagggaacagacaggggactctcctaacaggctggatcttccaggacagttgaaggacaacatccagtaggaccctagaccaagagtatagacactgtcgctatgggtgtttctctgagccctgagacttcccatgtttaagataagctggttggattactggttattgattatgttgaatcttttggtggcacagaccaacttgagaatctgaagatatcaactttctttctggagaaatgcatgtgcttacatagagacaaaatatgcctgcacttcctagaagggcaaggacccctccgaagttcattcacagccccaggatgacagcctctcacttaaaggctcttgggccgccctgctagtcattggcctgcttgctctgagacccagtctttacccctcgtctgtagactgtggactacactccccaggctccctcgctctttcttctagggaagtttgttctattcagcaggaatgcaggcagaagtctgcagggtgggggcaggcagaaaccaggacatttctccctccttctgcatttggtggcatctccagatagagaacatgtccatcattatatctatcacctctgggtatcctgccctccccagagtcctttcctctgtgatcctgcccagcccagcaggccttctgtagttccagcatccgccaggtgctgctggatcctgagttctagaaaaccagctcctcccttccccctctagccctaggatgctagcagcttcctgccattgctattctctgggctgcctctccattttttgcttggctttttatctccttggacacctttataactagttccccatataaactccttctactagatattttggcatgaactctgggtttcctctggggtccctggtgggatcagcctccctccagcacgggcattctgagagcctggtagcttcctggaaaggccaatctgagctgaattaacaaatccctaggaaggtcaagaagatggaggggctgggaaaacccatgttgcctgcgagtgcagtgcctccatcctgtctggttccattccaggaaaaaaagttatataggaaaagcctcacaatcgcaatgtagttaaaaactgtttactgcctttttctaaatgagggaaacaaatgtaaggcccagagcagcctcccatcaaatcatgctcttgctcagatcaaacggcagcccgagtgaatattcctagagttcctacttgggagctcacgctagctactaagtcctccctgccaaaaagacccgattatacaaagtggggcagcaggaaagccagtcttgtagcatcaaagaaacacactgtctgaattccatcagccacaagcaggcatcctccacccagggataatgcagccagggcactgtgccccagaatggccccacccatgcaggagggcaccttccctcctcactgtgctggcttcttttaacaaatagccctatctatgagctcccttgttccttccaaccattctaaagatagggcaggcaccaaggccaggggtatgggcaggtcctcctccctgaggaccaaggcacagagagtttccaaggccacacagccacttggaagcagagctgggattagaaccctgcctggacagggaatgacttcaacttacacacatgaacaaacacgaatctcaactccctgttatggtggggttccccagacacacatgcatggtagagatttcagtgcaaatttaatcatttgaaaatactgacattcaaccattttttaacctcaaaaatggcaatttcatgtggcttacatgaatagtttatttgggtagtgatcccaggggagaaccagctggggagtggggaaataaaatgggaaagtgagagggcagggtttgttaatggtcaggacactgctgcagacaaccaaggctcaatgccactggagacctctgggagatggggcagaaccaccctgtccaacatggaaggcaccagccacattgagctatctacatttaaattacttgaattgaaaaacttagttcctcagtccactagccaaattccaaaagctcaataaccacagatggctggtggctatcatattggacagcacacatacagaacatttccatcattacagaaaatcataggggtagcactggcatagaccatgcctcagagctgtgtcatctgaggggtagaatctggggtatttatactcccattagggtctatcattggcaagggctgcacctgggggtatttgctgcaggcacttccagatgtcttggctcacactggtagggggagggaaggcactgacagtaggggcatttgagtgggataggaatagagtggcctgggggcatgggcagggcattcacagcctctgccacaatcaccagcccttcctgcacatcacctctgctcttgttgaagcacctctggatgcaggcattttgacagcttcttcgcaatgggaatgtggccccagaatcctctgacctgatgacaagccattctccctggagacaacacacagagagagacacaatccaggccttccaagcatttgtgatctacagcaggcagctgggacacagaccacagcatgcagcaactatacaaacactgactaataagctaaaatcggaaatctttatggagaaacccttgtgagcagtgcctggctaacagcatgtaggtgttgcctccaagaactgtctagcatttgagagacacagttggagactgagcgtccccattaggcaggctggtccccgaatacccacattattgtggtaatcaaaacacagctttgagacatcactgtgctggtcacaaacctggcaaggtcaagaaagtgctctgaagaccagcacccaaaatcttcacagcttagccttcctcccaggggcccgctcttggcatagcacagtggccagaacacagactctctggagcccactgcctgaggtcatgtctcatctcctccttcctcactgcgtggccttaggcgcactatttgatctctctgagcctgcatttcctcatctataaagtggacacaataacaataactttccaatatggttgtcaagaaaattaaatgagcccatgcttttaaagatcttataagaaggatggcaaactttttccataaagagccagatagcaaatattctatggcattgcaggtcacacagactctcacaacctctcacttcggtccttgtagctccaaaccagccataggcaatatgtaaacaaatggatgttccaataaaactttatttataaaatcaggtagtgagccagatttgccctgcaggccatagtttactaacccctatcttagaatgattcctgctctacagtgagtgctatatgaatgttcgttgataaagtctgctgcgctctcccacctctcagattcttcctgtattattattctctctgcctccctctccacccatcctttaagaccaagctcaagtagccttcctgaaacagtgtggagatttctcaaagagctcaaaatagaactactattcaatctagcaaccccactaatgagtatctaccgaaaggaaatcattagaccaaaaaaacacctgcactcatgtttattgcagcactactcacattagcaaagtcgtggaatcaacctaagtgtccatcaatggatggctggataaagaaaatgtggtacacacgtgcacacacacacacacacacacacacgcacaccatggaatattactcagccttagaaaaaaaatgaaatcatgtcttttgcagcaacacagagggaactggaggccgttatcctaagtgaactaactcagaaacaaagtcagacagaaagtgatgggtacactaaaagcccatgttgtcacttataagtgggagctaaactgagtacacatggacatacagaatggaataataatactggagactccaaaaagtgggacggtgagggggtgtgggataaaaaattacctattgggctgggcatggtggttcaagcctgtaatcccagcactctgggaggccgaggtgggcggatcacctgaggtcaagagttcaagaccagccttgccaacacggtgaaaccccatctctactaaaaatacaaaaattagctgggcgtggtggcatgccactgtaatcccagctccttgggaggctgaggcaggagaattacttgaacacgggaggcagaggttgcagtaagccaagatcacaccattgcactccagcctgggtaacaagagtgaaactctgtctcaagaaaaaaaaaaattacctattggatacaatgtacactatttgggtgatgggtgcactaaaagcccagactttaccactacacaatatatccatgtaacaaaaccgcacttgtactccctcttttttttttttcaaaaaagaggcctccctggaccctccctcttttcttagccacatccttagaccacttccaagttgctcttctgtggtgacccttgccccaccctgctatttgtggggcaacttgtttcgctgtagaatttcattgttcctgttaaatgatgagatgatccaatgtcttcattttacagggagggaagcaaggcccagagaagccaagcgacttattcaaggtcacacagtgacggcagagtcaggaccagacatggatgtgtcttgattcatgattcagtacagtcttgggcttaaggagatttcaatactgaggagagtggggacacagatcacccagccttctacccttgatttagggctggactaggtcacccctccacagaggttccttacttcctgcctcagcacccctccaggcagaacacttacggggcttgttgccccaactagacaggtctggctcacttctgagtctgtcacatatccagcatgggcccaggcacgctccagatgcaatagtgttgaccctgtgtgctttgtcttcctcttccttccccgtgagtctgcccattgccccggggacacccaggacagactcacagatcttccccaggggacatgtcctgttcatgcctatctaagtcatcaaaggcaaattccagagcagcctatagccagggctgtgtggggactccccactgactatggggcttcacagaggcacagcccaaagtaccatgctcacagacacacaaattcagacacacacatgcacacacacacacaagcagacacatgcacacactaatataaacaacacagacacacatacacatacacacggacacggacacacacagaaacatgcacacactaacataaacacatacatgcacacacatacacgcatgcacacaatgaaacaggcacacagacacatgcacactaacataaatacacacagcacatatactcagatagatgcacacacctaaacacaaatatacacatgtatacccacactgatgctaacacatacacacatgagcacacacacacatacacagaaacatatatacacttaaatacatatatgcatggagaaacaaatgcatacatgtgcacacacacacttagacgtaaaaacacatatatttacaaacaaacacaaatgtatgcactcaaatagacatataaatacacatgcatacacacagacatgtaaacatacatacacgtaaacatacacacatctatagatgctcatgtgctcacagagacccttatatacctatgcacacatggataaacacacacaccctcacacatgcacttacacactgtgtgatgtttttagcttttacctttacagacagacatgggagctttccctggaagatgtaaggtccctgggaaagggactgtgccctgggctctcccccgggagagagtcccgcccacccacagcatctgcctggtgtcttgaacacaactagtgctcacgtttcctcaatggacggatgaatgaagtcgtctcatgcctgggccttgggtccatggggagagcttggctcaggaagccggtgctgcctctatcacctctgagtttccaagccatactctctcaccccatcccagcttgggaaacagccagcatcttgctggcctcttggtggagtgttgctgatccatgcctctgccagaggtgggagaaacctcgatgaaactcaaaccaagtcttgacttatctagggatggctgaaggtcctcctggggtggggagaaggtggaagaaaccactgactaaagtggtcctggccccattctcccagcatgtaggttttctggctggactttacaagtaaaaaccacagtgaggagctcacttctacctgaggtaacacagtgcatggcccccacctgcttcccttcatatcactatcttgcaaaactggctcagagagagcctcctggccctgcgtagcctgggaagataccacccaccatcatttgttacctccccacagtgggaaggtgaagggcttaggagacctgcttcttggcaccatcacactgtactgtgttgtcaccctatctggacctcagtgtttcctctgcttctataaaacggggtgaataacctttgcctcctaaataccaaggatacagcatcaaggagaaaggactctgacctcacaggaggtgggaccaaggagaggggcaactcacaaaagcctgaggaagaacattctttggtggcacctccctgatgagcagagaggagccgctctgcaagttaagtaattgatggagcacacgctaaaaatacaaactaggttagcactcagggtggtttattgctccaagagggagttaattcaggcactcaaatctccatggaacagggactgtgagcccagagcagcagactcctgagccaggaggcctcatgcaacccagctgagaagtgctgtttacttaaaggctgagcaagacggaaccagagaaaatgggctggggaagcatagggggtggcagagaagggagtgcccaggccttaggagcatgagggaaagaaaggaggcaacatgcaaattagtaacaggaagtgggacaggcgacaggagctggaagggctactccctcctagattgggctgcaaagaccccagcctcccagctttctggagccccttgctattccaagtaagctccagagaccagcggcatctgcatcaccagggctctcatcagaaaaacagaatctcagaccccaccctagacctcccgaatatacattgccacaagatcctcagatttcctgtgcacactaaagtttgagaagcacaagattaggagtcaaaatccctgagttcctggtccagctattgctatcaaattgctgtgtggttttgcaggacttgcttgacctctctgggtgctagaatttcttcctctgggctacaggatgagtgaggcttgtttctttctcctgggttctgagaggctcaagtcagacccttcatctgcaggcctcggaagcatgggagggcctttacagaaaaacgtttccattttctaccaggctgcccccttccgctttcttggagtcattagtacacagagaggtagatggggagatgatccttgaaggacacactgcagtcaggaagaagacttcttaatgtcattttaagccttgatatctctccattaaaaaaaaaaaattataaagcagcctcttgctaatggggaagcagcgggtctgagtcatgctaagtaagccagagcatttcatctggaaatccctggtctggtgttacccattgcctttgggacattcaatatcactactgcacttgagaaatgtggcttctggggctcagagaggttaagtgagtgggtcagagtcacacagccagtgagaaacagggccaggacgggaagccaggctcccggccctctaagagaaactcttttaagtacctcaaggtgcccacgtccttgacagctgacccagactggtgtgaggacaggaagggaaaagacattctgactattgcctgagttggacagagttaagaggataaatctgggaggatatgatatcacaagggttcagatagaaagtttctaaattattgcttaacttgtttcatcaaatgaattgcttccctccattagcccagggctgaagtggccaattacctgccttctgcacaggacgacggccgtgtataaatcaacttgggtaggtaacaaaggaatagccaaaattctaaaacaaaaatagatgagagacttaagcacaccccaaaataaaacacacacacactcggtaactcaagtattaagttctgagacggccaggcctgagtccctctcggcctccatccagagaccaaacatacagtctctgatgatgctgagcgtggcaatgaggcctttgcataggccacgatccctgcagcaaactgcgttgccttccctgggctttgggaaggacacttaaggctggagattcaactaagtgcaaagctggtacctgcagacccaggggcaccagtcagtctacagctatggagggtgttttaatgcaaatggtaaggcaactttgctggtccctccttctggctccaggatggcacctcctggggctgctgggcttttcccaggtcttaaaaggaattctggtattacagaaatactcagagttttggagttagaacagcctgagtttgattctggatgctgccactcactagctgtatctgccttgggtgagccatttaaacatactgaaccacagctttctcatctgcaaaatggggataataacaatgccagtgtcagagggctatcaagaggattgaataaggttaacatatacaaagcaccctatcggcacctggcaaacagcaggcatttaatgagtgtgggctccctccaacatagactagaaaaactggtcgaggggtagcctctccctaggaatattctcttcctttatacattacattaagagggtgaaccagtccaagccagattcccaattccatccttcagcccaaggctgctccattgcacagcttcaggaggcactgcccatatggtggtctagatgtgtgacgcttcccggggctgggcagtccacaacctgcctcagcctatggagacacccatgggatgctaagagggaaagaagagatccaaatccacccttggcagaaaatgggaccatcccaagaaagtgttcctggcaggagctcagtgggcaggaagtaggatgcccagcaagggcatacccttggcgggagcatcaggaactaaggcaaaaatagaccatgaggcccagggctgcatccacctcttcctggcccagacctctctgcccctctgaagcctggctgccctcactcctcgatcctcagtgcctagcatggactctccacacccactctccctcacttcgcctggtctccctaactagagagcaagctccctgtgggcaggggagtaactgatatcactgtggtcctcttgagccaaacacactgtgctaagaaagcccaggcctgcatcatctgctggctagctgcttcttcatctccaaagcccaattgacacagccacccatgtatctcagaggatggttagagagcccaaacgatgctcactcagtctttcaacaaacatgcattgagaacctactgcatgagctctggagtgcaatagtgaaataggcagaaaggattcctgtcctcaaagagcttattctctagtgagagacaaaggccaatcaagtacacaaacaaatactacatattacatatatgttaaattgtaatcaactacaagaaatgagttcactgcattatataatcaaccattgaaggcttcaatagtcacagaaagactgatgcaagagacaggctgaatgtagctctagtgagagagtaaggagccagaaaggtaaggaggggagaatatgagcaaacaagcctcctgtgcaggacatttccgtctgctgtgaccacccttcacagaactgagggcttgcctgttctgtcacgtgggatgctgatgtccatgagggaggcaggttatcacctttgatttgaaagccctagaggcagtgaagttgcaatcagatagacaggacctgaaagaaagaaaaaagggagggaggggggaaaggggaggagaggaaaaggaagaggagaaggaaaaaaagaaaaagtagagaaaagaaaaaagaaagccagacccctgtgctaggaaaaatctagctagaggaacgcagagcctagcctgtgatcttaaggtgacttctaggccagactgtgaagggcaccatgtcataaagccattgccacctccatttgatgtgcaccatcacctctcctggctcttggccttatagattcaccagtttttaaaaaaactcttacattgcagctgcttctcagaggctgagactcagtgactgtgtcagttttcatcttaattcatgtctgtactgccacactgttggcaggacatgtttcacaccaaataactacactttaatcaagctctctgttggttgcattttttgatgatggaaagtccgtctccgaagcagttgtcttcactaatgttgactgagcagtgctcagcagatgtaatgctgagcgaataggggatcccaagggactccagggtgccagtgcgatgatccaacagggttccagacatggcaatttagttggacttcatcctcagtcatagaatccagtggcagaactctatgtcacagcatcacagttgtgtggacacacagagctgccagagactataaaggccatagccttttccaccagcgcctgcatttgcccctagggaaagccaactcgaggtcaaggttagttcccaagtttccagacttgagagaggacagtggtcagagagtccagaagtttctgaaaggctgctccaaaagggcagggaggcacagcagggccacttggccactcgccgagttctacattcacagggaccacgaattttgaccttgaagctattcctgattaggttatgtacacattcctggagatgtattcatggaaggaaaaaatatggcattgatcatctgatttaaacttttatcctgttaccagatctcattctggtagtacactaggaattaatatgaagtttgcaaattaagtattatcctttgaatagtacaatcatattgtttccttgtttttatttttatttttatttatttttaaattttttgacacagagtctcactctgtcgcccaggctggagtgcagtggtgcgatcttggcttattgcagactccgcctcccgggttccagtgattcttgtgcctcagcctcccaagtagctgggactacagatgtgcacaaccatgcctggctaatttttgtatttttggtagagacagggtttcaccatgtgggccgggctggtctcgaactgtcagaactgtcaggggattctgtcagaaccaggggattctggagtcagaatgcctgccatcttctcctatagctctgtgtctacacacaagttacttagcccctctgtgcctattaagggctgatttatgttccccaccaaaaattcacattgaagtcctaatgcccagtacctcagaatgggatgtattcagagacagggtattcaaagatgtgataaaattaaaatgaggtcattagggtgggtcctaatgcaatatgactggtgtccttagaagaagaggaaattaggacacagacatatacaggagggagatgatacatacacagggagaagaaggcagtcttccacaaggcaatgagagagtcctggaaccgatccttccttcacaacccagagaaggaaccagccctgccaacaccttgatctcagacttctggcctctagaactgtaagaaaattaatttctgttgtgtaagccacctggcctgtagtactttgtcacagcaggcctagcaaactaatacagtgcctccctttcctcatcaagaaaatagaaatgataatagtcccttcctcacagagatgtgttgagtacccagttcccagcactcagtaggtgtccagcaaatgtttcttgcactacttgtgattagtacagagtcttaacccaacctggtctctgcatgcttcatcttactcttctgtgtgagaaaagaggcttataatgaaagcagagaacagtaaattctgcagacaagtcacacacttcacaatccccaccaccctccccgaccacttcgccccaagcaccttaaggttgaatggtttgagtcccaaatctgcacttgcataaggtttcttttgctctagccatgtactttgctgactgttgtaggacccgcctgcccatcctgtgttctctccacccaataccttcaaaggccacaataggaaccccgctactccttggtttatcaatattagacaacttaggatgcagttagagatccacacgccatccaagtccccacattacagaaattagaagcctctccttccagtttattggagaaggaggatttctggtcaagacgtccaccttcaagatgaggtgaagagcagacaccactctggacagtttgcctggccacctaaggaaaacacagcgtttagagggcagcgccagaactgtgtctcctcaagaaatttgtcttgagaagggtccctgaatataacggttgccagaggggactccttggggcctagagcaagcttactgggggtcctggaagagttctcagaggtgtgtgaactcactggcagctgactgagaaactgggagtggcacaaagacctttagaaaccaataaggacttcagaggtatcacccacaagcccagaagtgtggccaaactgaataccccagctctctgctgcctcagcaaggagccagggattcagtgatggtgtcttcttccaaacctgtatggcatggtaattaaaatcaaggtcatttagaacccagaaaccaaagccattctgactctagagggaattttaatttgttaatggatcttccggctgatggctgggggaaaagatagcaattcacaatgggtttgaggccaaaaatggcaccacagtggccgggaagccgctgatagctcctcggtcagtcttcaactgcagcaaggaacaggctgggctacccagggatacagatttttttttttaactttttaatcagctaatagcagatgaagacctaacaatgctgccaagattctgctccttctgtcagcagtggtgagaaggaggccagggtcggatgcgtccggctgcctttgctctctgaggttcttttggagggatgtaggaatttggggctgaggaggaaaccccagggccatcttctccactggtcaccaactgcaaggatccaggaaagggaaacaggtggaattctcagttccctatgccaatcctgggggagggcctgagacatgtactgtattaatttaccccacaaatgattatgggctgcttaaacggtgccacagatgtaatggagactcagcaaactgaggaggtgaggcccggaaacgtgtcactaaagctgcttactgtgtgccgcaaagggaagactccgggtggcctcagacagagggagggtagggcagcagaagagcttcatccagaaatgtaaaccaaaggcccggcaccctaccttgaacacccagtgctgccggaagatcctgtccccacatgagggctctgggcaggggatctcctcctaaccagcgccagcgaccacaaagggtgctcttcagtggagaagaaaaagaagaatctaattcctgacttttatttttagctgcaagtcagacagaagagcagaaagaaggcacttgaccataatcctgatcatactgaacgagtaatttaatcatttttaaagcctgtgtgcaggctccgccatcttactggggtctaacttgggaaactctcacctcatttcaagcaaccagggtttctctacaagagccatcaaaaactacttctttagaagcacaatttctaggcatttgttttgtccaaaaacttggattctcttactttgttccttgagctaaatcaagcacaactatgccagctgaggcagtgaggagaaaaccggggtggggaatgaagcaggcaagagggcctcctgccctcagagaggcagcccggctcatccaatggatagacgcacaccatacacacaccacacaacacacatgtaacacaacacacactacacactgcacaccacatacataacacaactcatactacacacacaacacatatacaacacacaatacacaccagacatgttacataactcacactacacaccacacacataacaactcacactacacacacaccacacacaacacacaatacacaccacacatgcaacacacactacacaacacacattacacacataacacaactcacactacacacacaacgcacatacaacacacaatacacaccacacatgtaacacaacacacactacacagtgcacaccacacacaactcacactacacacacaacacaacacatgtaacacaacacacactacttaccacacacaccacataacacacatcacacatacacacaccaagcaccacacacaatgcaactcacactacacacacaccatgcaccacacacgtaacacaatacatgctacacacacacttcacaccatacaccacacaccatacacatacacacagcacacactacacacacaccatacactgcacacactccataccaaataccacaggtcacacacacacaccacacacactatacatatacatacataatacacacccaacacatatagacacatcacacactacacacacacaccacacacactatacacacatacacattatatacacatatcacacatacacacataacacacatacacgcattgtccacacaccatccacgtacataccacacatatacacacacccaacaaatatacacgcagcacacacatactatacacacattatacacaacgcatgtacacactatacacacatcacacatatatacacacacataaacatacaagtggtatacacacactatacacacaccatatatatatacacaccacatacaccatacatacaccacacactacacatcacacacacataatgccacatacacacaccacacacacatacaccacacaccacacacatgacacatattcacatacatgtaccacatacacacatgcaccatacacataccacacacacacaccacataaatacccacacaccacgcattctgcacacactacataccacacatatcacacatatattatatattcactgcccacatacacaccacacaaatacaccacacacacacacactacacacacactatacatacatcacatagacacagacacatacacatagcacacctaggcacactatgcacatgtcacacacacatcacacacacacagagagcgtacatactaaacacacatcacatatacacatacacacaccacacacacatactacacacacactatacaaacatcacagacacagacacatacacatagcacacctaggcacactatgcacgtcacacacacatcacacacacacagagagcatacatactaaacacacatcacacatacacatacacacaccacacacacatactgtttatttccttgctttaataaaaaaataaaaagagagagaactttaaaaggaagcagaggaaaataggcatttggaaaattagccccatcctaccatgatagctcctataaaacatcttctagagtctgattttcccacatctaaaaattatttctttttattctgttgttgtttggcactacaatataaatatctgtgcgtgcagaagcagcttttagtctttcatctgtgacatctgtggagagcgctggagcttgtgtttattcataggcatcagtccgttccacccttcaaacaacaaaggaggcaggtggaacccagagatcagaggagtgaagacattagctcaagggctcaggatgggctccaggtgcacttactctatgctgtctgacattcatggtgggctcgtactaggattgggcagggtgagtttggcaaaccaaaacccaaatgtgcacttcccagcggggccacccaccagggtgctgtaccctaaccctccacggctgtggcctgccctgggtcacctcatggcctggtgctgcccttcacacgaggaaaacccttctgtcagttcctagtctccatctttctcctccctgattccaaagtgcaggtgcctgctgactgagttctttttagatgaagtctgttttcaccataggccctcaaccaaaggccagttgacttcaactggccaactttcatctcaacccagaattacagctatccccaggaggcaggcattggaggagttgctggaccgcagaactgaacactcacatcctctgagaaacggagcagtgaaggctcttgcaattatctcctgaggggggctgatgaactgggggccccagcctggagcagtggaggccaagaagagctttagccctgtcttcaagggcctgaagagagtggcccagtggtcagatgtattctgtccatccccagggggagaccagaaccaccagacagaagatttagagagaaatctctctcttgcttttcagtagagcctgactttcacaagataggaggggcctccgtggatggaaacaggctccctggcacaggaggcatttaagaagaggtggatggtctctcagtgggacactggagcagggggacagacatcgggggaagggtgggccagtgcgacctttccaattgcctcccaccttgagaatccctgactcgacagagtgaatacacagccatctgagacctcctggtcacctgcctgcagggctctcttctgggcctaaaaataagattcccagagtcctgatccaaattagatccttaataacgtgtcaccatggctataaataagtctctttgagggccagttaatataattattttaatcagctacactccctagaaggactgccagctagctccccgctcagcctcgctgcgttctgaacaggtgcgctcctcctccgcctcacccagggccggtccttagagcagtcacaatgatgaagggtgggtgggcagtctctctgcttccctctctctaatgtccctgagacactccttccattctggggcctacattctcccttgatcattcaccaagacttccaacaggaagacaggggtgaaaacgcaaagtctacaagagccagacacacagcaaagacatgtaaatcacacacggcatgatgtgagagagagtgttacggactgaattggttccctgcaaatccacatgttcatatcctaatccccaggacctcagaatgtggctgtacttggtgacagggtctttgaacaggtgattatggttaaatgaggtcattagggtgggccttcatccaacaggactgatgtctttataagaacaggagattaggacatggacagaaaaaagaccatgtgaagatacagggaaaacaaggcggccatctacaagagccaaggagagaggcctcggaggaaaccaatcctgctggcaccttgacctcagacttacagcctctagcagggtgagaaggtaactgtcggttgtgtgagccacccaggcgatggtcctttgttacagcacctcaggaaactcacatggggcgcggtagggtgtgccctgtctggaggttccacattcttttttttttctctctctcccaaagactggacagccaaacaacacagagccctggacttctctgtcattgtatatgactccctgagagaatgtaaggaaagaaaagcaatagggtgtcagagaaaggacattggcctggccgggagagctggtgggtttagccaggctacctgagcaagctgctcagtcttgggaactattcaattatgttggcccccatcctatcatcagttaactgaaacacctggcccacaatgacctttaaagagccttccaggactaacaattttgcccctgggtagcaaggggcagcctcagatcatgagcctagaagggagaagccctggaggacagagtgggacaactgcagaaggagcacacagaggtgtgggtgatgtcaggaggctgcttgactctttcctggagctaggagctttcgttcctgtcccagctgctctatttgctaagtgcctcaacttgtccccctcccgggcatctgtaaatgagataataggagtgcacgtgttgtgtaccagtgaaagtctacactatgccaagcatgctcaccattacgaaagaggacaaggacaggtgggtgcccagtggcttctcaagactgacatctacatttatcagattccccaaggggcaactccctgggcaaggcaaggtgggtcttcagagttggggccggagtgcctgtcttctccccaccacaaacctaggtgccacattactatacagtcctaaagatgctttaggattgtggtttcgtgctgaaggaggcaggggagaaatcgtaacttgcatctcccaaaggctagaagtgaaattaagatccttacacacgcttagtggtctgcattttacatagagctttcaccaatacaatctcccaggtattattattcccattttacagatgaagaaaccaaggcaaggggagattaatgatgaaaataaggcagtgtaaaaaaaagcacaaggcttgggttcttactttgacctttaacaaagtcacttaatatcttgttatcacatggcctgcaaacaaagtcctgtagccagtacaagcagggtcaaaacatgacctgaggacttccacccagaacacgccatatgcacatttcacagattcaaataatctcagaactggaagggcccttggcaatcacagatctgattcctttggatttatgccaaggaaactgaggtctaaagatctccttgctcagggtctcacagtgaggctctggctggactaaaaccagagtccagggttctttttcatagaccatcctgccctgtcaatttgacttcaaaatcttcctcttcaacacaaaccacaaccacaaagagaagggtcttctgggttatctgtattgggttgcagaaagaagttccacccgtacccccaaacctggatacttcctccaggccgcacggtgctggcctcctccagcgactttgagcaggagagcaaatgagtcaagctcctctcacaggatgaggctgctgggagcagctcagaggactggaattagaaattctaattattagaactctcggaatgcaccaaaggacaatttataattagcacatgtcaaaaggccatccgcaaaggggacacattataaatcagaaaacaaagatggccccagaaagggactggggagctgagctgtttggcctcccacccctcctgatggccctaaatccaatccacctcccactcctgtgagccctcctccctcctatgccagcctctctcctgctgctctgccctttgcaagcccagcattggtgcttcccgctccctaagccctcttccctctgctgctcggtcagggccactgtccgaaggccttagcacagggatccctctcttcagggtccatgcagctctaaccccaggtcctgagcgggtcagaggcttttggctcctgctgtcacaggctgcaaataaggatttaatgactagcctttttatgaggaagaaaatgtctccagtggactgataatgtcatcgtctgctgctcaggtgcatgtgcccaggtaagcctcacagccagaaccctgctcttatgatgaaagctcagggcacaatcccagtgcagacttggaaaggccagcatgcaaaagaggtcggggcacctccttgtttcttccatgaatgaatgaatgaatggattttctactgacttatatgccataaatattttcttgagtacttcctatgtgttagtcacagcacttgagattggagaggaaaagcagtcaaaaacacagaaataaataagacacgaccctaccctcccagaattcatagtagcacatacttgacaggtgaaaacatttttagaaaaacaaaaacgaaaaccagcaagagaactggcatctgaaggcaggacacctggattccaggaaaagctcttagctgcatgacttgcctcctgccggtcatttgtcttccttgggcctccatcatctgtgccatggagataataccaacttcgtggatcccacaggggttgccatggaaaacatgataaaacacaggaacagaccctctgagaaatgtctgcagtgtaactccttatcataacacgaaacactgaagattctgttggctgataggaataagaattctattttcccacacttgccagtctgactcaagatggcacctagttccttggacaaagatcccaagggtagagaaaggcaatttatcaggccaccatatgtctgtgcttaccaaggaaccttctagatggtgacattttctcatatgctgtggctcacaggggaaagactgcctctatgtctagggatgacaaggttttattccaggagcaaatgaaccccatctgtgtggtagtggctgcctggagcactgtgttaaaaaagatcctgaagttgcatcttggcttggctagaaagaacatcctgatagattatggatgtctgttatgaatatggagttggggagtggcactttgttacttgtgacctaggaagataacatgcccactcaaccacactccttgttgcacacctttctttagagctgtgtcctctggccattcaaaggtgagctgagtattggtcaatgccctgaacacgattccttctgtgtgaattgttaatattaagttcttagagccagcaaagcctaagacatatgcccagcaagaaactgctatttttaggaaattagctggtccttcagacccggttaaatgtgctaggtggtctcagtcatgttctttataaactgagaagaatgcctcacaaatttgggtgtcattagggtctgtggatcccgggcactgccacacaaaatcacccggttcaaataccctgcaggtacatgataccctctgccgttaattctatgccattttgttgaagtctattccacttccttcctttaccacttctcaggacaatgcattctctgagtttattatgagctttatgctctatgaattcttgccatttttctaatatttaccctgcttgcgttttaaaggggacctctctcttagcatgtcaggatgtggcaaagagtctgtactggcttagttgctctgctcacacttttataaaagtctattatgtctgtgttaattcccaacagagctgagctgcagtcaacccctgaactacttattaaaaagaagcactgagcagatgaacgctctgctcatgactgagaggggaagagaacagactgtgtccaagtccatcaacacatcatctgtgcaccaggaatgctccaaacacaaacagccctagtgagtcacaaggatagatgaatgctacggtgattcttacatttgcagtcaggaccacagagtgctggagacaagaggcagcttagaaaccatctagtgactaaagatgcagaaattcaggcccagaacaattaaccggcccacagtgttactccaagccaggtatacttactataaaaaagagtatcacaaaactctacatgtgaggtatttcatttatgtctctttttgctatttcagatggtttcctctcagaactaaaagcacattgtattgcacattgtagatactcaaagtctgttaaataaataaaccaatgaggtaatgtacataaccctgcagaaggatttcagtacaatgctatttataatagcaaaaaagaggaaaaagtaaagagcaaatataaggaaaaggagtgagcatccatataagatatagtcatttaaaatatgtttatagagtcccagtgtcacttggaaatgctgataacgtaatgttaagaagaaaagcagaacactaaatcgcacatattctaggatctcggcattataaagaaaaatgcacagtaatatatttgggggaaaataaaacgaatcatgaacagtagtagatgtttctgttgtgattatgggaggttttatttctgcttctttgcactctgctgttttttgcagataatttacaatgtgcccataggattttcataagcaatgcgagggtattaagaaatagaaaagaatatccacagatattattcagccttgctgggatttggaaagagacagagatcatttctctcttttcacataaagaagctgatgaaacaaagagacagagacactagtgatgaaggcaggcattagctctctggtgtggagggccatccaatgccaggcaaacaacagatgcgggataaaatccactcaaaccacagtgggagggggcaggaggtgtccagtcttcctcttcacaaaggttccatccttaccttatccaaaagatgagcaatacaaggctaggctcagcctttaccagcagagcctccccaaagactctctggcccctgcagccaatgacaataaattaactatcacagtgaggtttttccccttcgtcaggcaatgtgctatacacattgtctcattaaatcctccccatgtctctgaggcaggtcttactgtgcccatctgagggatatagagaccaggactcacacaggtaaacccaggtggccaaggtgtcacagtttgtaaccggaccccagaagcctaagccctcgcccctgtgccccggctggtcattcgttcctccagatctttgcagcactaagaagatgctgcctggtgacatttcctgaattgtttcccacgggtcttgtctttcaggctaggacaagttgtttaacctttcacgtgcgtctgtctctcttgcttccctcaattggactgttagctcctgagggggatgagggggtcctgctttataattccttgtgtgtcccacggagccaagcctggtgatgtcttcagtacttgacacttcagatctcagaaaatacctgctcatcgattattggattgaataggttaaggaggagaaccgtctcatgggcagacctggcctgcagccaagacagaagctggatgcgcctccctccggactcttgaccccaccaaatacgacgcccatatatgtcaactgtggcattggtgtttgtcccccacacccctaaaccacaagccaataaattgcagggcactcagacatcaggatgtgtccttcacttgccaccagacctgagctggctacaggccaatgacagcatagggctggccctgcccgcctcccatctggcagcaaggatccagttccagattgtgacctgtggttgagtctggcacagtgacccagggctccagcaggcaaatcccagtcataaaaccctggtctgaaccagccacgtgatggaccccagttatctcttcctaaattgcagcagagctgatcttcttccagctgagccaagggccatcagacagggacacgtttacttttactatcctattaaagcatcccagaaaaaaagaaacagtccccatatcctagagcaagaaataagcaaatcattatctacaatgatatcctttaagtctaagcttgcccagaaggtgctgcacatttggagaccaggctatggctcccctctctgaattcttttgaaaccgcagggactgttacaggcgcctccaagactctggagccacagcttgcctagcgcagcttccccctcccggcaaagccctccctgacaaccctacccacagtaatctcaactttcatgaaccttttctctccccatagggtgaacacataaagacacacacgtgcagccgggcacggtggctcacacctgtaatcccagcactttgggaggcggaggtgggcagatcacctgaggtcaggagttcgagaccagcctggccaacatggtgaaatcctgtctctactaaaaatacaaaaaaaaaaaaaaaatagccggaggtagtggcgggcgcctgtaatcccagctacttgggaggctaaggcaggagaatctcgaacctggaagggggaggttccagtgagctgagatcatgccactgcactccagcctgggcaacagagtgagactccatctcaaaaaaaaaaaaaagatacacatgtgtatgcacatacacacgcgtgcacacacacacatacacacagcgtgtacatgttatttctccaatgaaagcatatttcccttaagggataggaccaatcacttatctttccagagtctaactgaaaaatggacccaacatccttgaattaataaataaatgaacaaataaatttgttgatggactggtcagttgataatgtcaaggaactccctgcaacagcctacacaggttcaccctcctccaaaatcatacctttccaagtccaaggaaatgctcaattcaatcatgctgttttagaaataaagtaatgaatgatattaacaattgtttagaaactaacaggtgcctggccaggcacgatggctcacgcctataatcccagcactttgggaggccgagacgggcggatcacaaggtcaggagatcgagaccatcctggtgaacacagtgaaagcccatctctactaaaaatatagaaaaattagctgggcatggtggcaggcccctgtagtcccagctacttgggaggctgagacaggagaatggcgtgaaccctggaggcagagcttgcagtgagccgagatcgcaccactgcactgtagcctgggcaacagagagagactctgtctcaaaaaaaaaaaaaaaaagaaagaaactaacaggtgccaggtactaggcttttgatataaatctcatacgttaatcttgtaagtgaggtagtattatcattattatccccattttacaggtaagaagaataaagaccagagggctatccacaactgaagtatagacagtgggtgaggaaacatgaaccaaatggttcttccagactcagggccagatccctggcacaaagtgcctaccctgcattgccttcagctaacgtgccaagcagacagttcccatccttcaattttatttaatcaaagcaaagaattcataagaatctgcccatgttcattattcaggcagattaaatatttgatagccctgtagtttaattttttatggctcagagattggagtgaagtgctccctgggaagccacactgtccctgggacagggcagcagctggccaaggaggccagaggccgaggctccacagggctctgctcagcacccacgtgcatctgtcctgactccagtaagctgctcatgctgggtcccagggccaaaggttacagacactttgtaagtttgcaagagaatctacaaaaaggaaagaagggctgtggggacaggaggcttagggcatcacaaaatcagaaaggaacccagatgaaccaaaacatccaggtcccaggaaggggaggcagcctcctccttctgtctctgaccacgcagcagaaacaaagcttttggacaaatgcatgagacggcataagggcaggatcaacttgtccatctctctgccaactaaagcaccacagggccatttgggaccttttgcctgccccttccagccacatgtaaccttcacagtcactacatattcctcccagttcactgtctccctgcagaagcttgaaagtccacagagaacaagaagagctgggagccaagagtccttcacagcctcaatctgttctcctctggcctaaagaagctctctttcctagtccttttcttatcttcaaaatgaaattccagcagtttttgtctcagctaccccaaaatgcccaaatgtcatgcagcatgatttcaatccctgaactgctccaacccaccccgatgcccccaagtctctctcttgctctccttccctcctttcctccttccctttctccctccttcccttcttctctcccccatccttcctctcttctctctctctctctcacatacacacacacacacacacacacacacacacacacacacacacacacacaccccttgttcttctgtgcctaccatagaacaagacctaatatctaagaatttcactggtacccagtcaacatccaaccaattaatttgttcaagggtttagaggggccaggagaggagactttttcactccagcagcccacggagatttctgttttaatttctttttaattggcagcgccactaacagcatatcagaaatctctctgctccgacccttctcctctcctctgttctcttcaacttttacaagggaaggacatccggcagttttctggaaaaatagagacatgtcacagcagagcccagctcctttttcctgccatccctattcatcaccagcctcctgaggagccggggtggtgacacaggctctcacttcatccatgtggggctcatcggggcaggtgacgaggagaaaggcatgcgccactccccccagagatggggcctgtcgcctcctgggaaaactggggtggagggctctcttccccgatcacctggctctatcttgctctacagacacctcactgggccctcagtactctcatgagaagagagcagacttccagccacccctgcttgccactccaggcctctctgctgatgggtgtatggccacgggacactggaaataacaggagtgtgtggtgagggagaactgtttgcccattttccacattcaagaacctggtgaaaagatgagcaaggattatctccacactggaaccattcatgctgcaaaaacagcactgagacattgaaggggaggaggcaatttatttgctgtcttgacactgtcgcccaagcaattctcatcgtgacaaaagaacactctggacaatcactgcccctcctctttcaggaaaccacactgagttttcatgacttgcaggtgacattttaataaggaatcaacatggaaccacaggggaagtaagctgaggccaggatctaggaggaccagggtgggaggggccaaaaatggcactcaggaaacaaagtcacctacggtgcaaaggctctttgtgcctgcaagtctggcaccgtgggatttctggcttttttctcctctctcatttactatttgggcagaggggaagtattttccagaaaggacaaagtagaagcagcctcagtaaagagctctctagaaacttctcctattcagttggtgttttacaaagtgcaaagcactgcaggcacctccattcacttatcccgttacgtgggtgtcgttatctacatcttataggcaaggaaaatgatgtgcccaaggtcacagagctactgaaagaaggaaggagaaatcagacatttctgtgccacctccttatagaagttgccgtcccccatcataatccaattaatggtaaaaatcacaactgaggctagatatgcagtaactccttgtgctctgcacagtgctaagcactttacatcagttgtctcctattttaatcctcatactaatgccaggagagaggtgttatcactctcatttgtcagatggggaaatcaaggctctgggccatcagtcacttgtcccaggccacagaagcagcaggagcagaaccaggattcaaactgtgtgcccctgcctgtgtatctccatggttctcaatcttgcctatcatcagcatcacctggacaaatggtccaaacaagacatgctgggccccacccaaagagtcgctaagtcagtggggctgaaagcaagcctaagaatctgcatcgccaacaacttcccaagtgaggctcttactgctgatatgaaaactccactttgagaacctctgctctgtctagcctgcctcttgtcacccacaagctaatgtgagcatcctgttagacaagtaatggaacaagatgtgcaaaatgtggctgcaggaagttcacttcctgatgcacaaaatcgctccaagaaatcacacaccatccagaaacacttaagcatcatctgcattaaacatcaactaagggatgttctaagccaatttactctaagactcactctctccttcttctgaacctcctctgctgaaagtgaccatcttccagccagcccacctcatgatcattaaaatacagctgtggagacatagggagcacttctgaatgagcaacccccatcagtgtccactcccacgtgtgtatttgtatgcccatcatgcaccatatggtgctcatattacatacgcaataaagtgcacacagatgtaatcattttaaagagtgataaacgtaaatagaaatagatgtcttaacattttcttcccctattccaaaggatagttttgtgcatcccactttggaggctgctggtctagaattcactgttcccgtttctaatttctgatcattagaatttggcaaccaccccctgcccctgcaggctgaccgagcgtgtctgaagagttgctgtgctctgtggttcgaggaaaagccgtttcctttctgttagcaagcccctagagaacacaggctgaccctccaagacttgcccagcacaagctctgtaagtaaggatggctcagccaaagcttcttgactgtgggggtcttttctccaaaagagaataagaagcatctcagagcccatagagaagacagtggctgtctctaaaagcttttgacctaacaagcaagagcaggagactgagccctcacttctaaagcagcaggaggagagggaactggatcagggtcagagagcaggccttgggatcagcctccaccaataaccatgggtgagactgggaccacactgtgtcccccaaggaccaatgtccttgcttgtcaaatgagatatagggtgaccaaccagtattgtggggcctcccagaatgccagagtttagtgccaaaactgaaacacactagaatgtttggtcaccctagctgtggaccaggtaccgggctctgggcaactataagtgtttatcagccctaccctgacctctgctgtaaggtatcctaggagagcctgagggagctggaggccattccctgctcactagggtgttgcaatcctaacaagatagagataatgataagccatgccaagtcaaatgtcaataccaggtcaaaacagaagctggaaagaggacataatgtaggctgccgtggccaggacagaccttcaggaggagggcagggtgcaggaggaggcagattaagcacacactgaagtattctttcctcaacctcacctcatctcctccctccccttccccaccaccaagtagagcaggaccgcagagaatgaacttaggctctggagtcttcctgtttgattccaaatctggtgctacacttttccttttggagtgatctcgggaccattactcaaactgcatagctgaggtattgttttctttaaaatggagccaattataccccactttccagggttgttctaaagattcaatgaagtaatgcacacagaacactttgaaattgtggctgagagcacaagctctataaatattggctgttcttaacctctcttgacccttttcaatctgttcgtgaatctaaggtattttcaaagaacagtgagctctccatgagaatgagctatcctgaatatttctgttattaatgatgggtacagccggcttagttctgcttctatctgtcactcctgaagccagggaggatgagagggtgtgtggagagaaagtcacagggaagccagccctggccccgggcaaagcccaagggtttctcctggccctgtgcataataagaagcagcttcctctgtctccatttccagctcctagccccaagcaggcaagtcatggaggggtttcccttcctccctagtcccccaggttctgaagaaagaaaggttcagaggccttctccctctgcagaaagggtatgtcacctcaggccatgacaagtccccagctaagcatccgctcaggaccacttaaagctcttgaaaatgagctgtcttagctcatggcaggtttcaagaatccctgcaggatgaaataccagcagtgttccccataaactcagtcagcgatgttgatggtaggaaccaggaaaggtaccgtcctgcctaactttctctccatccagctcagccctagaactcaacacatatagtagaatctagatgagtaaacccccacacagacttggccctgaaattccaccattaggcattcacttctttgatatgaacttcttttctgtaggtaatacatttttttttggttgcctggtatgtcaactggaacacacttaaatgaagaagaccaagattcacctcagcctctccccttagaaatctcgcaagtcaactggggaaaacaagccacacagaagtgtaatacacaaaaagaagtgtatacttcttcaaaaagtatatacttttggtgcaatacacagaaagagagagaagtgcaatacaaaagagagagagagacactatcacacttgccctcaaagggatacccccaacaacactgcacattccccttaccacacccccattgcaccttcaacacaatatcccaataaaagtaattagattaaatggtcattgtttgtcatgggcaattctctcactgtactgtgagttccttgaggcaatttttctctttttatccccaaaatttcgtgcatgggacagagtaagtagtcaatgaagatttttaaaaattgttaattaaggaatattttaataaaagtaaaatggaaatgcaagacattttgagaagggcaccagcttaagccagtggtcctcagagatggccctggacctgcaacatcacctggggatgtgtaagaaatgcaaagttgtccctaccccagaactacaaagtcaggagtccccaggttgggctggtactgtgcgttttaacaaggccatccaggtgatgctaatgcccactcaagtttgagaaccaatgacttcattcagcctttatcatcagacaccttctgcaatatgggttaactgtcctcaactctgtgaatataggcatatattcattcaatatatgcctattaataagcacccatgcagcaaaggccaggtggagccagccctggtcattaggtggcccaacgatgtcgacaagatggcagacaacatggtgagtccctaagcagttactcccaaagaccctcaaaggctgttctgagccaacaggaagaaaggccaccaagttgtggctgtggccagctgactgccctttaggaggagctgtgaggatgagatttcctagcaggaagctgctctggggaagggggatggcatcctgacacctgggagcaacagcctggaccatggattgggaggcggagggaatggggcagggcagtgggccacccaccttgtgccattggctgccggaccctgagcactgactggtttggagcctggtgtctgggctggtaaggaagcaaaggtgaaaggggtgtgggataaggcaaggtgagggagcagctgagccagcatccccttctgatctgttgataggctccacatctaggcctcttctaaacaaaaaggctgagctgccggctcagcagcagctctgtgggtgcacagccctgcccatcatttccccctgtattaggaacaaccgcccaactctggcccctggggcaggcccagagcccaggggtgacgaggagacagcacctcagccctggaaggtaccatgtccaagtgctcctcagccagggcagccatgttctctggaaaccagtagaagtgcagaggacactctgttccccaatcaggggcaaagttgccacaacttctccagacttggttttccagggccataggtcacctgctgacacttcatttaaaccattctcctgttataaaaagggacagtttggccaacctctcaacttacaggccctttagcccagtgtggctagccggctcttcccaggcacccacaggccaggagctaggaatgcctgctccactcaaggcccacctgccccttcccatcttccccctctaggcagagggggtcataagggttgcaggagcctcagacaggggtagatgaccccagggcctacctgtgatctcagggcgatgggtagagctcacagggctgacagacaaaagatagggtgccagttacatttgaaattcagaataaacaagaaataattttttagcataagtatgtctcaaatattgcatagggcatacttaaactaaaaactaaaaaccaaaaacctatcttgcttatctgaaattcaaatgtaactggacaaccttattttctttttatttatttattttttattatttatttattttttttgagatggagtctcactcttgtcgcccaggctggagtggagtggcacgatcttggctgactgcaacctctgcctcccaggttcaagcaattctcctgccttagtctccctggtagctggaattacaggcacccgctaccatacccggctaattttgtttgtatttttagtagagacagggtttcaccacattgaccaggttgacctcgaactcctgacctcaggtgatccgcctgcctcagcctcccaaagtgctgggattacaggcgtgagccaccgcgcctggcctggacaaccttattttcatttgctgaatctaccatccttactctatcagcaagcccagaataggaaaacctggtttttccaaagcagagcttaatatcacaagagaaagagccttgaaaatactatagagtaaggcctcattcacatgggtgaggttgataatttacttcacaggtgagatgacagtatcaaggttctgtctggcctctggcctctggtcaattgattcaaactttggatcccagctctggtgcagctgtgctgcctaacctcagcaagtcactcccccttcctggtggtcagttgtctcatcttcaggttaggacagagtttctcaaccccggcactgttgacattttggtccagattactctttattgaggagggttatcctgtgtattataagatgagcagtgtccctggccgctacgcaccggatgccagcagcacccaccccaatttgccaatgtctcatgggaggcaaaatcatgcctggttgagaaccacggggttaaatgaccctatatcctaatatctagggctcccaccacttttaacagtcgagaattattgggtttacacatgaatttgtggcaaagattcctcttaaatatccaactcccataatgaatctaacaggagatgtgaatgaccagggtttgattacatgtaaactttttaaaaatgtatcctctacctcactcccctcaacctcattccagcattcagaaattgacctagcctgattccagcaagtggctccagctctttgatggccttacagacagcaatgacttaataatactaaaaaataaaattatcatcaccctgattgaagggaatgatttactggaacttcttgggcaaacagtttttgctagtttaatattaatatgactactactaacgatagagtgtgtagagtgcctacaacacgctaagaccacactaggttatgtcatttaatcttcacaatagacctaggaggttggtgctgtgcttattcacatttagcagttgaaaagaaattaggcagtttgcctaaagtcacagactctgcctgtgctctttccaacacagaaacagtctatttacatacagctctcacaggagtagggaaattcattcctccctgggcctccattccaggtaaatactcacagtctttcatctccaggaccgaaatctctaggaccacacagaaccccagtccttatagggctgccacgtacagacaacacactggcttgtaaatgtatcttgaccttgcttttaccttgaaccactctttgtaactccagggcctactgtaggagccctaatcagccctactgtaggagccaggcccacatcaggcactccctcaataaatggttgctaaataactcagtgttcccccatttcaaagatggagacactgaggtccacctctttccgtgcaagtcattatctaaaagaaaaccaacgctggctctcaggttttgtttgtcctgaatccaaaatcccccacagtgctgattcactttgttttcttaacttgctcttaagatcccacatttccttttgtattattagtggatggagagttgattggatttgagtgacctggttgcctggtggcccaaaggactggcccaggagaccactgaagagttctagagcctggatctggaactggggcctggaaaatcgtgtgtccgtgccctcagttactaggtcaccttgagtggggctgccacattgttccatggcccagtttcccctcggacagcatgctgagtgagattccccccacggcgtgctattattacctggcacaccaaggaattaggccactgctacaatgaggccaccccgccctccaagattcttcaaaattctgctccttagagcaggacaacagggcaatgtagggcagtggctccaatttgctgaggactgcaggatgaaagagggcatcttggggtgactgggtgaacactgttctgggacacccagctatgacagaagggaccacagaacaaaagggtgcaaactgtgggcctcaccctggggggaaatgggtttagaagtcatacacacacacacacacacacacacacacacacacacacaccctacatataccaccagggagtctaattttagtagccatttgccccagcaaagcactttgcaagtagttattttgagaaatggtattagccattcggttatttttaatgccccttctgtgacaggcatttgtgacataaacagcagctgaaagaccataaacccatagcccttagatgtgttcagggcccaggcagcagccccttgggatgtcccaagcccaattcaaatggagggaatgggcgagcatcttgtacgccctgccggtcccgcctcactgcctactgctccgttcactggggatgggcagcaagatttgactgaatgggaagcccctctggtctgtgacagccagtgtgctaatgacaaccttcagtgcttgccgacagagtgcaggtgaaaatccacactgctaatgaaggtccctcgtgggctgtccccaacctgatgttctcagaccctgctcccaacacatggcttccacactctctgccttcccacatcctcccctctgctcaagctgacctctcatttggatcagcccactcctcatctctcataacccagcccctgctgatctgcatgctctgattccccataatgaaagagctggatcacctccttggccttctgcatctaatagcttgaattgttggccacctgtgtacttgtatttcttattgaagccactgcatttactctgtactgaggatgcaccaggcatcattctaagcccttaatgaagttcagggaactttcctgaggatcctagctggtatcatcatcatctagattttcgagatgatgaaatggaggtatagggaagttacccaaggcttctttgcaagtagtgctctaagcaagactacagatgcaagagcctcacggtctaggtctaaccctggttctgcaccttggaaccatggacaagttcgtcagtctgtgcctcagtctttccctgagttcctgtaaagattaaatgagttaatgcttatatgatccctttacagatgtctggcacatgacaggcactgtctaagagtcctcgcttgtatgggagtggagaggagaggccagagtattgtaaggtaagatgtattagtgcctacaatgtgttatgcaatgtactaaagcattctgcatgtattatcatatttaatgctcataataccttgtgaaattttacaaagaaattaagcttagagaagtgaaatcattctcctgtggtcaaagccagtgaatggggatttgaaccaggtagctgaacacaagtctaagtttattaacctgaatcctctgctggttgtcttgactctctggaaactgatcatgtcttcagatttcccacagttcctggcactaggttgagcactctaaacagattcaatgccaattgcaggcttctgacaaggcttcctaaatgcagagccctggctgcagatcaggagaccctggcccctccaagggcaccccggctaatcagcctcttcttctgacttctgactccaccccaggacaggcatggtgcttcgaaagcagaagtaaggcagcagaacacttggagaagcctcgctgagggccagggcctggtggttcggatggcagcaagctgcccccagggacccaaaacccaaaggtcaggaatgtagtactggccagccagggcaggcactgctgtgtggtagaagagaagtccagaactgtgaggcgtcaagcgtgagttggaggcaggatggcagtgagaatgcacgcccaactgagcgagtgcgtgtgagtgaattatgtgtgtggttcagttttaggcactgggcagatttgcaaagctcatcaccctcctagagttgcctgcaaaaggccacatgtttaacaccacgtcaatcaatcaacggaggtgcactgggtggggagtgtgtggccaacccagcacggggagccgtgcagctgcagggaagagagcatctctttccccagtggctcatggtcatagccgaggacacaagactggcccttgtgggaaaattgaggggacctgttaaatgctgacctctaatgtggttccagttgagtcaccatatttcttgtgaacctccaaagcactggaagacttctgggcctcgcgtggctgcaggtgaaacatacagccaatcactccaccctggagtcttggtttcctcccctgcagaatgagagtgacgctgataagacatctcaggcagaggcgaaggaggtgagccctgtgggaatttcggctgcccctgtgccaggctgaacaagacagggcctttgctttctgggggctgatgagtcatataaaggggatagaatcaaacactcaaaagacaataaccgcaacacagggctgggtgaataaatacacaactggctactcagaatgggataaccatgggagaggacttttaatgccaaagaaactcaccacgttgcctttgactttgaaaagtgatctgtgcttaatctggcatttcgccaattggaccatgagcaatggggtcccagtcctcattacccagtgcctcctttgcttcaggccagggctgaataggtacttaggacattcctaagaaggactgtgcaggaggaggctagcccagctgcctggctagcctcagcacacacattccctggaacagcagcctcgcttactgccagaccccacaggggtttctgcaggggctggacaaacgggcacatggggatgaaaagggtagagtccccagagtcagtcaatgtcagtgaattggcagccgctgctcacagagctgtctggattctttgcagcccagagagcacctttcaccacccagatggggaggccttgccaaccctgagcccctcagggaggtcatacgtgtgattctcagacaccagagggagcagttttccagagagtgaagaaatgggatccgggaagcttggtgaattcgtctgctggggctgccatcataaagtatcaaaaactgagttggattaaataatagaaatgcattgtctcacaggtctggaggccagaagtctgacatggagatgtcgttggggtcagttccttctgagggctgtgagggcacatgtgttccaggcctctctcctagttttcttgtccttccttggcttacagattcatcaccgcaatctctgccttcatctttataggcattctccctgtgtgcatgtctgtctctgtgtccaaagttcccctttttataaatatgacaccagttattttgggttagagcccacgctaatgatctcatcttaacttgatcatctgcaaagaccttatttccaaataaggtcacattcacaggtacggagggctaggacttcattatctgttggggagacacaattcaaccaataatatttgagttcctcaaaggaaaaacagctttttaaaaagccaaactgaaattcctaacattactaatatactggaacagagtcccaagaagtaggctcaatgtgtgaaggagcttcccggttccagcccccacgttaccccagcccaggcctttgtggcctcccgcctgcactgctctgtgatgggccccttgccggctgccctgacttggcctgtctcccttctgctacctccgcatcaggctgccacaccttgcatctcaccaccaggtccacctcggtcacgacaccttcctggtctaaaggccccagtggcagtcaaccacccagagggctgactgtggctcactccttttgacttcagcacccttggtaatctgcaccaacagaaacatcggccaatgagtgccgtgatttctctgcccgttttctcattcatgaaagggagaaaaaacgaactctccatgcatctactcccaacacattcccctgagaagcctgcggggaagctccctgggagcccattgccaaagcttccacctcatggagctggcgtgtacacagacaggcacagcctgccgtgctgggccaccatactggtgactggctgtgctctggtcccagcccaaggggtgggcaaaagaggaaagccagcctcatgatgagcagaggacagggaagagacccccacaccagggactgacccctccattccctcagaggaagcagaggctactgagccaccagtacccccgcggttcctccctgtagttgctcatggaaagccaccagcctcaggaagtcttcctgtgtggaagctcactggcaccaaggcaggctgagcccctctgccaaaggttctgggcagccatcggtctgataaagacacagagccctccttggaggcctggaagccccacccctagaaggtggtccttgaaagctctgtcactcatttcttctccagagcccctgaagcatcctccatgcagctgtgcccacctgaccatacagcctggccctcccttagcagcaccctggactccattcctaccacctccttgacaacagaatcctgtctgtcaccctcctcaccaggtgcgggtcttcaagataagagaccacctcatgcatgttacaaggaatgctctagaaggagcaccattcaagaaagagaggacagggccgggcacggtggctcacgcctgtaatcccagcactttgggaggccgagatgggcatatcacaaggtcaggagatcgagaccatactggctaacatggtgaaaccccgtctctactaaaaatacaaaaaaattagccaggtgtggtggcgggcgcctgtagtcccatctacttgggagactgaggcaggagaatggcgtgaacccgggaggcaaagcttgcagtgagccaagattgcgccactgcactgcagcctgggtgacagagcgagacactgtctcaaaaaaaaaaaaaaaaaaaaaaaaaaagaggacaggttgagcgccctgtcagaccagtgggcccccaaagctatataccatgtttgtttacctacttgatttctcaacatcactgtgagggagctatgaacatcctcattttacatacaggtaaggtaactgaagttcagctagattaagtgtgttgaccaggacacagcactagcaagagcctgaggacacctggctcctgctgtcacctggctgtcttcacctggtgtcccacaagtacttcaaactctgctctccaaagctctgctcattgtcttcccactcgccatccttaccagcccctacccacactaccttgctcttcctgaatcctttgtcctcactaggacaccaccctctactctgctgaccaggcaaacaaaaggacccaggcgaacaaaaggaccagtgttgcccaaggcctctgcagaggtctgtgcatgcatctcagagagcgaactaaccatgggagttcagcactgatcctattgtgtccttccactggctttttgtctgagctcccactggaaaaaccctgcattcttacttgatgaattttcaaaagcagccagggctttattatcaactgtcttttatgaataatcaaagtccaatggggactccctaattagcctgggcatgaaggccatttgcataacatattgaatgcctctggagtgtcaggtacctcagtagacatgatggttcatgcactaaacctcagcatgtgaccaagcctatggccagacacagatgaacttgaaagtgatgcactggaagtcgatgccccttgagggtgggtgagctcacagagtctattcctgacactgttgctctcacctcgtgacaaagaaccaatgctgctttcttgcatccacccctgagttccagaacccccgcagacaggcttccaaaaactgtgtccccaaactaagactgtgtgatatgtaagaagaactggcaggggacccaacctatattataaaacctcttgatctcctaaaagagagctgagtttaacccgacttagatcaccaggacagatgctatcacagaatcttagaatctgaggttgtaatggtcttctccaattcaatatcaaatccagtgctcccagtcctcttctcctaggactttgtatttgaggtggggaataagggagaaagtggaagatgtggctaacttgcaggtgagtaaaggagaagtcaggaagaagtagtgacttgtcccccaattcccacactcaggagcatgggcagtggagggagaaggatgctgccactggcttcatttacatttgtccatttacaaataccatggcaacaagagctcaggcatgcaatgccctcctgcccagattcctgcttcaaaatcaaaacaaatccagtatgcctggaaaacctgccacagctcagcaaactaggaacaggtgccatcaatgtgccaaaaacctaaaggaatctgaaaaaaaaaaatcagttatgcagaaaaagagaaggcagggaggccccttgggcagctttgctccctgagaagcggcaggatggttgtgaaacaaggagtgaggcccttgaagaacctcacatcagagctgcctacatcagtagggctgaacagggaggtgagccaagtatcaggcaccgggactccctggtcactatggatcacagcagtgttcagcagcagcagcagctctgagaagccctgggaatcacatggcagatacatccagaagaaaactggccagggcaggggcttgtccctgacacagcaggtggcagctccaggaaggaggacaagtccaagcacagtttgtacctggcatgttggccaggttaaacagcaagccagatgcaaacagttggcacaaggtgcagtggctttaccaaacacagagaagaaatatcacaggattaagttccccttctggaactattcatggttccagctcactcacccagactcacaggtctctgcaaggcttcacttcatcatccagtgctctagtgcaagatccgagagtagcattctatgggcaatgaggtgcacagcagaggagcccaagagaattgaccctccctatttacaggcaaacactgactgcattcatggatgcaaaacacgaaaacctcccaccagaccttgaaaacattcttaactataaaaggtagagaatgcagcactcaaaataaataaatttgaaaaaaaaaaggactgggtgggaaagtgccattatcatcatggccaagagcacaggctctgctgtgaaactggctggacctgagtcctggcccccagtcagtacccagatgaggctgagtagggctcaaccctctggacatgcgtttccccaatctatataatgaggacaaacaaagcacatgccccttggagttgttctgaggtaatgcacacaaagtgcttagcacagtgcacagaggacagtctgtgctcagtaaacaactcgtgtgatattgtgataattgaacttggagaaaccatctattctatgtctgcagtaaaagtcaagagaacttatttctgaaacaagatgtgttatgaagggcacatttagaaagcactctcaaaatgaagaggaaaaaaatacagaagcagaaatactgtgaggtctaagacagattatacaaaaagatgacagatatagaggacaggcagccaattcagaataaacctaactgaaaagacgaaaacaaaaaaaagtttcttaacacagaagacagacccaagtctgaaagtcaaaatgctcagtaggcatgtatatatatatatatatatacacacacacacatacacacacacacacacacacatatatatatacacatacatacatatattttaatttcatggtgaagaattatcagcatccaaacagaagatatcagattatctatgaaaaaaaaagagaaaaatcaagctgatatctgatgtctcctctgcaaaacccaacagcagggccaagttgtcattcatattaaaagaaacaaagtgcaaagtgcgataaagcagaatacgttgttcaagaagattaaacaggtgttaaatttttcatatttgtaattaagacattaatcaaaacaaggaattcaacaacaggagatgtccatggtaataaagatctggcaatgaaccctaagatctattaggtttaaataattgttacaactgtgattacaaatcaaaatgaaaatgaaaactaaaatttattggaagagaagataaaatgtgaaaaatataataataataagtagaagttttaaatatcagattataccataaaagcatgagtgtaatattatggaatgggggaatgaaaagaagaaaaattatttatcttacgtggcaaggagtaagaggctatttcactctatacattaaccattggcaaaatatggttgaacaatagttttaaatacttgagaggcagcatgggtagacattccaatttaataaagaaaagtataaaataaaaaatttaaatatctattacagatagacaaaaaagactgcaaaaagcattttttaaaaaacagaaaggccaaaacatattagttattacaatcaaaatgtgtggtacacattatatatagtattaactatatgcaataatatataataaataaatatataaaattatacactgtttataagaaatataccctaaaccaagtgacaaaataaggttaaaagtaaaagaataaaccagaatatgccaggcaaaaatcaagtgaggctcacacctgtaatcccactgctttgggaggccgaggtggcaggatcacttgaggccaggagtttgaaaccagccagggcaatatagtgagacaccatctctaccaaactgtaaaaagcaagctaaggagtgatgccaagttaaaggcaatggtatccaagcaagtgaaattcaaggcaaaagacattaaataaggcaacacaggaggtttcacattgatggagataatccaaagtgagtatctaaaagtcaatgacttttaggcacaaaggaagcctcacaacacaaaacatcaaattgtcaaaaataagaggagacaagtgacagaaacccagtagcagtagaggagtttactgaagtactattgctctctcatatattaagttgtccaaaactaaacataattatgggtgattagaaggctggaatttctgcgttaactggtcaactggagagaactggtagaaagctcaaccctctggttttggaggttggaaactgagacgggatgatgagtcagtacagcacagactagtgtggtccctgggctttacctcaaatggaaacttattaaaaacacacattctcagacctatcgcagacctgaccgaaatcagaaactctggagtggggccaagccctccaggttgttctaatgcaggctcaaggctaagacccaccaaggcaacaattaagcccataggctctggagggccagggccaaatcctgccccatttcagcattgttgggtgacatcaaacaagttgcttaacctctctatgcctccattatcatcatccataaactgagaagaagaagaatagtgcctcctcttggcatggccctgaggacaagatgagatcatgtggacacaggctcacagtgcctgcacggtgtgagcactcattgatggcttgctttggttcaggaatgcttggcagagctgtgcctccagccccactgctctcctgcctcccaacacccagaggtgttgagggtgaactcctctgcacccaatcctctgtgcatgtgcctgaggaggatggactgtcccctgacaatggatggatgccacctcatggctgatcactgctgcatgaggcagtgtcataaacccctccttgatgctctctggctggagcggccagttgagtgactcatggagcttgtcatctcagggcctccttccctgatgcacacggccctctatccctgccccccagcctgattcctcctccccctggcaagactgcagagctgagcagaggctgacccgatctgggcccctcgtctctgcagaagagagaaagccagcatgcagcggactcctgggcaagttccaggatgctgtcctcaagtaccacgtggccactgctacccatggtggggtgggagcaggggcaggcagaggccttgggccacagaacaaattctctctgtctgtgagcagaccagggtcaggtgtgtcctagttaaatcaaaatgtcctgtggggcaggaaacagtttttccactcataaagatgcagttcaaatttgagatgtgtcagggatttcactgtggctgactgtgtgtcatcatgattagatcatacactcgagcattttagagctgtaagtccctatggaaatcaccctgtgtatccccctcctctgccaggtgagacccatgaaggacagagaggccctaaggcagccccaaggtcacacaacataaaaatctaacagcaagaatggaaaagaaactgccttctaccacattgggttgccatgaaacctaacagctgggggcgcctgggaagagagaaaaagtcacgaagtttcttcctgacactcccactgacaatcgtgattctgacaccagaaatgccttttcttcatagcatttcccttacatggagaaatacacctcttgtcttgcttcattcacagttaaatatgcttaggaagacgaggagacggaggcccgtactcttgagccacccacctctgaatccacctgcctctggatccaccaaaatacctgcccttcctatttgcccgaatgctctcatgtttcagagccctctcctccaggaagccctccctgcaaacttcatcttaccatccccttttccatcctggatactctagagaaatcagagctcagattgaagctgagtcctcagactttcagttgcgtctgatttggaaggagaaagaagaacccccacatctctggcacccccatggacaccaagagaagaacttcagtccatctgacagcaaagcctgaactctttcttcactgagttcaaatttgcctctaccactcacccaccctttgtcatcaggcaagccacttacaactctccgagcctcaattttcccacctggaaaagggcaataataataataccttcctcctaggttggtgtgaggattaaataagattacatgtgcaaaagctccaagcacccacaatagataccgaactggaagtcactataataaaactgataatgacaacgatagtgatggtgataaatatcattagtgtataatccatacttggaccaatttgggttttttgttcaagaccgctcggtgagctgagtgtggcggcacatgcctgtaatcctagctgcttgagaggctgaagctggaggaccgcttgagcccaggagtttgagacaagcctaggcaacatagctagatcctctcttctaaaagaaaaacaaaacaaaaccaagaccacttggcaactctatcaaagaaaggtaaacaggtaagagctttttgggttaaaatgttgcagggatctgaactcccacccctctaggccagggaaggagaatgggagtggtaagagacttcctagtttaaaaatataacaataaaatccatcttccaaataaaaactgacctagtacacattttggattttttttctttcttccaaagctctgagagttagttgaatcctttaaaaagacagcatgctcacctctttctccctagcaccaatgatttggagagacagatcacttcacttctgacattctagatacatctatatgttgggattctccgtccacccagctagggcattctatgaagccaagaatttagttctaagctcccaaaggaagctctatttcaaaaagccgggtggctttatttcaaattgaagaggccattaaattcacaatattttgccaaatgaatttctcagtgatcctgagcaatcctctgaagtcagctgtccttgtgcagtcatgggcccagcacagagcaggcgtacatactaagcacctgttccagcaggtagagacagtgtagtgactgggacaagcctctgccctcatggatccagcactccttaaacaatttctgaagaaactcaggggagccagtgactggtacattctctgtttgagctgccacaagtgctgcgggatttttcagtgctggaaggggtccccaccatattagcaacaaggtatcaagtgccaaacactgtgcgacatcttacctaagttttcactgggcattttctgtttagtaagtcaggcactgagggagggaacatgtgacatgtccaatgttcagcttggcaaacagtgaagagggggtccaatggggggcagggcgcaggtggctgggatatggtgctggagggtctctccacatagggatacaattgggtagcatctccatcagctgacgtgttcccaattgtcctttcttggttatctgcctgcctggcaagaatgtgtttcttacactgccgccatgagcttacacttcactcactatacaatttattccactcacttttcacagtgatagcaggttgcccatatggctttatctcttctggaaagggagagtgagcatgtcccttgccccatcaccctccagatatggtgtctgtgcagctggcaggattggaacccagttctgtttcactgctcttcaagtgtaaccttcatcatagtctacaccctgcagaggagaagccatggagtgggaaggcagtgatggggaaccgagcaaccgagaggggtgccagactagcccagatccttgcaaactttcccatgacagccctgaaggcagaaaagaagaaacttttacctcctacctcagggagtctggattagaatttgaagcaagccttccacaagcagacagtttctttatatatattttaaattttatctttttatttttgttatatttttagagacagggtctcactctgttgcccatgctggactgcagtagtgcaatcatagctcattgcactatgatgcaatgaactcctgggctcaagcaattctcctgcctcagcctcccaaatcactaggtattacaggcatgagtcaccatgtccagccaggaagcttctttaaattgttgcattttatcttttaaaatatgtatgcatattttattcctcctcatgacaaatgtgattgaatacaaaataatattcattcccaaaccttcaagaagaactggttctccaggaaaatgtgccatgattatactgcagcttctagcattccctgtgaggctctgggctgtgcacctctaatgctggaaagtccaaatccaggagactcgggtctcctgagattccttggccatctgttcattcatgccatccactcactgattcagggcccagaggagcaccagggttaacggctggcggctgagtcagcagctctcaaggcaatcaccttttccacctactcatgaatcactaacctgctgcccccttgctacgtgcctggaaatgcataaatgtgcttaaaataagtggtacctgggtagcaagtttctcaccagcaggaaccagtccaagtgagtacagggcaaatagcagtgcggggtgaaaataaagactgactaccactggcaacccttggtcactcttcatttattcatccaacattgctgaatatttgccctgtgcaaggctccatgccctggcaatggggggcacttgaaggcaaataagagctttacaaggctctaggagatgtcactagtattccaaaaaccctaacagaagatacaaaagattagtgccattagagaggaaatggggtagaagctttggttggggggaagctcattagttagaggagagagatgttacttctaacttagaacatcaaaaacagaagcttcctggctttagccccaggccatgaagaatgagtggaatttcaggatacacagacaagaaagcagaaaagataaaatgaactcccacataaggcaggagataggggtgactagttatgtgggttgcagcccaggaacacagggaggaatgatggagatctttgagcaccaagaagagaagtttggactttttgttttcctttggttaatgaggagccatgaaagagtatttgtggaggaaagtgaagtaattagctaacatttagaaagtttaagtgggtagtaagatgtatgactaatcagaaatgacagagtcacgagaccagctggaagagtactgcaagagtccaagcaagcagcaatggaagcctgaactagaaaagagacagcagcagtggagaagagttgagccacgaggatttggcaactgactagagaaggcaccaggagaagcaagtccctgaaaaccatgctgcttgggaaagaccaactctttctctcatttcctcttagggaattgtaaaaggaattccctatcaccatttaaatttggttaaattcaccaaagagtgatggggtgaatcactctttggtgactaacccctctggctcttgtgtagagctaattagagtttcttctggaagatctgaaaccaccaacagtgagactcctcagatgaccctgatgggcaggtccatgattcaatctgtttcttccagcatctccccactggctgcagcacatctaggggttcaacctaagggagcccccctactctgggtatggttagagctcctttcaagatcattctaatatcaaaagagggaatcttcaaggagccttgttggcttcttatacttagagagaaaccaagaacacagtcagagttgatgtttttaaataccaaatctgtatgcatctatcagagagacagagagagaaagagagagagagagttagagagagacagagttttgaaacatggagagagggaaagagagatgttcctagagagagagagagagagagagagagtgtgtgtgtgtgtgtgtgtgtgttagagagggagagagacagagagggagagagagagagagagagagagctttgaaatatgaagagagagagggaaagagagatgttccgagagagagagagagagagtgtgtgtgtgtgtgtttgttagagagggagagagagagagagagagagctttgaaatatgaagaaagagagagaaagatgttccgagagagagagaaagagagagagagagagagtgtgtgtgtgtgtgtgtgtgtgtgtgtgtgttagagagggagagagagagagctttgaaatatgaagagagagagtaaaagacagatgttcctatgaagccctcagctcctaaccctctctctggctcagtgtttgaagcccctccagccgcccatggcaaaacttccttccagaggagcaggccatgcatcccagacccatgtgtatgctgtcccctaagaatgagagcagtgctctgtttcccaaatgggcaggggaagcaaacttttgtttccatagtctataaaacatttttaaatttaaaaacaaatgctttgcagcctctgaattattagttttttattaaaaatacaaacagctctatggaacaccatgggaaaatgaggactcttgcaacttcgtttggctccctgttaaacagaataatgttcatgaggaagaaggtactgtttgttccttaaaatgttgtattgcgtacaatggagaagagcaacgtggagatgactttccaatgtgttcccttgaaatgacctgaggaccgaatcaggaagctcagtctgaccagctcagcagactacccccactgccccatcccagagctgaacttgcagtcagccctgataaaaatctctggactagaaccagagcaccaatatcaagggattatccatgaactgactgttctttcctgcaggcaggctccacgctcctgggtggccagagtgccaatcagccctgtcccagtgctctaacgaggtgcccattcactgcccaagagacaacatgcccaagctatgacccagctccaagatctgaagggaccagactgccttcctgtttttctctgcatcccctgagctccctcttgaaaagggaaggaaagctaacagaaaagccactttctcacacacttttggtgagatttcatgaaagctgcatgacctttctggaaagcaacttggcaatgtatagagaatcttaaaaaacatgtgcatcctttggcccagcaattctgcttctaggaatctgtcctaaagaaacaagtctgtgatgtaaataaaaatggacatattcagttcttgactgcagtgcaacctgaaacactgaaaaactgaaaataactcagaggaccaacaatagggagatggttaagtaaactgcagtgtatctacttgggaaactaatatgcatcatttaaaagcatagcttcaaagaattattgataaaacaggaagatatttatgtatgcatctaaatgcatagagaaaagagtgacataaaacattcaaatatgaacagcaatcatctctaggatttaactgctgctttcatttttatttgattttattttgagacagggtatcactgtatcacccagccggcaatgcagtggcacgatctcagctcactgaaccgcaaccccctgggctcaagcaatcctcccacctcaacctcctaagtagctgggactacagatacgcatcaccatgcctggctattttttttttttttttgtaatttttgtagagatggggtttcatcatgttacccagggtggtttcaaactcctaggctcaagcagtctgcctgcctcggcctcccaaagttccaggattagaggcgcgagtccccccactcagcctgctttgacttttatgctctttttattgtggcaaaataaatatcacataaaatttaccattggaaccacttttcctttttcttttttttttcttttctttttttttttttttttgtagaggtgctctctccctctctctctctttttttctttttgtaaaggcatgatctcactacgttgcctaggctggtattgaactaagtgtctagttctatagcacgaagtacattcacattgtggtgcaactatcatcaccatccacgtccagaattttttcatcaacccatggtgaaaccctgtaaccaaaaacatctccctattccctccacctccagcctctggccaccaccattcgctttttgtctctgtgaatttgcctactccaggtatctcatataagtggaatcacacagtattgtgttttgtctttttgcgactggcttattccacttagcataatgtcctcaaggtgtgttcacccatgttgtagcatgtggcaggattaccttccttttcaaggtagaataatcactgtatgtctatgccacattgaacggacatttcagttgattctacctcttggttactgttttttgttgttgtcattttgttgggttttgttgttgttgttgttgttgttgttgttgttgttgtttgacagagtatcactctgtcacccaggctggagtgcagtgatgcaatctcggctcactgcaacctccgcctcccagcttccagtgattctcctgcctcagcctccagtagctgggattacaggtgcacaccaccatgcctggctaatttttgtctttttagtagagacggggtttgaccatgttgaccaggctagtctcgaactcgtgacctcagtgatctgcctgactcagcctctcaaagttctcggattataggcgtgagccaccatgcccggccctacctcttggttattgtgaataatgctgttatgaagatgggtttgcaaatatcgttttgatttcctgcattcatatcttttggttatataccccaaagtggaactgctggatcatggtaattctatgtgtcatattttgaggaactgccatactgttttccacagtgaatgcatcattttacattcccgccagcaatggacaagggttccaatttctccacatcctgtcaacacttgttgttttccaacttttttgataatagccatcctaatggatatgcatttttatgcttttatgtattttcagaatctccttcgggaagcatgtggtatgtttataataagaaaaacaaaaattaacgttatgttttaaaactgtgctagggaatggctcactggatgttatccactttactcctcaatgctgctgggctaacagtcctcctcccaccctcagcaaggcacagctaaattctggggatcattagttgtcaaacaccaactctatggcaagtggagtgcaagaccctacaaccttatggggctgatatcataacccaattagcacaatcccactgctgctgcttggaggcctggttctccttccatgagtgttgctcctttctccccactcctaccccccacttcaagctccaagcgatgacaggagtatagaaaggaaagaaaagagatttggggattcacacagtcctggggtacaatcgcagctccacagttgctcagtgataagataagcaatgtcaccttcctggacctcagattgctcatctgctaattgggtgatggtatcaggttcataagtttgtagggtcttgcactccacttgccatagagtcagtgtttgacaaataaggatccctattcatttctggaattgtgcatagcttctgccacaggaagaaatacagcatacctactagtaaataccacttaattgactgattgaaagaaacccgtcactgtgaggatcccaattcaattatttatgtcctctcctggaagcctctatggagtgcaggtttctcaaacatagtcctgttctcttctcctcaaacaaaggatctcaggatcaaataagcctgggaagcacaaagattgttatcttcaaaaacagcaaaagaataataattaacatatgaaaggtctgtaaccaagaaacctatgtttctctggcaagaccctgtctctacaaaaaaaaaaaagaaaaaattagctgggcatgggggcacacgcctgtagtcccagctacttgggagcctgaggcaggaggatcacttgagcccaggaattcaaggctgcagcgagctatgacagcgccactgcactccagcctgagcaacaagaaaggccctgcttctttagaaaaataaaaaaggagaaacctatgtttctgaaacatattgaccactgaacacctttttggcataacgccaattaacaacacatggagatgactttccatgtggaaacacatggaaataacatatctccaacacatggagataacgccgattaacaacacatggagtgagcagtgctgctccactcctcatccgacctgaaacctggaagtctggttcctcaaggacatcgagccttgaatttccacatgcaaacacctgtgagtatgttggggctgctgcagatcagcagtctcaaaattcatagagcatgagaatcaccaggaaggcttgttaaaccagcgtcctgggccccagcctcagtttctgattcagcagctctgggctgggacccaagaatgtgcatttctaacaaattcccaggtgatgctgatgctgttgacccagggaccccattttgagaaccactgatgcagacagtcaaaaacccctcacatacaagtttaatacaggaccatacaggaaatctgtctactttctgcaatgccaaagaaatcaagtataattcagaacttgaaacatccattctcttctgggacaagttcttaaaggaagcatttcatagtagttaagaaaatggactctggagtcagaaaagagcacgtttgcaagtcccagatctcccagtgcctggctgtgtgaacacagcaagttattaaaacttcccaagccacagcctctttatctctaagggagagaaaatcatggcaatgcctagttcatagaatttctgtgatgcagaaataaagcaagcaggatgcttggggaatgcctggcatctagtaagtgctcaataaagattggttattctttttaatgactgttatttaatcatcttatctggtaaatagctcatctgcgtactgtcagctgacctcaggatgtgactatacagtcgtccctgtcatgggcgaatgcaggctgatggcacaggggtaaaagaatttaccaagaaaatcataggtcaagaaaggcagatttattagagaaagtggggaaatatgttgcctgagagacaatgggcaagttagcctgagagaagctaacttccagaagacaaaagcttgctgcagattttagagaatggaacttgggctgattgataatgccaaggcagcagggagcttaacttgcattcctctgtcagcctggatgtttgataaattgaggtgtttgatggtgagcaggaagcccgggagttatgtatgttatccgggcatgaaggccaaatgtcttgggtcatatatcctgggccatatgccctgggccacaaagaaaggcagacctgtaacttatctggtttctcttttgtttaaattctctggacgtgaagaaaggcagatttatagcttatctgctttatctcttgctttcccctggtcccaccagcctgactccttttccctaattaggactccacagtccccccttatccatagtttcacttttcattttttcagttacccacagtacagtacaatgaggaatttttgtgctctgtaatgagacagagcacagtcacatgacttttattacagtatattgttataattgcacaattttattattcattactgttgctcatctgtcactgtacctaatttataaattaaactttattgcagatatgcctgtgtaggagaaaacacagtatatacaggtatcggtactatccatctgcagttccaggcatccactggggtcttggaatgtaacccctaaagataagggcatctactgtatttggagacagggtctttaaagaagtaattaagttaaaatgaggtcattagggtgggccctcatccaatataactggagcccttataagaaaaggagattagggcacagacttacactgagaagacagtgtgaagacatggggagaagacagccacctacaagctaggcagagaggcctgtgatgaaaccaaccctgtcaacaccatgatcttggacttccagatagtaaggactgagacggtatatccgacttgagccttaagtccaagccaccgttccactattaactcccaccaggacaagtgcagtggcctgaggggcccttctgcttccactcctgcccttactccctggccttactgttacaagagtgaacttcaccagtgttaaccagatcacacgcgtggctgcctaaattcctccaatatgtcacctaatactgagaaggaaatccaagctcctcaccatggccaacaaagccctgaaaaacggcccctgccagcctccccctacccagcatttcccccacccccaccatcaccacctcatgccctaaactccactcagagtggcgtttttgctgtttcagaaacaagcaagctaatccttgccaccaggcctttgcactagctggtgctactacgtggaacgctcttcccccaaatttcctcctggctggcttcctctgagttcaaatgtcttctcctcggagaggcttttcccatccatcacaaagaaaccctcagcatcatctcacgctattgtcttcctacaagttagcagtagcttatcactgtctccctgagagcagccaccgtagctatcgaatgcactgctgcctcccgggagcctagcacttattccaaggccttggagcttagtaaatatgtgttgcctggataatgtatgtgaaagagctttgcaaactgtaaagtgctgcataaatgtaagataatgtcacaaatatcaaaaagagccagccaaataattcaaagaaaataggaaacaaggggagaagagggatgaggaattcagaatgaagctgagagatttcaagtgatgattcaagaaataaaccaagcaaccaattttgttaaatatgtgaggccacagggcgagggaagcacaaaccactccaatgatccattcaggccatgtctgctccactcagccatagaaactgcataaattacaggcagcagcagttttcctggagccaggcagtagaacactctccttggtgccggcctgggaggaggatcctggcctggcaagcagggctgactcaagctcattgcattagccctcccctcctgcatctgggcccctctcaccgcagtgctgcctgcccaggacctgcactcctccagcgggcgggactgtgactcacagatggcctgtcactcccagtgccagcacagagcaccacccgtgcctatctttagaagtttcgcaggctgaaaaatcaatttgcccgcctggcacctgggtctggggcctccccgctaacatcagtggcaggcgaaatgtggcctcccctctgcctgccctgatgcgtcagaccttactcagggtcccgagggcctggcagtgccgcccaacagactcctgtgagctgctgcacccacaggtgtgctggtctgcccctcagagatagccaggcctcaccagaagatgcgggcaaacaccacgccctagaaaatactggcaagggggaagcgaatcactttgcatcctggctgcctgactggcacattccccaggtggtcatctggcacctaatccatgtgtggtcacagcaaactggcttgcccaggtggtacaagttcagcctcttcctccaagcagggaccagaggtaagagaacagcacacaactccacgccttaataaaaaggcccaggaggcagattcccaacgcagtgacaactcccagctggcccccaggcttcccaactactgaaaatggccacatgtgactcccacaagccaaagggaccctgtattactgggtatgcggagagagaaccatctcagacatttcaccatattaataatctctctttcaataaagactcgctgagcacctggcagtggcagggtgggtggaatagggtaagaataagctgaggaacaagagaaaggaaatctctggccctggccctgtactttctccttgcacctgtgggcgctctgtgctcagcctttgagatttccaaatcccctctgaccttctgcctcttcactcacgtctagacaccatttttacagaaaccaggagctactgcctgttttgtttttttttgttttttttccagtaatacagcctagggccctgcccaccccacctccttttctttatgagatacagtgaagtccagctgtcctgcagcagatgaaaacagagagagggctctcacccgctagctctagttgagaaatgagaatgccccagaagagcttaagggctcaaaagccatctctgagaatttgcagaagcacaatcctacatgtttgcttccttaatccaaaaaaggatccaaggtcatgtgtctacaggagccagcctgttacggtgagtgaggggtgctgcattcagcaccgggggatgggggggaaaggagagcgtgcaatggctctgcccaaaccaatcatcaccatgaggggacacaggcacacaaaggtacattttcaatcttttattttttcaaaaacagctagcaatccagatttttatccaaaatctcctttgtaaatataggcaattgatgaaaaaaaaaattaaaaaacaatgaagccacatgggctaaaccaaacacacctgtagactgccagtttgtcccctctcataggtaggatggggtgactgaattctggggagcacgttcagaggtcgctatctttctctgcttctccccagagaggtcttcctaggctgcctctcagacacacagcaccagccagagggcaaggaccaactgataagccaggaagtgtggctcccatcactttgaggagggaatcaggaactctttggaaacccctgctgtacaccttgctggtgccatttcccaaatatttgtggttcacccctcggctttcagtgtctctttccttctctgcctccccacccagggctaactcctctccttcctgaagactctgttcaagcatcagctcctccaaagagctgcccactaagcagtgcccctccctccagcccctgggctgggaggcttcccggcacctggcatatcatgcactctgcatgcccacacacaacttccaggcacttgattgaccctcactagcagggagctcctcaagagaagggctggttctcttccatccctgttatccctgcagccagcgcagatcttggaacacagagcagctccacacagaactgaaccagcaacttctccaggagcaaatgttttctgagcactggcctataccaggtgcatgcgaagggtgcataaggccactgagatgaatttgacatatccaggggcttcagaggatcacagtctcttgggtctgacagatgtttaagaaatccccatcatgtagagtacccacagcccacccccctactccgccccgccacagccaccctcctcccatccttcctgggtcttggccacacttgctcttccttctgcctgcaacatggccctttcctgaaatctgctccaaactccccttaacaaagagctttctctccatgcaccctccatagcactattttttcccattccctgtttcatttgtgcttgtgcacttatggccacctggcttctcctgtttccctatttgtcctgtctgtggtctgtctccactactagacctaacccaatgagggcagggcctgcatctgcttcgttttctgcagtatgcccggtgcagaggacagcgcctgacccatggtaggtgcacagtaaacagtggttacccgaatgaatttaagaatgagaaagtaagatacgttccaaaagctctgcatgctgcaaaggcctctgagcctctatatgctgagaggcagctggacctctgcctcctcctttgcacggtgggcagagcacctgcagaactttccacttctcatgcctcatcatgtgtctgggctccggctccggtgctgcaaagcaggtgaagggccccctgtgcaagtgtaagaggctaaaacgggggtgcctgtgtgagcggctggtgtggggtgggcacctgccggtgtacgggagactgaagggtggagagggcctctcatgcaggcatgtgtgagcagctgcaggtgtgtgagcaaatgtgcatcactggggaacaggtgtctgtggatgagggaggaagtgagggtgagggtgtttgtggacatagggatgtgtgttttttacaaaaaaaaaaaaaacaaaaggtgaggggaagccggcctgcatacatgtgcatgcatgtgaacatgcgtgtgtgaatgtggggaagggcgcattggtgaaaaaggtgctggtgctttttctccctgatgcaaactcaggctggagagactgggactaggcagaccctacccttggcactccaggaagagttcctccctctatgaagagctgcctgacctcattcaaggtgtacagaaagaaagcagtgtcaccggaacccaggcctccaccataaatgggccagaggcaattccacagcagtaaccgggcaggcaaaaccacccctggaaaacacaagctgacacgaaggatgagcctctcaggccccctgggcgtggggtccctggaatccctctgtccctggctcctagtgattttacaccaaggctgaacacatagatttgaggcaccagtgcagtgcaggacatgggcgtgttattaccagctccatggttaatgagcattgcatccactgggagcagccaggctggggatgctaagacctgctgggtggttctgctgagttggggctcatggggcaagaaggccagtttctgccagcccctcccagcagcagtgagacaaggacacagacactgaagggcccgtgttctcagcctctccccctccgactcctgcccatcttcctggtcacatctcctcccaccgtctgccttgcttgctgagtccatgcatttgttcatttccccattcaacaaggaggtatcaagcaccactatttcccaggcacattcctagggtgtagaactgaaaaacacaggtaaagtactgcctccatgcaacagacattgtagttgaggaaacaggcgataagccaaactgataagagaaatataaggtgtgttaagacaaatataagatggtgacaaatgccccagagaaaataataaaatagggaagggaggcaggaagaggggccgttaatcagggtagccaaggaaactctccagcagccagcctcgttccctccccagaggcttcacagctgctgttccacacacctgaagtactgttccctcaaagatcccccatagtttccttttccaggcaagttgatcttgttccactcattggccacttccttagaaagaccctccctggccaactacataaaacaggttccccattgcactcacatcactatccccttagcctgtttcatattctaaaaccagttctcattatctgaagttagtttattatttatttactatgtttctgcctcccccagtgaaatatgaggtctcaaaggagagaggatgtgtgtcttgctgaccactatatcttcagcacccagaacaggccaacacatggcaggccctgggactgaaatttcatagtccacttcttgttcctttgggttaagcaatgccctcccccagcatccatttaaaaatactctcaggcaagtgatacatgaagtcatgaacactctagtatgaatccgtcacttctctctaggggctgctcagaaatctaggagcacgtgttagtactgagggaaggggacagggccgaaggaagaagcccacaggctgcctgcccaagcacaggactggaagggaggaggcctgggtgtggtgccagctctgtccccagcttctgggtaacctctctaagcatccgtttcttcatgacttagagctgagagggagctcttggtcacctatgctttggggactccagcggggaggaaatgagtcaattaggaggacatgaagttggctgcctcctcactttgccatcaaagacaataggtctatgttctgatccctgcctcagacaaaatggagaaaacccaaagatagtgggaagccgcctgcactgtatgaatgcacgcttggagaagactgtctccctgctgcccagcacccactgtccacgcatggttactattagaaagttaatcatggaaaatgctgaggtctctttccccagccctgcacctctcagctccacactacaatttcatcttccatatagtgttaccagacagtgccattggctccgtccactcacttgtcccaggcctttatgacctttccattcaagccacacaccacgtctgctccacagagctgtaagacacactggcttcagcccgcctggcctgggccagcacgctgacattttccatgagtccacatcagccagtgaaatgctcagaggggattaaggcaaccttctccatcacccccgagttgctttaggaaagagaataacagcactgacccctccattggcagctggtgatatccacacaccatctctatccagagatgaaaggctccttctccatccttgacttgcaaaacagggattatttcccacctcacgctttctgaaatatcaccaaagatgcagctgtgtttgaaggccagcctcataaaaggcgtaggacccacgtgtcagtcaacactccactgagaagataattgattttttttttgttttatgattatttgcgggcactggttctctttccattagcctggataatcgagggaagactgtaaagagtattaatatcacggccaaggtcactcagctggctcctgctgccattccaacccaaaggctgaattactatggcttttactaataataacaagaacaataaataacatgagtgattataaagccagggaactctgcaattacctcaacaattaacacatcccttcgtgaaacacagaacagaaaaaattttcaaaggttcaagttagaaaacttctgcattctgtttggtgcaagtgacagtcagaaaagggccttgtttgagggtatgcagtgtgagagtatgcagtgtgagggtatacatgaggtctgcagtatgcagtgcagtgtgagggtatgcagtgtgaggtgtgcagtatgcagcgtgagggtatgcagtgtgaggtctggggtatgcagtgtgagggtgtgcagtgtgaggtctggcatatgcagtgtgagggctggggtatgcagtgtgagggtgtgcagtgtgagggtgtgcagtgtgagggtgtgcagtgtgaggtctggagtatgcagtgtgagggtgtgcagtgtgaggtccggggtatgcagtgtgagggtgtgcagtgtgaggtctggcatatgcagtgtgagggctggggtatgcagtgtgagggtgtgcagtgtgaggtctggggtatgcagtgtgagggtatgcagtgtgaggtctggggtgtgcagtgtgaggtctgggatatgtggtgtgagggtatgcagtgtgagggtgtgcagtgtgagggtatccagtgtgaggtctggggtatgcaatgtgaggtctggggctggctccagttggtttccaactttaccaggtgtgtggcccgggcaagtcacttcatctcagcaggttcctgcacataggggctggtgaggactcaaggataaggcacactaaagggcttggcacagtgaccagcaggtagcagcactctctaagtattagctgccattgttgtctttatcattaatgtaactacatcttaattaggaatgatgggatctcatttggcccccacaccaatccaggaattgagatgagaatagtgtttcctctaccatccatcagccaatatccagcagccaccccaggggaggccactggtcatcccacgccatataaagttcactgcccctggatggtaggctcaccccaagcctgctccctcatcctcattcccatcctcaacagagaggaaagtccaccactgtctccattttaaagaggcagcctgtgacatccaagagaccttccagcctcagggaaaggcgtgaacaagagctccagctgggtctttacagatgaagccccactttggtacctcttctcctaacaaccccagcttttggaagacatcaaaattccaaaggctcagctgcagaaagatcttccaaatttctcattatagttattccctgaaaggccaagagctttattcttcatccatttactcaacactttcatggagcaactgctacgacgtgtcagcctctgcaggaggcagctttaaactaagtgtgacagatgagaaagaaccataacacacaaagcagggagaacagtgattccagccaaagaaaacagcatgtgcaaaggccctgaggtgcataaaatttggcatgttctctgtggatagggttctaaatcatgtccaggacagggggacacctttgtgtcaccctcatctgaaagcaacctttaagaagccacaggacagactgtcttcaactcagaaaacctccctgatacccatcttccatcctccacccctacattctcactcttgtctggtttcctcagttaccatcctggtgcctaatttctggtggcagcaaagtgcaagattagaggcccacacactagtgcccggaagcttgggcttcaatcccagatccgccaattatggcttcagtggtttggggcaagtgatttaactgcctctctgtgcctcagtttcctcatctgtaaaccatggataacagagaacctctttggagatctgctgtaaggatcggacaagtaaaaagaagtgaggctcttggataaataaatatctaaggcacatagaagttccctgaaaatgtgggcattatcaatatttattttaagcatcatcatttttcttattatattccctttctccatctggtcccttgagagtgatgactcggttgaatgaatgacacccaccccagtttctcaccccatctcccaacaccaggatccttttgcctagtgggtggttatcacttagatgtgcccatccccaaacctcacttgatatagtgatttctggagaccctaagaggactcagggaccaggcacggtggctcatgcctgtaatcccagcactttgggaggtcgaggcaggtagatcacctgaggtcaggagtttcagaccagcctggccaacatggcaaaacctatctctactaaaaatacaaaaattagccaggcgtggtggcaggtccctgtaatcccagctgctcaggaggctgaggcaggagaatcacttgaacccaggaggcggaggttgcagtgagccaagatcatgtcactgcactactccagcctgggtgacagagcaagactccatctcaaaataaataaataaataaataaataaataagactcaggggacttcctgcacattcccatgagccatgagccatctccaacaccttggggcagagtaggggactctatgactccactggggaaggggtcctgcaatggggcctgagatgtgctttcccccagctgacactcttttccttatttaactttttcaaaaactcccccaaatgttttgccttttcatttgcctcgcctcctccttaacactctccacctgccccaaaatccccagtagtttcaaaattgaataactgtcgggaacagcatttaaagatgctaatttaaacacacgtgtcagaaaaggcaagctggatccctgctcctagcaacagcccctcacccacacctcacagctgctgctgcccagaaacagggcttgcttgagtgagctggcaggggggccggatacagggaagcagagttgtgggacctagctctgagcctgcttctggcctttccccttggatggaggtctttatccttgcagggcagccttcaaaggtgcaaactctgccaagctgccaattcctcaagaaaggggtcttggggcaaccaatggtttaagtaaacccattgtatcacattttgaacatacagaactgctaacacagagacctctaatttcctttaataaacccaaactcttccatttgagtaagcttcatacattaaatagcaacacctactgttaaagcataacaagtctcctttccatttttcacatcataaatgtaagtttgggtcccatcaaggggcagattcctctaagtgccaatgtaaagtgccccctcctctatgtagtcctcctgaatgaccctccatgccacaggtgggagtggtcttttcctcccctgaactctctcatgctcttcccagctatctttcattgtagcaagatcttggtcaagctcatgcatagcttatctccacttctagactgggacatccttaagaacagaagctatgtcttactcaaccttggacgtgccccccccccttgcaatcacaccacagaaccgcatagtaggtgcttaataaatagttataaattattaacatcagtcaccttggagctctccaatttaaagaaacagttttttaaaaatatgtatagtaagtagacactgccccaatagttggtcccattggtaaatatagcttttcatgtgttgggtttgcttcaaatggaggtataaaaacacacagaaagaccaagacagaagctaaaacatagggaatgcaagcctggtaacctctacctgggagagaaatttgcccaactgggcaatgtgcaggcaaggctgatgtcaagggaagatgctggagaagagaaatgctactgaaagagcacgcaagtgcctttgcatctccaggtaagtgcttatttcaagaaagtgtaaagcagctatgtttcttgatttggatgttagttccatgggtgtgttcagttttgaatatgcatatactttgtggtgtgttcaagttttagtatcatattatatagttcaacttgaaaagtaaaaatatttgtgggatctaaaaaatcaaattagagtagaaagagagttaccagaggctgggaaggggagtggcggattggaggggaggcaggatggttaatggatacaaaaaaatagaaagaatgaataacacctactatctgataacataatagggtgactatagtcaataataacttaattgtatattttaaaataacttaaagaatgtaactggattgtttgtaactcaaaggataaatgcttgaggagatgaatattcactctccatgatgtgcttatttcacattgcatgcctgtatcaaaacatctcatgggctccataaatctacacacctactatgtaacccacaaattgttttaaataatttaaaagcttttttaaaataaatgactaaacaatatttctcacatggaaacttatcctcgatgtccaagtgaagttattgtgagaataggggttgtggtgcaaaaattcactctctagagaacacagctgttaccacctataaagaaagcgaggtctccactcacaaaggaaagcagcaggagtatgtgagatgtcgaaggagaacgtggaatgcctaagtaataaaacagacacagaaaactttccatccccacggtaagagaagctttggcagagtttgctcttcagcctcagaccaacagagctccagcatccaaatgctgaagaagccaagaatgtgcaaactatgctctctcagaataataagaagaagaatattcccttctcctctgggactcttcaaatgttttgaagtttctgacactctcaaaaacatgcagaaaccgcagcctgaatttagaaacctcagcatggtggtatgtgtggtatgagttccaaattctcgacagccctagaaacctgtttctagaggagaaatgaaaataccaggcacactgatgcagcttgtgggttgctttattgctttatttagggtggcagctcgggactgagggacctgggtctcattatctatcagctacctccccactcacattttctgcaattgacatcatgcacaatgagagccacctagctggtaagagaaggctctaaagactactcagagggttatgcgggagggaagaggaggaaataatatgagcccatccacttcctctaaacactggggtcgagggctgtcatggatcacctgcacggatatgatccccggcctccctcagcaccagcaggctaagccgctgtcactgcctgaccccctaacccagtcaatacccaaccatcaagatcacagtcctcaaatgagctcactttcagtaaggtaccgtgttcgatttttctttggacaattttatctggacgatatctaccatgacttaattttgtagccaatgtatacacattaaaataagatgaaaacaatactttctggacctcatgcagttctaattaatataattccatatggatttatggataccagttgtgttctagacactgttgtaagtccttggaatcaggcagtaagaatatgaaaaaagagaccaaaatgagaattatctccagaagagaaagcacatccagcctggaatatgtccttacaggttggaacccgttctcttccagatgccttgaggcttctttaactttactctttctcataaccacccagaaagtgcagggttggagactcaatggttgatcaatacatttattgaatgaaaatgacaggccctacaagtagtttctggaagccctgccaacattttcccaccctgggttctggtactgctcccaggctgtgtggcattgactagagtgcttcaacggcccactggccccacacagctggtgcctggggcccagggtggatccatgagtttgggcaactcctcctcattcctggagctcagtttcttcatgtgtaaaatgaaaggattgaagaagattgtctctaatttcccttccaagttctagcattctgtgatgccatgtgcaccccagttaagtgagaactgccctttgctattcatggaggcaaaagatgtcaccctcctcctcgttactaacatggccccatcttgtccaggttcccactccttctccacagtgtcttgcacctcagataaactgaccccattccctcaccagctggtgggtcctgtctagtttacatcagggcattcccattctattgacactgactgatttggagccaggcaagtggcctggttttggtcaatgagaaaaatgggagaagtatcgggggctttggagaaagattttctctatatataaagtcctcaccagaagagatggtccctgccttgactctggacattgccatgtccagatgtgatgtccagaaccactgcagctatcttgcggccatgagagaaatcagacttggtataaagctgtcactaaggacagtagggtgaagaaaagaaagggcccagggcctcatccacatcactgaaccactgatccatccatagtggagcctttcctcccccaactctgttctcttatgggagatacatttccttactgtctaagccaatttgagtcagtgttcttgatcattagtaatcaaaagcatctaactaatgtagtggacccccaatttggaaagaatgaaaatattctgaaacactcaacactaaaactactgtacacagttgaatctttctaatgtctgagaaaatgctctacaacactatctggatggaggttaccctttcaaataaatgcctgacatcctttctttctcaaaagccaatagcatccagatatttgcacttttcggttgcttggtttctagacaaatgttagtggcccgatcattcctacaagaaatggcactgacttgcccttctccatggagacgatgagcacagccatgaactcaattcaaagagcagcagaagagtcaaaagtggcaccttgaaactgaattctctgttgtgttgattttctgagctttcaaagtgttattcatttttttctacctgtgaatgaatccttgatttctcaatctgcctactcgctgagatagatttcagcaaaataacagtagacatgggtttccttctcctctctctctctctctcttccccctctccaacttcccatcctccctctccatatctccccctctctaattcaccaaggtaacaaaagaaacaataattaagtcaatgagcatgctcgcatgtgcaacaaaaaatacctctcttattacattgccatttccttttcaaatcctttgggggcattgtgtacaaatatagtaaacagcattagagggaaataatgccgacacatacttctgggagctcgtcatgtccctttaagacaaggcccactgttcagttccattctaggccacagctcgggtttcaagcccaaggtccccttactgcctcatgcagtattaatatggccctggcatactcccaaatttacattatgaaccataatctgggccagctcccacaggacgaactggcttggggctcccctcttcatttccccagagggccttctccccatccatagccaggccacccccttccccagggatcccccactttcagcctcagccaggggaacacacaagtgcttttcaacaagtagttaattccctagcatggagtatcatctgtgggggctgcttacacaatggcagaggaattgcgctgtcctgcaggcagtcacagggggagaggggaagaaggcactctcagacattagagccagagccaactcagggtcacttctgtggcaggcctgaaagcaccaccaggatgtccaggccaggaggtcccatgggcatacccagatctgctgaaggaggcctctctgtctcttctctgtgtctcttcctctctctctccccagttataaccagaaggcaggtgcaatttctagaagagcccataaaccatttccatttattaaaagagaaagaaagagagagagcgagagagaggtgaggctggtggggagtgaggaggaggcacaaggaaggagtgcagaggggaggcaaggcaaggaaagaacacagggtggagggtggctgagtgggccctggtgcagccctcatccccaggggctggctcgggctccatgctgtgcgcacagcctccaaccaccatcaggaggctacaggctccatccaggatgttgtctatgggactcctgtctctgaggcaccatggggtgtgttggggagagactgcactctggacagcctgtctgggttcaattcccagaccctctactcacaagctgtgtgaccttgggtatgatgcttaaccactctgtgcctgcatctcctcatctgaaaaccaggaccaagaagagtgcccaccacctggggttgcttgtgaggatggaaaacaggacctggcacaaggtgtctagcccatgcctcagagcttgcacccaacagagcaagtaacaaggtcaaggcaacaacagagggtggacctgaaacacatcctcaagaatccagcaatttcctcaataagttaaacacagcattaccataggatctagcaatcccattcctaggcatataccccaaatcaaacacaggcctggcacagtggttcatgcctgtaatcccagtactttgggaggccgaggcaggcagatcacctgaggtcaggagtttgagaccagcctggccaacatggtgaaaccctgtctctactaaaaatacaaaaaattagccgggtgtgatggcggatacctgtaatcccagcaactcgggaggctgaggcaggagaatcgcttgaaccaggaggcagaggttgcagtgagctgagattgtgtcactgcactccagcctgggtgacagagtgagagcccatctcaaaaaaaaaaaaaaagaaaagaaaagataccaacaaaagctcgtacacaagtgttcatagcagcactattcacaatagccaaaggcggaaacaacacagatgtccatcaactgatgtatgaataagaaaaatgtggtgtggccatgcacagaactaaaggaacggagtactgctgcatgccacaacacaggtgaacctcaagaacattatgctaagtggaagaagccggacacaaaaggccacatatcctatcattctactcataggaaatatccaaataggcctcaagaagcagcaagcagatcacaggttctcaggctggatggaggagagaacggcagtgactccccattggtccagggtttccatctgcagtgctggacggttctggaagtaagtagcacagatggttgaacagaattctggttgtatacttaaaatctcacaatggtcaattttatagtgtgtatattttaccataataataaaaaaaaagaattcagaaagggcacagcactcagactcttctcccctgagtcctctcacgtggtgaagagccaggcaaaagggttgagggcattgttgttatgcactaagttcccccactgtgttcctgccctcccctctttttccccctgcaccactctgcctgtggtttcccagctcacctctgggcctttcctgtgctattccctctgccaggagtgcagcccctgccaccccagcaccctcccacctcagccagcctagctcctctcagcccttcaaacccagctcagcccctgcctgctgtagaaggctttcccttgttaagatctcctcctcagggctcccacctcactccccggcacctaccctttgtcaaagcaccatgttctgtgcatgctagacagagctccccacctcagctgtaagcttcttccatgcaagggccagatctaatttactcttatacccttagagccgagcacagagaaattatataaataacaaatgagttaaaactacagactattatctagaagtcatgagataggaaagaaaaattagttatgaagaagggactctcaattcctagataacttaaccccattctcacccctgatcccagaacctctccagggaaaagaatgaggacaccccaagcagagagtgaccaggccaaccaagagcccccacgtgggcctttgtcaggaaagtcaggggctgaagaaccatgacatcctaatcccagtttggagtggacagcctggccttggattcagtctccgctactttcttcaagggagccaagtactaggctctccccacctcttacctcattcaaacctgcagaggtaaaagccaccttatagaggaggaaattgagactccgggaggtcaggcgcatgccccgacaacaaagctaataatgttcaacaccacaggcatctgaggccaaaacttgtgacttttaaattcgtttcctcttcctccagcagtgtctacatggttgcctcctcaatcttctaactaacacgagaaggccagagacacaggcaatgctaaaggacagatccttgtggtgctggactaacccaccgaatgcagctgggtcctgttccaaaaactcacttcaaacaatgatgctattgaccaggatagacagagggacaaggaaagagagatccttggggaaagacacaaaatgattcatctcagccactgtgctcaactacttgtgtggctttgagtaagtccaggtctctctggggctttttaatttttcccttttgtaaaaaaattgtctaagtctaacataaaatgcagtaaatcatctccaaagtctcttctagctcttaggttctaacactattacaactaacagcttccccagaaggatctagaaaaagtggccatcttgtccacattcacttagtgcaagtcacgcctagagcagacagcgttgcctgtgagggtgatgcagtgcacaaagctaagtcaccatcaccttttctctgggagcttcttataccaatgccccaaacattccttgtaccaggacagacacaaagagaaagatgcatttattctgctcccaccacatgttctataggagacctgtagtgtaggtctcagtagtactccaaattctgtcattctctcccatcttcctgatttctgccccgcctgcctgcctgcactaatattcagtgcatattatccttgaaatcaacttgaaattgtctcgattttttcaaattagcattgtcctgggcaataatatctgtgaaatcacgagctctgatgtactagttctatttttccacaagtgtattcaaatacacaactataataagaaattcgtctgtgtccctcctcaaagcatcttgcatcccaccagcattgaggtgtggcaaaacacagcagtagctcacttagtctccaccagcaaacctcttaggccaaacaaagctgtttcctaccattttagaaaaaccgagacttggggaagcaagcgttcaaggtgacgcagccagaaagcaccacgcggggcttcaaacttgggtgtgcctgattctaagtcccaagtctttgccgctcttgtaagcatccagcttgtctacagcagatgggggtgaatgaaagtcaagagattgtaaataatgccaatgacctttatcacctattctacttaatcctgtcctaagaacttgacagcaagattttccacgataatctgaaatgagagtaattcatctatgcataaacaaagctgacagccagcatactgaaatggacagaaggagagcactgtatgagtccagaccagttagctccctgggcaggtgcccctcacccacgccagcaaggtcaaggtttattcccactccaggcaacgctgggttcaagctgtcccagttcagaggctgtaccaccgaccctgccagcgctcctgcaaatgcacagcttagtcacaagggactccggctgtgcatgtgcgtgactcagcacacatccctcagccctccaaggaaaacaatgacaagagcacatgggatcagcagtgtcatccgtgaacacagaaacacccggcccttcatgcataaacccaccaaagaaaagggcttccaacctagcctggaaaattcaagaactggaagggctggtgctcaaagtcatctggtctgacccctcacaagacagcaaggaaaaaccagagccaagaaagaggcaacaagggacttgcccacgggcactcagctgtgtcagtccagggctaaaaggaagtgcccctacagcttcctgcagagtcagcagccccaggcacagtacttctctctgcccacgtggcactgaggaaattgccaattacagagctatgccctaaattcaggaatcaataaagtgtaagtggagagcccagttacccatatgaattcaacaacaacaaagaaaaatgaagaggaaaactacccagctcattatctctctgaagtgttttccagtaacaactcaatacgaatcagaaataatctcctacgagaagcagcaactggggggaaaatgcactgaactgtgcttggagaaagaaggggctggccatgcattccagcacgatgagaatccccccgtgtgtcacgcaatatgccaactgcaggaggatcccccaagcaggcgtgtgctaacacgtcatttgactccaacacgagatgactttgagttcccaatgatgtgcgcaaaagggacagattctccccgccagtacagtgggctctctggaccttctgaccaagccaggaagggaagaggttggcagcagatgagggactgaccagcgaatgaaaacacagcgatgccagatgcaaaggacactccttgggtgggaaggaggtagggttggtttattttttcccagactttttcactcatttaagcctggagaatacctccctccaaattttatccaagaaccagccaatggccaaaccccactcaaaagagaaaacatgaacactaaaatattccatgtactgaatatttttaaagcaaagttaggattttctaggtttgtttccatgggggaagagggtggtaattaaatgatttacagaagaattttacaacctcttcattttacagataaagcaagcaagacataaagaagcaaatggttttttcaaagtaaccctgatagtcaatagcagaaccaaaaccagaatgcaagtgaaaaaatccagatttgccaaaaccttcctattggctctatgagagactaacttctgagtccgggctatcctgatgatactgacagggtccccaaaagctatcatgcctctctgagtatgttctcttggcaacctgaaatcactctcttccttagctcctctaccatctgtaattaattattctataacttttattgaagactttctcccctgcaatagtagaagctctactattatgctgggaacataataaatgtttgaaaatatttgtagagtgaatgcatatgtatttctgacatatgaacactcgtgcattcaacaaaccagggctgaccatccagggcatgacagtgctttcatccctcagtgttgctaacatgcccagtgttgagacaccccaacaaggtcatactacacatgcaggggattcaacaaggtcagacacaaccagagccccaaggagcagagtctactgggcagactagccaacacacagaagcggctgcatgacacaggagaaagggcacccgtgaagctggagctccgggtctagtttcccttccctagtcaatgattacatgacttaggacaaatcatttaacttctctagaacttgtctgcttcatttgcaaacacaagccaaacaagaggaaggcaggcatcccgggaggaggaacagtaaatgttggaagtaaaagccctaaggatcctaatctccttgagtacagggaccagtctttcttcccgcatcccaccactcttccccagatttgtgtgccaggctctgcccctcccccacctccatcactgcccggcaagagtcaccaaactctgacagcattattcttccagccactgacctccaaatatccctctgataaaatcaaatcctaacaaaggaggatgaactccccctgcttaggctttgtgggagagaactgcctgttgctcattggtaactcagggcagaaatatcagaaggatgaactgtggggaggctataaatgtgtgactgttccttaccacctcatggccacctgtactgtctctatagagccaaagctctaaaaggtactcatttgtcttagctccatgcctgaatgttctactcctgattacagagggagaacccttccctctcttgctccatctatgccaaagctggcccactatgctgcttggtgctggcctctaggccagcagcccctgccaagggcacacttgagccaggcagccaggtaactccaggccaggcttccccctcagggcgttaccaggctcctccccagcttctccctagcctggcaaacatccagccctatgctcatcccagaaacctaaagataaaatcattaggaaaacttctagctcagagatgattattgctatgttatttataatagccaaacagcagaaacagcctaaatatcctacactagagaaattatggtgcagccataccaagtagaatgtagtcataaaaagggtttacataggagatgtttgttatagtaactgggaggcagaaggcagcatacaaaattggcagagggtacagtcagagctaaagaagttgaaataatttaaaaaattggtacaagcaggcttaaagaaaatgcatcaaacgataaccaactggtgtcctaggaagaaactagatacgaggtcctttctctatccacgtttatgtgtatttattatagcgaagcataaacattaccactgaaaagcatctcatttttcctgaaggaacctaatatactcaggaagatcagggatttgggcatcaaaagttctgggttcaaggtccaggtctatctatacaataggcacaaaaatacaggtagatggaaggaataagatctagtgttcagtagcacaacagaacgactacagttaataataatttactctacatttcaaaatagctaaaagaaaatatttgagatgttcccaaaacaaagaagtgacaaacgtttgatcaatgttctttctgtttccagcctacaatctatacctacaacccacagcctacaacccatacctaccatttacagctataacctacagcatataactacaaactaaaacctacaccctgtacctccaacttataccctgcaacctacaactgcaatctataccatatatacctacaacctataacccataatctacaacctatatctacaaccacacctacaaactacagggatgctataagggtcgtggagattcaccaagtgccaatctttacatgaatatgttatatgaaggtggcgcatgaattataatttcttaaattctacacacatgcacacactccagtagcaaccacacatcagttactaagcacatcttaattccagaaggacgctctaacatcccaaaatactccaaccagggctcaaaagtcaaaaggtcccaccattgactcctgttcatctaccccacatatctcaggactcatcagatttggtccaagaagtttattcccctccttccgaaaaatacggatggaagtagttataattcagttttttaaaagacagctattatcaaaaagtctgaaaataacaaatgctggcaaggaagtggagaacagggaacattcatacactgttggtgggaatgtaaattggtacagccactatggaaaacagtatgaaggttcctcaaaaaactaaaaatagaattaccatatgatccagcaattccactgctgggtatatacccaaaagaaaagcaatcacacagaagagatctcttcactcctgtatttattgcagcactcttcacaatagccaagatacggaatcaacctgagtgtccatcaatgaacaaatggataaagaaaatgtggtacatatacacaatgaaatgttattcagccatacaaaagaatggaattctgtcctttgcagtaacatggatggaacaggaggacattatgttaagtgaaataagccaggcacagaaagacaaatatgacatgtccttactcatgtggaagctaaaaaactatctcatggagcaagagagtagaatggtagttaccagaagctgggaagggtagtggggaggggatattaagagggattggttgataggtgcaaacatacaggtagatagaaggaatacgatctagtgttcagtagcacaacagggcaactgtagttaacaagaatttattctacatttcaaaatagctagaagagaatatgtgggatgctcccaatacaaagaaatgataaatgtttgaggtgatggtatcccaggtgcccagagttgatcattacacattgtgtgctcacagcaaactatcacaggggcctcataaatacataaaactattatgtatccataaaaattaagacaaagaaaggaaaatgcactggcatgtgtattttgcggaattatttggtttggcaactactctttgtctagagatggagtttagaattgtccctcaggtttgaggccacagttcctggcatctcggagcaggaggacgccagcatccttcttgttagaatcagacagcatgggctttcccagagcttacttcctgctgtggtctttcttcccagtgttgggagaattccctcacttcactgatcttcaatatcctcattagtgacagtaatgccaatatttttatcatttagaatgtgctagatacaaagctaagggcttcatacctacgaactcatctattctgtgcaacagccttactatgaaaataacattaggtacgttgactgcctcccccaggtagagatgaggaagtagaggcacaaagaggtgagtaacttactcaggttcccacagcttgtgggcaggatgttggggttggaattgggtactctgtctcccgcactctgatatgtctgtcagctggaagcaaaaaggcccacttcagaagtcattgactaaattttaaaagccaatgatctaaacaccatagtgcaccctcaattggtgtcatcactggtctcctccccagagctgccaacatccacacctttctctcaacagccatttgaacacagggagaacacatgattcaccacagccaatgactgggaaaaaccaaacacaaagctcaccgcatggagtgtgatgtcttgtgtcccattcatttcccagtgatttgcaggaccttgtatggtgtctgggaaaaatgtgtattgactttagttcatttccttcgtaggttcagcctcttattattttatgttcatatttattttccagagatagccctaaacacgggacatcaccagttccagtgaaatctccagggggagtacatagagccccaggacagacaggaactgtgtcacctaacccaacactcccaagacttctgaatgctcctagaaccaaactcctcttctgctccattgcttcccctccacccccctgctcctttaatttcagtgacaggaaatgccttccgtttggtccatcctatgtcatgcatcactgtgccaactcaggggacacattcttcagccacaagaacaccaccccagcagaaccacattgagcctacagtgcccacaccttgctccaaaagtcacatccttgcccccacccagggcccaccttccccaaaccatggacaaatgccagaaccaggcctgagaagggctctttcagagtccaagacacatgagcttccttggaaagcatcttccctatggaaattccccccatgactgcagaaaaattaaaatcactcagaattctctatttcttcttagagtttcagaattgacttgaagacacctaaaatcctaatctcaccaactctccatctcctcctctgcctctaaaggaagaaaaaaaaattttaaagaatggacctagcattgagaaacagagaacaatctattattgtgactataacaactcctaaggagccatcagagtctcggtggcaccgctggccccatcgtcacccaaatcatcacagtgggccgttcggactgcaacacgctgcctgctcctcccggcgcacattcttcctggctctccctcactgattttttggcagggctcagcaggaatggaatgggcttccacgcccgttatgatgatggatgggcaggctgctggtggagtggggcctttggggaggcactgtatacacacgcacatacacacacactcacatactctcacattcgtatactctacacgtactctcacacacactctcatattcacatactctacacacacactcacacacatccacatactctcacattcacatactctacacacactcacacacacccacatactctacattcacatacacactctacacatactctaaacacacacacatacactagacacactcatactcacacatactctcatattcacatactctacacactcacaaacacacatatactgtcacactcacatactctacactcacactgcatacatgtgctataccctacaccctacacatacccatacacactcacactcaaactcttggccagcagcacccaggtgaatccactgtggtctcgtgggccaggattctccccaagatccttggtcgctgaagcagccccaaacccgctttgtctgggtctcttccaactctagagctttcattgccatcattacccccagctggacttctgagtcaaccagatctgagttagaatcccagctccacagcttactagctgtgtggccttggcaaggtcacctctctgaacctcaatttcttcacgtgtgtcttggagaatgccagtactaaactcccaggctaatatggagtcctcaacagcccagctagatggtgagtcccatctatgatccatcaatggcaccccctcccccaccttggtccctctgccacagactccatggatctccttaaaacctaaggatatggagttaaaatctgacccaacagagggcctctatgaacctgttctcgtgccacaaaaggcatctaatcccattgctccctgcctgtgaagggctggttgtcaagactgattcaggggacagtgtgtgtggagtggttagcacagggctcagcatgaaggctctgcatagtaacagctgcctctgaggctaggaggctccgtacataggtcccccctcctgctgagcagtaacctgtctccttcatgtcaccacccacggtcctacatctacccaagaggctgaacacactccaatacaggctggttggtccgggaggaccctagggaagaagctggagactctgagacttacaccattcataaaccagctcccccaccctaggtaagagcatatgtctctgaggaacccacttttctcttttctgttccctcaagagcctgcaaggccattctcttatttgccattcccaacttcccaatgagctagcatgataggtactaacgttctgcattttaaagacaagcaagcacctaagtcaggttgcttgtccaagataatgcagagatggagatgggatcaaaacctatgagtcatctcccaacaacgtatccactaaaatacctgcaattctagttttacaggtaagagaatagacatgggtgggataagtgagtggcctggggatacccagataatggagcatggaggtgaggcagaattgagcttggggaccgaaactctatcctcttaaatggcagatttgggagacattccctcaagaatgaacccagctctggcagggcccctcatccccaggtgtccccaccaaattcctggcccctgctattttggaagtctatcagagatgggcaacacagacactgaggagccacgggtgaattcccagccctaattttctgttctgtgctcagtctgtgggccctgggcttgggtatcgccctctctctgcagagtgtgtgcaccacccaccaatgcaaatgctgttggccgctgggagaaagcaaagcaaaacttgctgccagcccagctctgcttcgtaatctgccctttgcattgctggggaagcagtgggaatacagttgcagctacctgatggtacatctaaaaaaataaccagctaaaggggcccacagactcccacctgtcctctcctacccaccactctgggagagcagcgaagagctgctgtttcttttttctcccaccccaaggaaatcaatatgttgtgcaaaaacaactccttccagcaaaactccactttacacctacctccatctggaccatcccttggagcatccccctaattcaccaataattcctcccagaatcatcatgattgatttcacagacctgggttgctgcctgtcctgctatgtcccagccaggtggagcagagcagtcacatccacactcagtccccaaaagctttggatccagggtcacagccaaagagacacatgcctagaactggcttgcagagcaataaggcaaagctggggtgttttaaaagggaagtccaggttggtatccatataaaggctaacagtgattgagcacctactgtgggctaagcactctgcagaacttacctcattgaataatcagtataacattttacaaatgagcaaactcctttgggaaaaactggcactgttcagactataatttgttcatataactttcacaatgttcatcttcttgataccatacttatggataaaaataatacttagtggctctttgggtaaaaatggtaatattaattgtagtgctggcagtagtaagactagcactagcaattggaatttattatgcattttaatgactgtcaggcattgtgctgaatattttgaatacattatttgagtaaaaatactgttatcactttcaatgttcccagaattatgaaaatgtatctcaaaaatttaagagtaatcactaggagaaggctgggcatggtggctcatgcctgtaatcccagcacttcgggaggccgaggtgggctgatcccctgaggtcaggagttggagaccagcctggtcaacagggcgaaaccccaactctactaaaaatacacaaaaaaaatagctgagtgtggtggtgcacgcctgtaatcccaactactcaggaggctgaggcaggagaatcgcttgaacccaggaggcagagatcgcagtgagccaagatcgcaccactgcactccagcttgggcaatagagcaagacttcctctcaaaaaaaaaaagagtaatcactaggagaacagaatatgatctacagcttatgaaccaacaaaatttaaaaaaagaagaaatatggaacaattcctttaatataagacaggaaagggggaaagaggagcaaagaaacccaaaataaaacagcagaaaaaactcacatattgtatcagtgagtatattaagtataaacgaattaaacgtacctattaaaagacagagattatcaaaccagatgaaaacattaaacaaaattcaattatttgatgattgtaagaaacatatagaaaagccttattaaaagattgacaataaaaagacaaaaaataatatgtcagaaaaactctacccacaagaaaactagtgtaacatgtaattaatatgatatgaaactaattttgttcctcaaaacaatgcaaggtagaattaaaatccctattttgcatgagactgtgaaatagagaagttaggttacttgttcaagctcacacaagcagcaggggcagaaaaaggacccacacttggatttctattactccaaagcccattcttgaaactacgtgactctattgttctaagtaacattaccttagaaactattcagtgtgtagaaagtacatgttccaaaatcaaggcttgagataggagtaaggaaaatggagaatggatcatgagtcactaaaaaaataagaaagaacaatctactggttctcagtcttggaagcacgctagatagaacacctagggaactcaaagaaaaggccagtgatttggccctaccctagaccaattaactccacatgcctaggggtgaggcccaggcatcaatattttaaaagcttccaaagtgattttaatgtgcagccagagttgagaacaacttatccattcactaactcaagggcaagtttgctaaaacatggagggtatctttaggtcattgtgacaaagagaaatgagaagatcctccaaccttatccctttgcaatggtttgaatatttgtgtccctccccaaaaatttatatgtagcaattttaacccttataagtgggattactgctctataaaagaggtcccagagagctgcctggtcccttccatcatgtgaggacacagaaggctccatgtatgaagcaggaagtgggctcttaccaaaaaccacaagcaccttgatcttggacttcccatcctccagaattgtgagaaataaatttctactgtttgcaaatcacccagtgcaaggcatttttattatatcaacccaaatggaccaagacaaaaggaagaattggcataaagagagacataagcccttcttctgcatagtgagaggatgccatgcctgagaatatgacagaatccctgtgctaacaccccctccctgtttcttaaagagaacacaatgaaccacagaatctcagcactggaaagaatcttaggggaaacttaaaatggatcccagacttggctgattgttagaacgccttggaagttttataaaaatataaatttctgtggccctcccctaagggaatctaattctatagctctgtgttgagcctaggaaattgtatttttttaaaagatacgcagggaggcttttggagaaagatggcagagtgtcccaatacataatcagacaaagcaaaacaaaaaaacaaaaaccaataagtgaaggagaaaagcaagcagcaatcaaacaaggaactggcacacactcatactatcaacatctaaaagacctggggtgagggtgggggcaggaacaggatttggcagaagttgtcaggttcctaaccccaccccatgcttcagaagtattattgctgaggccaaaatctttagacttctcactaattactatatatttgcagagaagcagactgtgagtgtgacatcatttcttcctcttttctgacttaatacggagagagttggggaaacagattgagaactattagaaaaagagctataaaacagcagcatgaacaatcaagactctctctctttctctctctctcattctctctctctttctctctctctcattctctctctctttctctcacagaaacacaggttccagggctcaacgcttaattgaggggatcatctaaatggcaaggacatcccctcctatatcccctcattagtggaatgagccctggaacagcacatttaacaaagtcatgcaagagttaaatgtggtcctacccaaaggagcacacagctctgagtctgaccaccctcatctcccatgttcccctataatgctcccaggcatcagaaagcatctcaaactggagctgacaccatggcagaggtttcaggtaagtcacaaaaggagtcctaaagaatttgccctcaatatcagagtgattagaagaagtggacagagctacccaagttaaacatatgcaagataaaaaaaatatggcacttgtgaacacacactacaggaggaaaataaggaacataatagcatattgtgctattatgatgatgaagaacctctctagaagaaaacataaccaaagaaacaaagaaaattcctgcaaatgtttaatgctatagaagaaattaacaaaaacatatattcaatgaattcagaaaagttagcaggtcaaagaaaacaaatcaaagaccaaaataatcccattttagattgtcgagtaaactagaacagaaagaatacaactggaaattgaattcctacgtaggggacatgcttgagactaaacaactcagggacttgttagatattatcagccttaacaatgtaaaaataagctataattaaaataagaaagggggtaggaggtaggaagaagcaggtgattgctaattttttcatcatttataacatgggctcaaaagtctaaaattgaaactaggtattaacagaaagcaatgactccatcttcttaaaatttttcataaccttgatgagctcttctaaaagatatccatttcaatgaagacatatttttccagaactcagaacttcctttagatgtacttgtttcctcttagaaatttaagccatgtacgttaatactctttgttaaaattgggatgtagagtgtgatcccattattctaaaattattcctgtcaatctgtgatctacatatctttccagctgtgtgtgtgtgtgtgtgtgtgtgtgtgtgtgtgtgtgtgatgatagagagattacgtgagttttcttaatgttcatgatggttatgtctaggaagtgagatttttgagtaatttttaaatttcttctctgaactttgatattttcaaaaacaattgttataattgtttaaaggaaaaaattcccaagtggttgagagggtcacagctaaacttgaagagcacggcatctagcccaggaatctgattcctgaatctccaaaaatcactcctgagaagaagccacacaccaagctgctgtcaaaatctccagtgatgatgaagcactcactatcctcatatgccccatcccactgcagggcaacttcaattttacaggaccacaaattttctttctactgctaccctatcttctagtaataatatccacctttcactgaatttccctaactgtgagctaagcgtattctttaaatcttcagagcaactctatgaaggtatgaggtttcactatagttttgcccgtcttcctgttgaagagactgaagcccagagaagtaaattttcctgaggtcccccagctagtagtttgcagagctgggcttcagcttttcattgtggttgaatacaaagcctgtgtttttaaccaaaattctttgctagaaagtattgcatcatattgaccccaaatccacttttctataacttctaaccaatggcactgactctgctccctggggacacagcaaaaagtctaatccccttccataagcattgtcttccaacataggaagacaaaaatcatgtgaccctcatctaccccatcttcttcctccccaagtgatccttctgcaggtgcaaaatgtaccgagaagagagcatattttttctgacccacgatgaagtcactgaatgattagtttaaatggaatcatgaagtttctaatatgtacttaactatatgctatcatttaagttctgctttgaaggagttcctaatagttgggttcctccggaaaatctcctaagagggtttcatcccacagacaactcccaactccctgggttaactggaggggtgcagtggtgtggataaagtaatttatgtctgacacggaaatgtattatatgcatttttcaatttatcttcctaattaaattttttcatagactcatatttaaatgagtttccactcccctaacacatgaggactgacagtgagtggagggaaaataggataaaaatgttaagtagattttccaccaagtgtgaatcctccacacacgaatcactgagggaatcgctggcactctgtgggctgggtggaggggttttctttggtttataaactccccagaacctgattttcacatgcagacatgagagcctgtccagccagcagagtatatactgtccagcatctcctgtgccaggagccacaaggcagtggggcatggaggtgccccccgggccctgcctggaacatattctcccaggactttgagcttcctggcagggtcatgttccaggagccccgatttcagggaaatattctgctcccttggtttcacacagagggtagcaagcctccaccaaaatgcacacctgtgttggcagcgaggctgtggactgtggcctggaaaacatggcctcacgcctgggaaagcatgcctcagcgtaggaacagagacccaatatagctcagctcggactgagtcaggcactgaccccactaccctgtccctaaatcccccctgcagtgtccttgatgtcacctccctgatgtcctgaaatccaagccccccagccccctggggcacaggcacggctcttcactccctccctatggccattccccagttaccatctgaactcacttattccaggcccaggcctggctgtcccttggagggaaggagagacacccaacaccacagcccagaaggaacctccacagggagtcagtcaaaagccagacactaaaattacattttctcactcccttctcatttggaggaaagtctgtgtggggctggctgtgatcacacactttcatcacacactttctgcataagtgagagaactgtctcaactgcctcctcctcttcctcctcatcctcctcctattccctctccctcctccactgaattcccagctcactgcctcccactagttcacagtgtgctagggccctccagccccaccgagaagccacaggaagctctgatccacccccacagggaaaaagggatcagaaccaccacccagcacagatataggggccttgtgtaggggaccagccagggagcccctccatcttgaagaatctaagtcacgaggacaagcacaggagcaaagcaggcagcctgagctatccatgtcccaggccactgccggcctgttctgaaaaatttcacacaaggttatccccaatattcccagacatgtgtcccttccccggtgctgcatggcccccacactggctgagtatctccagtgggagaggaaaggacagaccgactcttaggaatgcctgctcactccgtggtagcatgtccccttcaggcctcctttcccatctttgaaagtgaatcctgggtggctccctgtcaggggagcacacagataacccagccccaaagatggcggggcagacctgggcattagcaactggagttctgttttcccttctaggctacctactatgtgtcgggctctgtgcttggtgctttgtaaacccactctcattccatcacccagcaacagtgagacccaaagctcagagaagtcaaagactttgcctgaggatcttacctacaattaatggcacatggtcaagacacaaatctcattccagaaaccaagatctttctaccacaccaaatgtttccctaaagagagcccataactccacacaggaacccagcccagcctggataacccatcagaacagaggaagaaaactcctctgtcaaaatgaaagatgctaatagcaagggtgtttactaggagtgttcaaatttccattaaaaccttcctgtgcaaagatgagctacgaaaatttccttcttggaagcttgtacctcctggaatccagacatctactttcaagctgctgaaggctcccactgcctccccacagggctgcaatcccgaccatggattattaaggagtccacaggcttggctcaatgaacagaacggctccgttatatttcaacctacccactaagacttaaatatcacaccctagttcagacagccctcgcctttcatttttcttggctttaggaagacagggagggagggcatacagagccaagaacccaagtgtctgagcttttacagtaacccaaactcacccaagacaggctgcccaaccgggcccacctctgtgtggcttctccagatcaacagaaatttggggtgaaagcctgcttttctccatgcagtaaggcatctgcatgaaaggcacatgtttccaggaccttccaagctctttcttgagtaaatattctcttaaaaaggttttgaagcagaggctaaggagaggagtcaacatggaattttatttctcttggattatctgactcaagcagcacccaagactagcaagaccaaagatgggctgacccaaagataaccatttacaacaggagtcagcaaaccaacagcctaagggcccaatccagcccgatgcctatttttataaataaagttttattggcacacagccatgctcatctgttctggggtgtctgtggctgatttcatgctacaaaggcatagttgagtggctgcaacagcatggcccagaaaagcctaaaatctctattatctggccttttacaaattaaaaaaaaaaaattgccaacccttgatttagaaaaactttcagatgtagttaggcctatttcttgagcctttttaagagcaaataatatctctggaatatatttggtatagtcttatatggagggaaaaggatgaaaaaaaatggcccctgagtttccttccaaatccacaggaagccaaaaaaggaatgaggtgcctggtacaaatgcctcaggtgacagacatcctatttacagaaaggcaatctgtgcaccacctcagggaggccaaaccaacatgcctggtgcaatcatgcagccttaccctgcaaccacgcccaacacttggaagcctaacgtggacaacgcctggtgcaagagggcatgtggtcagatgttccacccccacttagctcaggggcagacagaaggcttctccaaagctgtcccttggcaggatttcatgtagcagatgccactagtctacagtctctacagcctctgactcccagcatgtacacatgtaggtgtgcacagaggcccagagaagcagggtcaatggaatccatgaagctgacctggtggcagctcagggtttattccctgcttccaacctaccagcaggcacaactcttgatagatctaacagcacactggggatggagcactgcatcaggactgaggagactcagggtcttgccccagctctgtggctaactcctgatgcaaccttagaagagtcatatcatgtctctgggactcactttcttcttctgtcaaatggattaatactacccactccatctaactcacagagctcagtcatgcaacaagtaattattgggcatctactatgagtcagacattatgctaagcacttgggatatagtggcaatcaagatggacaaattccctgccttgtggagcttacactctggggttggtatggaaactaataagggatgcatagatgaatactttgaaaaatcatgatgtgcttcacttgagtcgtggatggtgatgctatcttcccactctgggccattcatggactagactcacacactgagcagacctgctgggaacacatcactgataaaagtcattcattgggaactattctaaatgccttgtatgtattaacctcaccatcacagagagtcctcaacactgaagtaggaactctaaatatgcatactccacaaacaaggaagctgaggcctggagcactggagctaaaaaggaaatatgtgtcctgtcccttatgatatctcccatactggctggagatgttgaatttactatattaaattcttctccattatcttgaggagtaaggccaggacccttcagatggagaggaagtctctctccctagatggggaagggaagttctccttccctagttcaatcatcacagaaaaggaaagcatctaacaggaaagtagcacccagaagagaggccttaaactccttggaagaggtgatcctcctatctgcctctttgggctgaactctcctagcaggggatttttagaagggtggataaccagttgtgggctgcagtgagaagagcgaacccagcccatgaagaaggccaaaaaaatgaggactctggcagggtctgtgagctaagatgagctatgccctacagggcagttatctagctctgtcagcctccattcatttccttttttctgtctccacattttcagtaacgtcctgtctaaacatcccaccagactctcaacgcaacatagacaattagcgaaaggttagaaagtcatgcacccaagcttggcccaccacagttagaggaaaatggcaccaccttaaaactagtatgtaggtgttcgtactaaatacgtgagaaattctcccaaaggaaggtgaagctggagagagtcagggtcatccaactactttttgccctctcagagcattttcctccttgccaatgctggacaatgaaagcactagtttattcagggaaatcacagtttcctttttagaagagcaggatgctaagaagggagcaagaataagttgaaaacaaatggagtaagattcagcattgtgcacgcacccccagcccagccacccaagagattctcccaagccaggcagtgatgctcacatctggtccttcaccaccaggaccaagtcagagcaaaggagaaaagaagagaaggaagagacaggagcgcactggatgggagagtgaagggttggagaagagagggatcccagcctactcccaagcccagtgggatcatcttcccctaggaactcccatctgatattggctctggttggggctgcctctctcccagcacctgctgggtagacttccccatgtttggtcctgggaggtgctgtagcagctggagctgtcctctttctgccgctggaagcaactggaagtcccaggggccctggcgctccctctgggatttcaccctattctttcctgtctcgctttctcttttatctcctggattaacttactgttgtgccatctacccagttgtcagtgtgcctgtctcagctttgtgatctcacgtagatccacagaacctaagagctggaacgggccctgaaaacattctggagcaggcgtctcggcagactcaggcatgcctctccccagggaaccaggccgcgtctgggcagaagcaaggcttgggggagtggcaaggattgtgtgtactccctcgaagcacatcttcagaagtggagcattttcaaggtaggatgttgacataattgttaggtccatgaaggcagatgctagaagcagtgtgaaaataagactctgaggttgtccaggtggggggctatttttatacatttccccccacaacccaagcagtacatgggccctagccctcaagcttcacctcccagatgtaagactccaaccaagattttggagtcaggggcatacaaagcccactcaggggacacactcatagagtattcaactgattcagagatgtgggaagaacgctattcctatttatttttttgtagaaacagggtcttgctatgttgcccaggttgctctcaaactcctaggctcaagtgatcctcccacctcatcctcccgagtagctggaactacaggaacacgccaccacacccagctaccactatttttatattaaataaaacatgtatcatggagtgacaggaaaaacctatgcaagtttaagtaaatattgtacttaaagtgggtgactttaaattatgctcttatatgtacaggggaaggacagaggaagggctcatttaccttcattcttctctctccctagagaattctgtgtatccaattttaaaaattcatcatatgtcacagacagaggcacagaccccctgagccatggtgggaagatacttctggacaaatgtatacccagcaaaaatctcaaaagctccaactttctaatggcttcattttactgatgagaaaactcagacctatagaaagaagagcagaaacagactggatcccaaatccctgtgccccacagttgatgctctttccacctccaatctgaggcactgctctccatgtggccaggaaccgtttccaactaaactggtcctgcctagggcctggaaaaacacactgttaatatgcagccttaattaaatatttctgatgagcacaatgatgcttcaaaattctagctaggattcgactgatgctgcagcctggagccatcaaggaagagcctctttcccctaagcatggtgtgtgtggagcttgctgggaagactgagaccttccaatccaacctggccagcacatctattcaagccatcaaccagaggacagatgtagaagtcaccttctccttccagggaccactcttggaagcagatttccacaaaggggaccgtacagttctaagcttacagatggttagaacagaccagccccactggaaggccagaagtgacgaggatgaggtcaaatgtcagtgacagagaggctcagacctctctgagccatggtgggaaaaatctctctgacccatggtgggaaaaatctccctgaactaatctgcaatttccaggcatttctgaccagtaaggaaaggatttggttgcagaaggctgggaagctagattgtagaccaagagatggagaaaactcttcaaggggagagcccagccactacaaaggggcccagcatgaggtgtgctggaggtaccctgagggccgtggctgcctgactgacttatcctctactttgggaaaaggcaactcagtgcctggattaaaccattagctctggaggatgcctgtctggtttgaatcttaatttctccatttcccagctgtgtgacctcgataagattacttcatcctctgggtctgcttcctcatatgaaaacaggaacaagaagtgcataaacacatttcagggatgtagggaagactaaaagggttaatatagggcaagcacttagcacagtgcccagcatagagcagtactgtctaggctgtagctaccacacatacccagtgaaggcactcaactaccaggtggacaagcaactgatacatgtgtgtgctgctctctgctcccctttggacatttggaatttcaagtactgggacttaataccacagagggcagagttttgtttttcctgcctttgacatgatgtttatgatcttcttttcttgtgaacaccccagacctagggaccagcggtggcctggcttcctgatgcagcccatgaacacatttaagaatccaaaaaggttagccaggcgcagtggctcacgcctgtaatctcagcactttgggaggctgaggcaggccgatcacttgaggccaggagttgaagaccagcctggccaacatggtgaaaccctgtctccactaaaaatacaaaaattagccaggcatggtggtgcacacctgtagtcccagctactggggaggctggggcatgagaatcgcttgaacccaggaggtggaggttgcagtgagctgagattgcaccactgtaccccagagcaagaccctgtctcaaaaaaacaaaaaacaaaacaaaacaaaaaaacgccgggtggcggggtggggaggcggggagaaagctgcctctgcattgcaacttcccaaacagcacagacattaacattttagtgatgaaataacaaagctgatattctcagtatcattcctttattgagtgaaatcagaaatataactttttcttcttttttttcccccgtgggactccataaaactatttttgttgtaaatgttttaaaaggcagcctgtcaatatttcaaatgttcctgaattggagctcatggataaatgactcttcccccattggccaagtctcctctcctgctgcagcaaggaaaggggcacttgggagctgagaaggcaggaaccaggcgccgttgacactcctctagtgagatgaatgttccctccactgggtcagcagtgagcaccagcccaagaagtgccctcgcctccctcctgctgggcagtcaccaggcaaccctgcaggcagtgcaccaagctgttcctccataatgcacacccagtcagggcctgggcacctctagttactcagcagtgagcccacctgctatgtctcaggggcatcccacacccagaaagctgcttctacttcaagcctactcccaggggatgccccatcagggactagagggtcctgctgaacccaccccaggttcaaggtcagcagcaggctgtttcaccaggaaggccaggagctatgctcaaggtaaccaaaaggacagaaggccccacccaagtgtcatcttgcccctcctcccagcttccccattggctagtaaatgagtaaacagacatggttctaaaacctagaagagcatcagaactccctgtggatctgggttcaataacacagatttgatattccactcctggatattccagttttgtaggtcttgagcagggatcgactttttttttttttaaggttccaacagatgatactgtggctacgatgggcagctcagatgtaggccactggcaacacagagtggaaggagaagcccacagggttcctcactgggcgacacaagctcttcaaagcaagctgagtaaatctcttggtaacaagccaagccggactgcccacagctatgggcaggtctgctgtgtctttcgcctgctgaaagcccaggttgcagcacagggaacagcagagacaggatcaaaggctctctgaggacagtctgtggcaacaaagtagcagctcctctctgatgaggtaaggaagagtccaaagaaattacttttgggctgggtgtggtggctcacacctataatcccagcactttgggagaacaaggcaggcagctcacttgaggtcaggagttttaagaccagcctggccaacatggtaaaacctcctctctactaaaatacaaaaattagctgagcgtgctagtgtgcacctataatcccagctactcaggaggctaaggcaggagaatcacttgaacctgggacgcagaggttgcagtgagccgagattgcaccactgcactccagtctgggtgacaagagtaatactccatctcaaaaaaaaaaaaaaaaaaaaagaaagaaagaaaagaaaagaaagaaagagaaagagaaaacacttttgaaatttggaaatgaggaagactaaggaagagtccaaaagaaactttgcctctgcccaaggagcccacaaactttccaaggccttcctgttcctggaaacggtgccatctccaaagactcctccgcacatggaagagcctgatctctcgggcacagtcaaccattacggcccattttctcaaactaggccctcctgggggtcttagggaaagggggcaacattacacaaggcaggtgaaggggatagccaatcacagaggggtgcaggttggcattgacctcttcctaacttttctcataatatgaaagtgacttctcttctcagaagaaccgttcataatgaaattcgagctgcctcaatcttccttgatcatctcttcactcttaccacatacacacacgcacgcacaccacaggaaaacgcatcagatgaagaacttccccagtccagtgcagatttaagaaagaggacactgacatagggaggtgggctggggagctggggagggggcagacaaacaagggcatgtgactgatacacttcagggcgggagtcagacggccccctcacaggccagggtgacatgtgacaaagtcacaaggccctgtggtatttcttgaaacttgatttcagcccaagtcaaactccatggatcaagggtcatttctggctattataggatgagagtatccaggactgaagacctcatggggcagaaagaaaaaaaacagaaaggtagctcttggagaaataacctaaagattagaatcaaggaagagccaacctctcttctaacagggaaaaaaaatttactaaaatgacacttcagcatcacctattttttcaagcttgtctttctgaacagaacttgaaaacacagttgtaaaactgttttactagttcagccgacttagaaaaacaaaaagagcttctcacagctttaaacagagtcctgtgctgaagtgttccaacactccagccccactctggggttaagaatgacagatgatgcaatgtaaaaacatcattttccactggacacagagaacatggtacaatactttggaggttaaacagatgagaagggaacagtacagagacccaaacttagctcctccatgcctctagcacacacatatgcctcatggaaggcatctggagaggttagtgctagagaggccagaaatcttgtttctggttctgtgctggaattaactaggtaaaccctggatgaactgttacatctttgatcgtcactacctgagaattaacttagacaaacattgacactctataaagcagcaattgcaaaatgtgggttttcaaaagcactctgagttcttttcaaagaggatggcataagaatcgacacagctgacatatggtgtggacagagagaaatagcttgggcttggatttccggtcagttcccctttctgccagttaccatcagaggaaccatgggcaaattacccaatctctctgagcctgtgtcttcacctttaaaaatggtattatagttctcaaagtaattgcgaggaattaaaagtcaattcagggtcaggcgcggtggctcatgctgtaatcccagcactttgggaggccgaggcaggtggatcatttgagtttaggagttcgagaccagcctggccaacatggtgaaaccccatctctgctgaaaatacaaaaactagccaggcatagtagcatgtgcctgtaatcctagttactcgggaggctgaggcaggagaattgcttgagcctggtaggcagaggttgtggtaagccgagatcacaccactgcactccagcctggacaacagagtgggactatctcaaaaaaaaaaaaaaaaaaaaaaaagggaattctatgccctgtaaagtgcagtctatggaagtgatgatgatgaagaccaggatacagtacaataaggactctttatgctttcaaaaccgtgattatgctgcatctggtggaagccaggactctggaaatatggcccagacacacccagaactgaggatcaagatgagcgtggatccctgggtcatgagcatcccaaccaagtgcctgatgcccaactccagggaaccatcttccctccgcacacaatagtcattccatggtggtgcacacctgtgagtcaaaaacaccctaagaaaatgtaatccttggggcatttcctcagctccagcctccggcccatcaatcacaagcacaatcaaactgcaatgcctcaaaccaatctcctaggacccctgccagggcagagactgaaagtcactgaggcaatagagcatgtattatattgatgatcctctagctgcaagacctgattggtttgagactcccttggataatgctggcaattaattttggcaaaagagcaaaagatagatgtgacatccattgaacacagagctgcacaggagtcaggtttctggaaggtaggaagaatgcaaggaaattaactccagagtggtttgcagggaatgggggctccaggctcattatttcaatcttgaaagctgtcaatcactgtcaaaaggcagtttaatctcaccctgaagctttcaagaacactatgaatccaggcctacaattagcagtccaatgttgggctgatgagttatgggcattttccatctgggagggcacaagcttctcctatccagggcgtgccctgggcataaaggatgtgtggacaaatacaaacactccaccagccagaggtgacagaaataggcctataatatttgcccaactgggtttatgagacaagcatgtagttcaacactgtttatacagttcatgagagaatcttgggcagtgacagagaatgtaactctcatcctccttagggcttccagaaatgaacagaggatatatatatttttttaaaaagtggatcctccacattttctaaagtttttaagctctctggggcaggttaagaaattcagactgcccaggaagtgattttttttttttttttttttgcatggaatttcgttcttgtcacccaggctagagtggaatgcaatggcatgatctcagctcaatgcaacctccgcctcctgggttcaagcaattctgcctcagcctccctagtagccaggattacaggtgcccgccaccatacctggctaatttttgtatttttagtagagacagggtttcaccatgttagccaggctagtcttgaactcctgacctcaggtgatctgccggcctcgggctcccctctttacaccattctctaagcaaataagctaacatcccagaatggaattatagaaagattgcaccagtcaaaaaaggcatttggtatacatattctaagaaatgctacataataacaatatgaattaataataaattaccttctttcaccttgaactgaaggatttgcaaattttctcaagttctctttcatttgaccttcacaacaaacctgtgacatttcttaccccctatgaatggttaaggaaaagactcagaaagtgggttcttgcttcttcagatcccagatgactcctgaaatattcataattctgatcttaaaaaaaatataacacagatggtaggacatgcctcgtgaatcaggtaataccctggcagcatctcccttagagcgtagaattccacaggcagggatgtgccaaacacctctgcacgccaagctgggtgtagcaactccatcaaatccattggatcacgatgatcctggtacagggagaggggacaatggaacaaccaaggccctggaagacagcaactgaaaattttgacctgtggttcaccagcttgaatccagcactgggatgtcgggggtggggtgttccagggaaaaagaccacagcttctggatggttccaagaagataggttccctcattaaaactggtatcaaccaaccctcttgtacacagacccctgtggtgggtgtcaaggggaaagaaacagatgggcccaggatagataacacagatgcccagtccctgcccccaagaaagctgcccctgccagttgagaacactgctgcatctcatctgaagagaagcctacacagcagtcctggaattccaaatcaggtggaagaaggcagatggcgcaaaataaactcaagaaacagacaatgggaagtaagcatcaagccaggtaccttgacacagtacctctggcatggtccccaacagctggcctgttggcctccccaaacaatgcctctttctaatgagtctttctttaaagtggtcaccgactatacaccttagtgtagagctgctggtacaacttcctgtaacatagcagttgcagtgaagctccagggctacgctgggagtatgagtgactggctcagccccagaaggcaagtcactctccgtgtcctggtcagcccagcccctgtcactgggcaacatgtggttgtgttcagacatctcccacctgtccataaaaggtgaggtctaatggtggcctctttgggacaaccttagggcaatggggcatacgtccaggactgaggctgagaagcacacactggtgcatccctaccagggtgaaaatattgaaatcctttttacatggtggtaagtagcagcttccctgaattcctgcatgcctactaccaccacccagcctctacaatgggactccatgcctccccatgatccagcgactgaagggttggacctggcacagtcgacacttctctaggactctgtcggtgcccaggcagctgtgtaattgtgaaatgctttgaatatcctccccacacgggcccagtcaatggtgctgcaccttaacccaaacacctcactagtagaaaggctaaggaactcaccttcctaagaacctgttgaggccacaccaccagctgtcctccactgggcaagaaggtgtcacccccagctctcctctctagctagggatcctccattcctgctgagagggacaatcctggaaaaagaactatagcccttcaggtattgtatccatacctctgagtctatgtgtgtttttgagaggaaaaaaaaatgcttctggtttcacctttagaactaaaaatctggttgatctaatatgctagacatttcagcaatctctggcccaacacagagtagggtgccactgttctctatattcctggcccagctgaatcacagcatcatagcatttaagcaccctcaactatattcagcccgatatgtttaaaactgcaggttatggccaggcatggtggctcacacctataatcccagcactttgggaggctgaagcaggtggatcacgaggtcaggagtttaagatcagcctgaccaacatggtgaaaccctgtctctactaaaaatacaaaaaaaaaaaatcagccaggcgtggtggcgggtgcctgtaatctcagctactcaggaggctgaggcaggagaattacttgaaccctggaggtggaggctgcagtgagccaagatcgcgctactgcactccagcctgggtgacagtgcgagactctgtcaacaaaaacaaaacaaaataaaacaaaaaccctgcaggttatgacccatcagcaggtcacagaatcaactgaatcattcacaatcagcatttttcaactgaaacaacagcacagaaaacagagtactgcatattaaaagggttgctgcatggaacttttgtttaattacatacatgaacataagtattgggttgagaaagaaaaggtatttcttattctgggtttcaggggaaaaagcttttgaaagcccctgatctagctaactccactctatcattgatgaggaaactgaggctcagagaacagcatggtcaaggccactcagagaatgtgcagccaggtgaggtggttctcagtccatgcagcctgcggactttgcttttcttctaagcagctctggctctggccatgggcattgggattctgggatgctaagtagctggctcctcagttcctaagagctgtgctcaagtggtctctagtgccattgagattttccccagcagagtaacccttagcactagatctcctgaggctgaccaggaggccctgagaagagatgccagccaagcaccccatcccccattcccacagcctggtagtgggtttgggcccagcctctacatctcattctctctttataaagtctcaagcaaactgtgtggctgggactttataataaacttggagccttcttcaagctgaggctccagcaaacaactagatctttctgagcagatgcttctgctctttaggcaggcttcctgtctctacaggtggtctagccctgggactactggaaaaatgagggagtgagggtgtgctttgtgagaggctgggacaggggaacggctcctcctgacaatgtatggaaacacttttttttttcaattaaaaatagcatagatcacagatgagaaactaactagaactatataaaaatacaactttttttttttccaatgggacctgcttagatagaagctaacattccctgaaaactatttgtcaagcattgtgctatgggcttcacacacattatctccctggatggtatagtagttatctcacttgatataaaataaagttcagtgataccagtgaatgtattaatgacatacacagagctatcacttctacagtgcttattctattctaagaattttgtgtgttatttgatctcatcatcagcttgatacagttggtgctattctcatccccactttgcggattatgaattgaggtaagaaaggctacctgacatgcccacactcacatagatactaagtggtggggccagggtttgaacccagatggtccaagctttggaccctcctaattacctccactacactggttatgattccttccactttctggcgcagaagcagagactcgggaaagttaaatcatttgtgtccactccacccagaagctctccacgtacaccagagggatggaaaacatttaacaatgggtaaggcaggtccatgaccttcacaaggggcaccattggctaggctggagacctcctgctatgctggaaactgagccattttaggggctgcttcaaggggaaacccagagggtttcagagaagggataaggtaacagggacactcacagcacttagggcaatgtctattttaatcagcagggaagttttccaatatgttatcaattttggccactgcaaacagccaagataagacagtgctaaagctcttagtcgaaactgaatttttgcatgtttcggggctggaaagaactcttgagccatatagaattcaacagcctcattttaccaatgaggaaaccaaggctgctatgcaaagcatggtgcccaaggtcagagaactagtaaatgacagagtcaaaatgaaaatccagggtgcccagatgcccagattggtacttagggtgtttggtggtggtggtttgtttcttccctatctgtgctgattatattcaatacacagatgctgatgtgcatgcacggggcccagcccccagctgctgtgccacaccctgacaacctcaggatcttcagagaggctcagctgctcaaagttccaccagggaccatacaagcttcatggatattcagattttttttagtaagcacctgaattttgtgtaactgatttccacacccattgaaggcggcttctaaatttagaattaacatccaaagcggtctgttgcacaaatgtatacttcctcgcaagctgttgtcagaaacagtaaaactgacatccataaaacagtttcttcataccttaataatattgaactataaaaatagaggatctcaagcaaacaaagctgtaaccataataacctttacaaagtctactaccacagtcaagtactgtccagatctttttttaatgaaaatgtaaaggtggccccagccttattctcacatgacaatgcaattccctaggcccagcattccctctagacacttgtcactgcccaatccagaactttagtaattgatcatttggggtaataacctgcaccttatacaataaagccacctttgcagaaactgcagcttcactttcatcacttcctcctttgcctattccaattagttgcttagattcagttagacacgtctccccataccaagcacattcagttgtgccaggaggatggaagaagtctttctttcaagacatcttaacaaagtagacattgcaacgcaataaagtagtgagactcatggttgatgcttacacacaatcttccaacagaatgctttatcatcccttgcccagaacagatggggaaaaaattacgctatgccctgaaattttccattcttgatctcagcccaaaggtgacttttttatttttaaacttgagacttgagcaaaaaaaaaaaagttcaactatttttgattcatgcccaggctaaagaaacacatggtaagattctttttttttccaaacccgtaggtagctcaaacagctaagcttcaaaagctcaagctttccaactagcactaatagtgttcacagaggcagcacctctgcagtaattgcaaggccaaaaatcaatagccggggtgagaaggagctgggattccactttctggacacattgtccccagtacctctaaatacttaaaagaaccgcatagaattctcaaatgtttaagcaggatggttgggcctgaagcttttcctcccttctgggtgataaggcaacccgtcctcatcaccattttttcattacccatcctttgatgcatttcagtcctctcgagagtccaggctacccagagagaactgacaggtctcctgactgccctctgtccccagaacttgctctcttctaccccgtccctcccagccctagccccaacactgactcctctactccttctaccctccctccatcctgctattcccagtctccatagaggaaaaagggagtgtcatgcctagatgaaaagatttggggttcaagtcaccccatgtacctccctggttccaacgaacctccggaattctagccacagatccccctcttgccctctcatcctcccctaacacatccctacacattgcaggcccaggggggagtccacaaaatgggactccatgcatccatccttctgtggggccgcgtagcacacccacggcaagactccagtccctggtcccggctctgccacttatgaactgtgtgcccataagcaagtcgtctcttgctctgcagactggggcttatcacatttgtcccacctgtcccagagagctgttatgcaaagtaaggggaatcacagatgtgaacaggcttcagaatcagagctcaatataaatgtacctccttattattaggcacatggcacagtgccaggcagtgtggtatgttccttggggctaaagtccaagagatattggcaataaaagaaagtgaattataccgggcagaaaacaaggaacaaaaagagaagaacagagatgaggattcaccagcctccagagaagagtgaattcacagtgacagtgcaatcaataaaggcttcctgcaagaggaaggctttgtatgcagcctgaagtggctctcaccacgctgatcaaaggtgatttcatggccaggcatggtggctcatgcctgtaacacgagcactttgggaggccgaggcggacagatcacttgaggtcaggagttcaagaccagcctgggcaatatggtgaaaccccatctctactaaaaatacaaaaattagccaggtattttttttacaggtggcacatgcctgtaatcccaactactctggaggctgagacagaagaatcacttgaacctgggaggcaaagattgaagtgaaccaagatcacaccactgtactccagcctgggcaacagagcaagactctgtctcaaaaataaatttaaatttaaatgtaaaaaaggtgatttcatgcatgccccttcccaagaccaagcgctctttgagggcaggtgacatgtctttatgtctcagccttcgcagcttcctcctggcatctaggtgaaagaaagaatgaatggagccttgaactaaccaggaactcaactaagtggaaaagaggagagactcccagatagcagagggaagacaagctggggtcagagggcggactctttggcttaggagtagaggagttcagaagttcaggcttctgatcacaaagggaggtaaaaggagttcagaggagtcagtgacatcatgaaatcagtatttggggagcttaattgggcagctgcatgcaggatatgcagcagggggtgaaggaaagctggcagagtggccaggaggcaagggcaatgagtcaggcagacggtgagaagggaagccactgcctctcggccaaatcgccctctgggagcacccatctctgtcccagtggaagccccatcaagggccactctcagtgactgtcctctttaggctggaccttaagtgtcccctagtcctcctgccttgcacccagcactggcctcctgcaagtggttaccttccccttgtgaatccctccaggctcagggattccagggattccagggattccctcccattcccgttttagaggacaacgcggatggtaagcactcccttaaaggaagcacagtgatgcagcagcgggcggggaaacagggagagagcttttacttctgagcacattttcccaaattgctatcttttcaacacttttataaggtagtatgttaatatgacagttaagatgatgataaaaagaaggtagaggaaaaaaatgtggaagacaggaccagtgcattcaacacacagctcagacatgattgagaaacagatcctggtgctgaagagctggggacaggagcctggtgatgggcagcctcggttccagggcaggccctgccaccaacgcactgtgtgaccttaagcagctgtgctcttcccagtcactctcttccacctgtaaaatgatgtcagagatagttcccacccaagagggtagttgtaagaaggaaatgagttgatctggtgcagtgcttagtacttggcacaagataagtggttagtaactggtatctgtgatgggcaccaggctagcagttactgcctctaacatctggagacgcaaaccctagcactgcagctatcccacaggaggtgtcaaatgtgagcctcccaccccatccccctgagatccccacatgaatgcacctccccacagccctaacgctctcaccagggacacacagaacaagccagtgcctcctcgctttacagaccatcagaaatgcaaaggcagttgctgtgcctccacggaatattctctcccctaaaatcttcatgtttttctctcctcttatttctcttctattcacctactgcacaaacaagatcaggcagcagtgataggcaaggaaagatggaaatattctttaagtggaatagcaaaaataggctttggaaattaatgcctagaaatttaccctgtgggctctctggagaccaacccaaatgaaatcccattgacagaaagctgcagccctctggggaatgtccccccatcccatcccccaggatccttggtccaggaaacatggaagttggcttctgatctccctggtctcccagggatcctgctcggggcaccacctgaaaagtccctcggcagaagcacttctcgccatgcgtgaatgctgtggaaagcatctgaacatgaagtttccaattactgctggcatttctggagtgtcctgatgctggctgcagctgtcccacggaaggccagtgatgtcatcagcaagcctgacagcactgagttccaaggctggctgggaagaaaggttccctgcaggctgagcccccatcactggagagggaggaacctgccatttcccccgcaaaggtgggcactactcaggtttgctgcttcccttcctgggtagaattccattgccataacttggactcacaccaggaaaggttcagaagctgcaccaatgtccaggatgattccatctgactgcttctgaaaacttactatgtgtccagagttgttccgggtggaggcaagcccaggtgagacctactttccaaatgttcatgtactcacttcgtggcatgaaaacaaaatggtcttgcattcttcggctacagagagacaataagggaagtaaaaaagggaaagagagaaacggagaaaaagcaaaagaaggaaaaggtgggaaggaaatgaaaagaggaaaagagagagaggggaagggaaggaaggagggagaaaaggagggaagaagtttttgtcctgtggctagttttaccttgaacctccctactcaagaccttcccagttcctctctcctcctctcccttgctcagggagctcaggccctgggggagccctggcagataccgtcctctagaagagctgaccaaggagacagagcacgggatgcctgcagagcgatgtaacagattgggccctgagccctacagtagagttcaagctcaacgcaatgttcagatttcccaaggcgggggattagattaattggaatttgcaggctgtgcccaaccaagatccatatctgtcaccatgttaaccacattcaggcccctcttaaaatcagaaccccgccatccatcaccaccccggtggagaggcacggccagagcctcgcagtccaagactgaccttctggctggcagcctaccttttagccgccagcctcctccatgggcttccagataagcgtgtgtaactcttgagcaaatcctagcccctggaggaactaccggcagttatgaacacagtccctttgttcatctcaggagctgatttaattaaacgagaaactatggacccttcctaagggagaaactatttagtatccagaaccaaggaaagtaaaggctaaagggaaatccagatcctttcaaaaactatctaattgaaccttgggagcaaaaccatgcagtcaaattacacaagaggatccaaggggctgcagtgtaacccaaggtgacacagccattaagtgaaacactcaggtctgagctagggcaccctttccaatgcattatgacacatttaatctgtaaaactgtaaattattttttttaaaaaaactgtcttgggccaggtgctatggctcacacctataatcccagcactttgggaggccaaggcaagtggactgcttgagctcaggagtccaacactagcctggccaacatggtgaaaccctgtctctacaaaaagtacaaaaattagccaggtgtgctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaatgaaaaagagtccaagaccagatgcattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaagagagaattttagaccaatatccttgatgaacattgatgcaaaaatcctcaataaaatactggcaaaccgaatccagcagcacatcaaaaagcttatccaccatgatcaagtcggcttcatccctgggatgcaaggctggttccacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtactgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattagaaaaagaggaagtcaaattgtccctgtttgcagatgacatgattgtatatctagaaaaccccattgtctcagcccaaaatctccttaagctgataagcaagttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagatatagatcaatggaacagaacagagccctcagaaataacgctgcatatctacaactatctgatctttgacaaacctgacaaaaacaagcaatggggaaacgattccctatttaataaatggtgctgggaaaactggctagccatatgtagaaagctgaaactggatcccttccttacaccttatacaaaaatcaattcaagatggattaaagacttaaatgttagacctaaaaccataaaaactgtagaagaaaacctaggcattaccattcaggacataggcatgggcaaggacttcatgtctaaaacaccaaaagcaatagcaacaaaagtcaaaattgacagatgggatctaattaaactcaagagcttctgcacagcaaaagaaattaccatcagagtgaacaggcaacctacaaaatgggagaaaattttcacaacctactcatctgacaaagggctaatatccagagtctacaatgaactcaaacaaatttacaagaaaaaaacaaacaaccccatcaaaaagtgggcaaaggacatgaacagacacttctcaaaagaagacatttatgcagccaaaaaacacacgaaaaaatgctcaccatcactggccatcagagaaatgcaaatcaaaaccacaatgagataccatctcacaccagttcgaatggcaatcattaaaaagtcaggaaacaacaggtgctggagaggatgtggagaaataggaacacttttacactgttggtgggactgtaaactagttcaaccattgcggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactacgcagccataaaaaatcatgagttcatgtcctttgtagggacatggatgaaattggaaatcatcattctcagtaaactatctcaagaacaaaaaaccaaacaccgcatattctcactcacaggtgggaattgaacaatgagaacacatggacacaggaaggggaacatcacactctggggactgttgtggggtagggggaggggggagggatagcattgggagatatacctaatgctagatgacgagttagtgggtgcagcgcaccagcatggcacatgtatacatatgtaactaacctgaacattgtgcacatgtaccctaaaacttaaagtataataataataaaaaaaagaaattacttttgaatgggaaaaaaaaaaattagccaggtgtggtggcacatgcctatggtaccagctactctggaagctgaggcaggaggatcactcgagcctgggaggtggaggctgcagtgagacaggattgcgccactgcactagaacctgggcaacagagccagactctgtctcaaaaaaaaaaaaatactttctttgatatatctttatgagaattgctatcttaatgttgctcataaaaataacttacacaaatgtgtgccaattgctgaagatcttcagtttcagttattctattttttatttctggaagtcctatttgtattcttcaaatctccacggattttaaaaattagtctattgtttcttcctcatttgtttcaaacatttaaaatacattacctattccattggaactatatctgaaaccctcgggaatctgattcttctgtctgttgtttctgctgactttcactcgtggtgactggtttcctcatctgttttggattttgagagtgaaagctcatgcttgaatggctgggttttacctacaggaatccatcaaggcttgagctacaagtatgtccctccagagagaatgtgcatttgattctgacaggaactctggtgtgaccaaccccaaactacctccagttaattttgcagcgtggagtctcctgggtcacccaggcagtacaaattcaaaccccaaacttgcatgaaggcagacttatgattacaaattctcacagcaaacattgttccatcctttggcaagccaaagccaaaacagataagggcccctgtcttctccctttgcccccctgcagatgtctgctggaccacctgtctgtcccctagggatatatttctcctgtaggggaaagcttcagacagaaatctcatttccaactccccacctggcaagggtcccaggtctggctccctgggtattctaaaggccatgctttcaatcctggcttaaagcctgacacgccctcaatctgatttattgtaaacacagcgaagtctttcttagagcctagatctgtgctttttcccgtacctaatttaaagctagatacacctttctttggtctttggagcccagagttcccagggccttctaaggaataagctttcaaaactttgaaatgtagatgtatttataggaaaaggaaagcagcagcaacaaggttttaatgacctataaggctaatggaagggaggaaaaaacgcacacgcctgtgtagtcagcagttccaattgaggagcatctgaaatgctgtaagaaggtagaacaaagtgggaaatattagaacagagcagagtggatggggaaagaatctacaaagactgtagagacatttctctctgtctccgtatctttctgggtcattcttcgtcacaggatgtcaacataagaggtatattttaccctatacacacatgatgtgggccaaaagttgaaaatgagtgtaggattagaaactacaattcagaattttaaaaagaaaccagaccacacacaacaacttatccaggtagtttccagaaggcttcatagccatcactcagttcgtcctcacaaaagccctcaaaagtgcattttataaccagtaatggccaaccttctgataaccagtctactgtactttctcacatctgtcactacttcttatcaaaaaaaaattcattgattaatcaataatacgtttgggaggctgatatgtctggatcacttgagcccagaagttcgaggcagcctgggcaacatggcaaaactctgtcgctccaaaaaaaaaaaaaatccatatatatatatatatatatatatatatatatataaattagctgggcatggtggcatgtgcctatagtcccagctactcaggaggctgaggcaggataatcgcttgagctcgagaggtcaaggctgcagtgagccatgatcatgccactgtgctccagcctgggcaacagagtgagatcttgtctcaaaaaaaaaaaaaaatcaataacatgcacacactgcaaatatatctccagctctatgattcctcactcaaaatcttcaaaaccagatgtgttttagaattccaattgtttcgggttttaggaaattattaaggtgaatctctgaggtttgggctgcacatcacagtcacacacactaacatttcttcaatgacacacgacaattcagactaagctggatgaatgaagaccataaactgcctcgcagttcagggcagcttccactcaccaccagcccctccatgaattaggtaaaaacactcacttttcagagtttgggggacttcaggttgggaatgagctggtgtagaactggatacataagtcatctctcaaaatatcttatatttaaatccatcagcttaaaagtccttcccactaagtctcaaaatcttcactctgattctcagaaggggcagaaaagaacagtgatcagaagaggagaggagcatgaaacagttgatggccagagagagcccagtgggcctccccgggagccatgatgtgtagtgtgtgcatgggcggtggggatgtgtaggcataaaaccacaggataggtcagacatgacccaggaagactcttaacaaagcctcaggtgtaacagcaggggcaggctgggcaggggtggccctcagtacagttgcatttggcctcagatttgtgactaagagaagcataatatgaggcaaaacctcagcatcctcctctacagcaggagagctggactacaacagcaatttcagatggcaggcctcaaccccctggttgaccaggaaatctatgtaacaggttataagcaattattttttaagaaaatggaatggaatggaatggaatggaatggaatggaatagaatagaatagaatagaatagaatagaatagaatagaatagaatagaatagaatagaatagaatagaatagaatagaataggtctgtacctcgctcaacagggacagaagcttctgtactcaggacccttccagactcaccctgtatacctgtccacctgcctgttcatttatatcctttataatactctttttttttttttttttctgagacagggtctcactctgtcacccaggctggagtgcagtgacacaatctcagctcactgcaacttccgcctcccaggctcaagtgattctcccacgtcagcctcccgagtagttaggactacatgcgtgtgccaatgccaggctaatttttgtatttttagtagagacagggtttcaccatgttggccaggctggtctcgaactcctggcctgaagcgatccacccatcttggcctccaaaagtgctgggattacaggcatgagccactgtacccagacctatcctttgtaacattctttataatgaaaagattatgtcaagctgcatctcatgtggtaaggacagccattgtttcaggaacttttctttctataagatatatatattaatatctatgcgtgtgtatatatatatatatataaaatctagcagaatgtatccacatgtatatataacacatagatataatacacatgtatatacacaatgtatgctttgcacacacaatgtgtgctttaactgtgggatgtggtctaaaaaatttaggatttactgtgctagatgactgcctctgaatctttttaacacaaacatcctgtggattgttttttctggtgttactgaatccaggcattctgtattaaaatcatcccagactgaaaatcaaaaagaagtctcgttaaattctctctttttcaggatgtactttagccactgggacctgacttctaaggtctctgccactcactcattatgaccactagggcatttatctaatctctgagcctttagttccttatttctgaaatgcagaggctgaccatcacagacctctgaagagcaactgctcacataaaattggagaaatgacgactcctagctcatagaatggtcgtgaggatcacatgaggtcatactttgaatggtgcacccaacacactgtaagtgccatataattttgcctctaagacaagactatgaatgctttccatgtctggtgcttcatgatgcttttgaatccagtattcattttgcacatgcagcctgcttggagtgggagctgatggctttcaggaggccccagggcctgaccactgcaggggctgggaccacagatcgtaccaccaccctttgttcctgcctcctcctagcccttgggaggcaaagcttgtcccctcaataaatgatgaccagaaccctgtgtttgttgcccagcctcctgggagatgggcagtggcatagcaaagggattactttgggtaaatatttctctaaacctcattcttgcctccaccagtgcccagaacgagccggccagctccccaacagccccaccgttccaatgctaggacagtgctgacagcatcagctccctgaatacagggcaaatgacctcactaaaggtaagccccagaattaagcagtggtggcagaggctgggaagcacaagaggaggagaatgcatgaactgttctctcaaggcactagcgatttccttttccagagcaggttatcgtctttacagcacttagtacttggaccaaacagccaccacattgcaattccacctgaggccatggcgggcatccaatcctgcctcctccaaaacgggaatcttggctgcacctttctggacagatggaagcccactttctggtgtgccttccagaacccagggagctaagtcttaatgctccccaaggcaccttcccatcactggcaggcaaacagaggttagtctacccaactgatagctgagaacgctgagatttagttcacaggcctaaaatgctggttcgcaatattggctgcacattaggatcacccggggagcatctgaagttcccagagtccctgccatacccagaggctattcggatttgttccaagcatttgctttatctccccaggagtttccaacgtgcaggtgctctggctcttggttatcgatctcactggtgcctcagagccactggaaggccagttaaaatagagccctgggccccacccccagaggggagtccctgacttgggggttgggcctctgaatttccatttccaacaagctcccaggtgaggctgatgctactggtccagagaggaaactagagctttgagatccagtgctcaaggcccatgtttctagccttaggcttctcagccatggattggggagaatggctcctggcttgagaagctctgttctagaatagcactcctcagtcttctgtgtgcacatccggacgcatctagattcatgcccaggaggtttgggtggaacctgtgctgctgatcctctaaccaccgtctgaggaacaaggccctagactagcaggcctgactgccaaatctacattcttcccacttcaagcaggtctagggccaggcaactcgcccttccctaacagagatctgcctccttgaaacctccactctgagagacttgctctgagccacaggacaaagaaaaagacttcctctcccagaaaggcacccaggtatcctgtccccacctctacctcttagcctctctttctccctacgaaacaatcccccatcctttaactcctcttgctatgtcacaacaaacaaaacctcagggatcttggaagcaggcggactctcggcctctcccagcacttgatggggcagtactacgtgacatttaagtcccctccactggagacgtgcttcctaagtgtccaccacatgctgcatatggtcctcagggcttgggacccagctggggcacaatgacagaaacacaggaagcacacagccgtgcaagaaagctcaccatgggattctaaaaggagtgacgctaacagctggaacaagaagactgcaaaggaagaagatccagttcccatctgcaggccaggggtctcaggactgctagccttctgccctctaagccactggtcccattctctagcctagagagctacaggatatcaagcctcgagatgctggtaacctgtccaagtcatttaacgggaggaggaaggacgacaatggcttacactgtttcccatgcaccatgtgttaggcactgtgtgaaatgctctgcaagtattatttcattcaattctcactgaaatcccatgaaatgctcattgctatggcaccacagtttaacaggaaagaatggagaagaatggagaattacagatgtgaagtagcatgccaaacaggaggtaacagcagtaactgaccccatgttgacgagcctacacactctctttttttttctttcctcggctcactgcaacctctgcctcccgggttcaagcaattctctgcctcagcctcccgagtggctgggattacaggcgcccaccaccatgcccggctaatttttttgtatttttagtagagacgggggtttcaccatcttggccaggctggtcttgaactcctgaccttgtgatccactcgcctcggcctcccaaagtgctgggattgcaggcgtgagccaccacgcccggctcacactctcttaactgccatgtagttgaagcagttaacttgccttaactgcctaaagatgaggcacttaacttgcctcatcaaggaccgggagagaccgagactcagcctccttccaagatccaggtttctatgcaagatggtcccgtcctcaggccatttcatatggtaataaataacatcaagcaatataattgcacttaatacaccaggcaactctaaactacatgtgtatacacatatatacacacatacgtaacttatgtatagataaaaacatacactcattccatcctcacaacagccttctttgtaaatatctagatttccattgtgcagatgggaaaactaaaggacaaagagcttgggtaactagggtctcccagctagttggtggtgaagccagaatttgaactctgacagtctggtttccaggttgtgctggtgacatccccctgccccctccacagttcacattggctttggtgcctaaactgaataaagagcacagttcaaggtgctttctgtgcccacattgcacccagtccagtggccaaatcctctgcaggtaccttgataaacatccagtaaggaccaaacaggtgcctcctgccctatttatagctcccagcatggccagctagctataattagcaaagctcccctaggactggagctaaattaaactggtgggattagaggccagcagcttcggacagtgcctctggacacctccagcaacacaccactggtgatactaagagaagcctcttcaaagaagtagtttggcctcaccagtgggcctttctcctgagtggtgtgtggacccaaggggttcctttaatggcctcctcccaattctagtggctgatctgtcctgagatcccccaattaaatcagaagaagatgagtgatctcatgctctaagggtcagaaaaccagaactctggtcccggctgtgccgctgatcagcccggtggccaagggactcaactgctctgggtttcagctttgcttcttgagatgaagacaggcctatctctgaagtccttcttggccggaaaatcccagacatctcacagatctcaaaaaggggcttccagttaagtcctgtggtagggatcaaatgccctctagagaagggtctgagggaagcctgcagcccccaacgagggaggaggactctgacttgaaagtctggtgtaaactcttaggctgctggtgctgtgagcctggaagaagagaagtgacaacctctcaccacctcctggagcctgaagaggacaaagaaagagatctcatcttccctctcgctccagagtatccagccgccaagggctctgcctctctcgggactcagatgtcacctcctcagaggccttcctgggttccttatctagaaaatccacctgccaccacttcctagccactggccagggcactcccaagacatggactctcatcccctatatatttgttaaaatgtgcattaactgtctgtatctcccactgggatgtgagccccacagaggcagggcctgcatctgtgctcttcacatctagagcacctggcatataccaggcactgggtctgctgactcagtgagccattttggccccaggcctcctttctctgtgctgagcgcccagctgccaacctcccggagtcgttgggcttctgtttttcctgtccaaacagggagggagccactaaaccaaacaggatgaaagggaaagaggggaggtcaggaagccttcttggagaaggggatttcttcaaggatgagtcagtgatgtctagccaaggaagcagcaaggatggagagaagagaaggggcaaagcacagaggtggaaatggcccatgcagggcatctgccggcagctgggagttgctaagagcatggaaggttatcaaagcaggagggatcagggaggcaggggtgtcagtgacaaatggccacaggtgtgtgcgaagaagcctgaattttatcctacagctcaggtgtgggcaaacttctctgtaacaagctgtcaatctgtcacaattactcaactctgccacggtaagcttgaaagcagccataaaagatacatcagtgaatgcagatggctctttcccaataaaactttatttatagatatttgaatctgaatatcttatcatgttcatatgtcgaaaatataatgtgtctattgtttttttcaaccatttaaagagatagaacccatccttagctcatggactatacaaaaagaagtggccggtagactcctgctgtgggcaatggggaagttttgggaggttttaagaaaaagaaagacaagatctgggttacgtcttcaagaggcctctctggtggccagtaaagaacggaccagtgaaggtgttattccagaggctgggagaccctcaggaggcccttgtgatggtttaggtggaagacagaagggatcccagcaaaggaaatgagtcacagaagctcccctagaaagtgatttccatctgacccattggggcagtgaggcaggtgtccccggatgtttcttccatgaacagcaattgaattgaatgccaaatttgaatttggataacagcctctcgtcctagcaaaccagattaatactaatcactttccctccccacacatatccagctaactttccataaaatgctatccttaataaatccagaaaacaaacaaaaaccttcaatgtctacaataagattatagtatatatataagaaatgtctggccgagcaccgtggctcatgcctgtaatcccagcactttgggaggccgaggcgggcagatcacgaggtctggagatcgagaccatcttggctaacatagtgaaaccccgtctccactaaaaatacaaaaaattagccgggcgtggtggcgggcgcctgtagtcccagctacttgggaggctgaggcagaagaatggtgtgaacccaggaggtggagcttgcagtgagccgagatggcgccactgcactccagcctggacaacagagggagactccatctcaaaaaaaaaaaaaaaaagaaatgtctttattttcagaaatgcaaactaaaatctctagggatgaaatcctgtgatattggtaactgactttcaacatatttcagcaaataaaaaatgaacgcatcaaaaacagctccaatctctactgccttcctcctggcccatgacttgggaaatgcagggcagggtcagcctgccccaggatcccacacacacttctaggaggtaggtgtctctggatccatgtggcctgtgcatgtgatgaggggcctcttgctcctgcagaagagccatctgtgctttgcaaaagaggtcagagtcccaagccatagcagccaagggcagagaccaaagtccagacctgttcctgaagctaaaccactgttgcaggtacctttgctctccgtgatcttttgccaatgacccaaaaagaagctgtgaatttctgaccctgcactcataaatgctggtgtccatcaagcccttaccatgtggcccaatactttatatgcattattatctttcctaaacttcacaacaagcctatgggaaatatactattttctccactttgcagatgaggaaactgaggcttagagtacaacctgtgccatcatacaggtccccacacctgggaagaatccatgcttggcttaatgctctgctatcaccatcataaaattcttcatacattttataggaaccctacattcgcattctgcacaggaccctgcaagttacatagccaatctcactcaggtctcacggctcactggtggtgacatcaggggtaatgcaggcagtaggactccagcacctgcctgccatccatgacagtgttagaaatttcatgtaagtggctatttgattccaggctgctaaaagccaaagccaggacagacaccaggctctgtttgatacccaattctcaacacttttttttttttgagacagagtctcgctctgtcacccaggcagagtgcagtggcgtgatctcggctcactgtaacctctgcctcccgggttcacggcattctcctgcctcagcctcagtagctgggactacaggtgcccgccaccacgcctgtttaattttttgtatttttagtagagatggggtttcaccgtgttagccaggatggtctcgatctcctgacctagtgatccacccacctcagcctcccaaagtgctgggattacaggcgtgagccaccacacccagccccaattctggactcttaactcaggcaggacaaacagttggtggcctgggcccacccaactgccgtgctcagttgccttactccctccactctcagcctccttgagaagcacctttcctctctcggccacttctgtttcctccacagtgaccttggaacggtgactaggagtgctgcaggtggtggccttagaaggacaggggccagcccagtcccactctccggctgtcactgaagaagcacatgctcctcaatggaggaagacagcttcaaagagcatctgagttttaggaagggtaggagacagctggaacagaggccgattctgccagctgtcatcggtctctgatctcctggcaagaaagctggccatagagtaaaacctctttttaaaaattcagcaaaccaggagacataccctcagggtgtagctctgaggttccaatatacatattttcccagggctgagaagactggaaatttctccagcaagatcaaatgcaatgcatctcaacccagacccaccagggcaaaagcagaatctgtccccgaaggtcaacgacatcatcactgacattgagtctagctcaggctctggagctggtctgcctgggcttgaatcctagctctgatgctcgctagctgattggccttggcaagttatttaacctcttcatatctttgtttcttcctctgtaaaacagaaataatgatgcctgcatcagggttattatgaggcataaacaacttaatatatgtggaagaggagcttaataattgctagtgattaaagttgatatcatcattttcaagctctgcttagggacctgaagaaatgctcattccctacctaatgcaagcggggcttaaaacctagatgacgggttgatgggtgcagcaaaccaccatggcacgtgtatacctatgtaacaaacctgcatgttctgcacctgtatcccagaacttaaagtaaaatttttaaaaaatgttcattcccccggaagtagccccaaccttgccatgccctaaatccgctgctctaaaatccctaacacaagcaagaagtattgcctcttcttgaccaactgcaaggaagtgcctgcttctccaggacacctacaagggcagctcacagagccatgcccctcgggggacttcttgaccttggtggtggaggccttggcagacgctcaggtgtttggttccatatttgcttccagataagactgtttagtagacatgcaactgcttagctatgccccaaggcatggggcaagccaccagccagggagggcccacttcctctgactcatctgcacacatgacaggccaccagccccatccgccaatagcaaggcaaagctgactcaggcaacatgagattacgagagcatctccctcccctcctacttcagtccacagcaatctgtgcctccaaccttctttgtgctacaaagataactcactggtccaggattatcatggtacctctgtgacaggctcatcagcagggctgctcttgccaatctcttactgctcagagcctggcccttgtagctctgcctgctcttccctggtcctgaaccttgcttctgctccttggactcccaggttgggcttcttcctggtcagtcttatgcaggtctgaccacaactagtcccactatgaagcccatcagaaatgaggtcaatgcatcactggcccagtttcacagaaagatggacgggggcacaaatggctgctggaatccaggtcctgacaaatagagacttgatagagcatggttgaatatttctcacatagggacacaagtccagaaggcatatggcatctctgagtactggatgtcataccaggagagtctcatctcaaaaggaggtgatgatcatgtatttggccttcaaagcccatgctgctataattttctaagatctgaaatctgagtaatacaacagcagtcagcttcatgaccaagagcccatccttgagggaaactgactcttcctcctctgatgagtgacttgactttccaggcaagtaaagcaggattgagcttactcctgggtctcagggttgcctccctggcctggggcagagcagatgaagaggaagtgggtgttgattcttagtggtttggggcttcaaccttgtcacctacctttcaggcctagcctcagtcctgactcaacaggagaggccaacacacccaactccacttcctaaaggctttggtgcccaaccccaagtcctgatcactactcaggaaggaaatacaaggaaatgccttccaggtaggaaaggaggtataaccatatgtagataaaaaaggaactttccatttctgtaaattgaagtcttattcacacaagagacagattgcagggggctggatttatggggtaagatgattaaattctgtgtcctctttcatatgtcatgctttatcacgcattactaaggatctgatttggtggcaatttgttgatttcttcagttcttagctcagttacaaaaacgcagtgagcaggacttgggtaccctgccagtcagctccttagggtcagagaaacaccgtcagtccacagtgctttataaccacccaaccaccttagacggggccttggtattcactacccactcgtcctcccctagcaacaagcaccaacaatccaacatatacgtaagacttgtgggaagcccttatttgtctttatagccacagaatgtggtacatttaagttgttccataaatgtttttgtttttgttttgagactaagtctcgctctgttgccaggctggagtgcactggcgcaatctcggctcactgcaacccctgcctcccaggttcaagcaattctcctgcctcagcctccagagtagctgggactacaggtgcatgccaccacgcccagctaatttttgtatttttagtagagacagggagggtttcaccatgttagccagggtggtctcgatctcttgacttcatgatctgcctgcctcagcctcccaaagtgctgggattacaggcataagccaccacgcctggccttgttccataaatgtttttaaagaagaacatgctccctgaaatccagcccatacgccattcagtctctgactctgtctctgacagagacactcaagagtgagctgggagaaggcctggctgtctgacatcacctaggaggctgaggtctgacccagtcttccagaccctaagaagtctcacagagaacccagcactcggctgcacttaaggcttccacagcacgctgttccagcatcacctccagctccctatgggaagcccacacacctggccaagggacactggagcatgcactccctgcacagtcctctcagccactctagccctttgctcacgttcttctctgaccccagaacaacctccctacccttctccaagctgtccctcaaaacccattgatcacttaagaatctccatagcagatcttttgtacttggcatactgaactctgaccacatgctgggcagtttgctggatgacaggagtaccaagaggacgaaaacacatgcctgctctcaggccactcagactatcgggggaggtgaacagaggaacaaatggctgcaactcctgcacagtcagactggctggggtgagtctcagccccacaacgcactagccgggtgacctgaagcaagtcgcttaacttaaaatgtctgtttcctcttctctcatatgaggacaagcatggtactgatttcaccaggccgttgtcgcagttgtatgaattaatataattaaagacaacatttattttactcaaaaattactggagtaagaggagtgaaggtaatgcacaagctatattacttggttttgtaccaagctcttatcagattgctttcactagattggtgccctgtgcacatggcaggccctcaagaaatgtttgtaacccttccttgaacatgctctgcactttacccagcttttctgttctcatcacctcttcaacattgtttgtataaaaattatgtattctgcaaggatgagatcagatgccacctcccctaattaggtttacatgcttcatgattcccagacgaacaacttccctgtcttgtttttggatttctcaggcatctaaaaacaggtcctcaccaccttcagttatacccatccatataggtatactatatgctcctatcagaccacagctccttgaagacaaatactgagattcatgcattgttatttggggccaaggctctagcgacagaacaattaaaaagcagtgctatttctgtaggggagcactccaaaactcctttccaaaacctttttctcataagcccatgagccagaatggctttccagaacctcatttttatcaaaaatagaaaccaatctgaccacgcacactttatatcagagtgaaatggaacatcccaaacttttatcaacatgcattttctgttcccggtatataataaagggtcccaatgtttatctaacatttttctgaaatcagtatgtaacactctccacttctgaatctgatggggcaccagtcagtttcatagtcatcactggagagactctgtgccagattttgtcttcagttgtaacacaggatcacatggtcactctactgagctattcccacccacactcttggttctagggatgatgaagggaaaaacaaaatggttctagcacctggatgcagaccgttgcatgttcgacgtccttttcttgtgctccatatgaaacatgtcccagatccttcacgagcaaccctccactgttcagtttcataggagcgcagaaaacaagtccagtttcaagtaggtagtaatttctgtttcatttcatgaacaaaatagagatgcagcaataaattacatgatttgagccctcattagtagacagtaaatgtcactgtttattaaaaagctaataatccattcaattttttaaattaagcaataagactctaatataataaatttgaataattaagcctaatattaatggagtgaaaacatgagggaagaaagaagttctaaaatctttatttttccctccacataaaacatgttaataatgatcccacaggtgaaagaagtttctatgtgcataccagtggagtacttatttgtcaaagcaagaactcacacgtatgcttagatggctggaaatctctagggaagtacagagaactctcctaactcagccctcactattgactcctagctctatttttacctgatctgtttttattgctggactccactctctttccattacatacagcctaagaattttctactccagctagaaagagctctgactaggacacaagtttacaaccaggatggttggtctgtacgtgctgtcttctccctgctcaataaaaggagagcatccttgtgttagaaatagcttggtatctgcggccataccaccctggacacacctgatcttgtctgatcttggcagctaagcagggtctggcccagttaatacttggatggaagaaacaactttgcacaacagttctaaacaaagcacagtttgaacttattcttcctgccacacagccttcccaccacgtgaggccgtagcatcatctctgcttggaaactctacaccaagattgcaccatcacgccctgaagaaggcaagaagccttttctcaggccactgaatataggcttatgtaaacaggcagtataactcagtaggcggagatgaaacatttgcacttctctccaagcattataatgagaaagcaaaactctttatacaagctaaacccttttctacattcttaagtgtccaaacaaacttttccccagcagcctgcacttctatggctttgcattattgggataagccaagagggagggaacaggagcctttcctcctaagctcagagagatcaaagaaaacaaagctagagagtgtgagggattctgcttggtgagcatttctcagcagagtggactttctgtgtctgggctgcgggcccctgagtgtccggtgctctgaggacaccttcagtggaatctgtggaaggtacacatcagatctgctcccagtaataatgccctgctttgcagaggctgttttgctttcccaggtgctttcatgtcttttattgatcaacaagcaaacacttactgagcgcctatcagatgcagggccccaggtggagttatctcaccgacagatcatctcacggccccagtcttcagatatatgtgccactctgaaaagaaaataaggcccagatctgccttcaagatgtttatagtttatttggagacataagcagagtcccacagaaagagaaataatactgcaaagcactctattttaagttagtcttcctcaaactttgatcataatcacaaccacattaggagcttattaaaagtcaaaggggcctggatcacatctttggagattctaattccatgggaatgaagcctgggtccctgtatttttaacaagcagccacaaagattaaaaatttaaaacctaagacagtgcctaagtggcaaatgagacagtcactcctgttggccgaggtcaaaggactccagcaaggtcagacataaaagagacctgcaagggcagacaggaggctgagagcagaaaggcagaaaggggcaaggtaggaagttaggagggagagggggatagggtcccaagaacaagtgcaatattcatgtaggggacagaatgcagaaaattctggatgtaggagaaggctgccctagaggattgagagatcaagacagacaggtaggtctggagtccagggccgtgggactgcagtctgggccctgatattttatcatatcaaagtaaggaggatcatgaatgacaggtgtttactttagcctggaggcaaagggtgcctcaggaatggcagggccatgagagcagagaattttagacagaggtcccgtgctaggcctggattgaaaccatcaggaagaccggaagctgggcccaaggttctagtaagatattttaatatcctgttctaccctcaccacagatcaacgaactcagcaagatagataatattatcttctttctgtagagagaaaactggagcacaaagtggccaaacagcaagaggaaacctggggaagccagaacagccatgtggctggcgctcatctttgacaaatcaatccactgcatttcaagcctattcaacatacatttattgagtgcctactaccagcaagaaacaagaagcagcaagataaacggagtgccgttcctgccctcagggagctcacctcccaggggaggagctggcaaacattttctgtgaagaaccggatagtgaatacttcagactgtgcaggccagttagtctctgtagcaaatgctcacctctgacatagcacaaaagtggccatgcacaatacacgaacaaatgagcatatctgtgttccaataaaactttatttacaaaacatgcagtgggccggattcgacctgtaatgtaccaatccctaatctagtgggtaaaacaaaccccttcatggctacttataaaacaagagaggtgtgttataaataaaacgactttgcagcccaaaggaaagatagagtaatttagtctggccatggatgactggggaggcagcactggagtaggacaagtacttagttttctaggtctcagttaaaacgatggggctgaatcagaagcacatggacggcccttcttgttcccgtgttctctgacttggatgtggtgctcctttcctgcccagagtcttccaactgcacaaacaacgtggcctctcccaagctccctgggcctctcctcacctctaccatcaagttttgaatgtcaattaaggaataaaaattcctaaatgatcctggaaggctgaacacacacacacacacgcacaaagtgtgtgtacatcctactgtgtccggaattggtgggttcttggtctgacttcaagaatgaagccgcagaccctcgcggtgagtgttacagctcttaaggtggcgcgtctggagtttgttccttctgatgttcggatgtgttcggagtttcttccttctggtgggttcatggtctcgctggctcaggcaggagtgaagctgcagaccttcgcggtgttacagctcataaaggcagcgtgggcccaaagagtgagcagcagcaggatttatcgcaaagagggaaagaacaaagcttccacagtgtggaaggggacccgggttgccactgctggctgcggcagcctgctttcattctcttatctggccccacccacatcttgctgattggtccattttacagagagccaagtggtctcttttgacagggtgctgattggtgcgttcacaatccctgagctagacacaaaggttctctaagtccccaccagagtagctagatacagagtgtccactggtgcattcacaaaccctgagctagacacagggtgctgattggtgtgtttacaaaccttgagctagatacagagtgccgactggtgtatttacaatctcttagctagacataaaggttttccaagtccccaccagactcaggagcccagctggcttcacccagtggatcccgcaccggggccgcaggtggagctgcctgccagtcccgcgccgtgcgcccgcactcctcagcccttgggtggtcgatgggactgggcgccgtggagcagggggcggcgctcctcggggaggctcgggcagcacaggagcccacggaggggcagggaggctcaggcatggcgggctgcaggtcctgagccctgccctgcgggaaggcagctaaggcccggtgagaaattgagcacagcagctgctggcccaagtgctaagcccgctgagcccacacccacccggaactcgcgctggcccgcaagcaccgctggcagcccctgttcccgcccgcgcctctccctccacacctccccgcaagctgagggagccggctccggccttggccaccccagaaaggggctcccacagtgcagcagcggtctgaagggctcctcaagtgccgccaaagtgggagcccaggcagaagaggcgcccagagcgagcgagggctgtgaggactgccagcacgctgtcacctctcactaccaccgccagatgctaagtctaaatttatttaaatttctaaaggttttctccctccttcccagaacctctccctcctgaaaaaggtccagctgcttctgtaccagacactctagcgagactcaaatgttcttcctgaccaaatgcccacctcaagaagaacctggagccaggaagaaaccaagggtggccacacacctcatctgccctgctgtgctggtgccaggcgagaaaacagaaatagagccacggagctcaacagcaacacctcatatggtgccagcagacagcgagcaaggcccaggcagataaacacattaaggcaggctgtgcagcgcaggccacgtccaggcctcagagggacttcatctcagccagccaaggtcaactccattctaaggcttagtcagcctcctcctctgggggctcagactcccctggccaagatcactcatgtaccaagaggattggacaaggccacgagtgaggccaggtgccagcagggcaaaggcaggcaaaaggcaccacagatcgcatgtggtggcagcaagccagctgtgtatagattcaagcctcagacccacctctgaaaatcctaccctactcaagcctgaccacctcctccaggaagccctcctggctcttgctaattagcagtaaattgtgtgttctcttaacatctagagtaatacttctcaacatagggttgcgagaccagcatcatcaataagcaccacctgggaagttgctggaactgctgttggaagttctcaggccccacccaggccaagcaacttagaaactctgagggtgggacccagcaattggtgttttaataatgtcctcctagtgattctaaagcaggctgtggtttgggagccactaatccaaagtctagattctaaaccactaactggacacctgtgttttacatgcaatccctgtgctcctggcttccctgggaatgtggttgcatttcagagcctggatcgcacatgcccatcaatcccccaccttgcccagcccaggatgccacagcaagtacttcctcagcaaacacctgtggaatttaattagcttgagttcagataccaccatcaggttacaaaatcacagaacctgaatgctgaaagaggctttagtgcccatccagcccaactgcccatcaaggctctgccaggacccagcttctccacgtttctctcaggtcaggtcagatgctccactaatgcctgggagttcagtctcattcgttcgcccagcaaatattgactgagcatgggtgcgaggcacacacagatgttcctgcacacaagtgaacgagaccaatgagaatccttgctcggagggagcagatattccagtggcaggagagacccaatcaatagcaataaataaataaaacaaaaaaaaacccatatgctttaaccattagaaaacatcagacacaccaaaatatacagaccgcctatgaaaataactaaccagcactcttcaccaatgtcaaagtcatgaaaggtaaggaaagacgagtcacaaaagcacactaaggagacatggtgggtacatgcaatgtgggaccctggactggatcctggaaaagaaaaacagcatcagtgggaaaagtgatgatatttgaggaaggcttaaagtttgacatgcagttttagaccaacatgaaacttgttcttttctatagtgatgtaagatgtgaacaattacgggaaactggctaacaggtagacaggaattctctgtactaatttgcaaattttctgtataatattttgatggcaaatccagttgggaaagatggtccaaataagaggtgaggtgcagttggcatccttaaatagagaagtgacatgtgggcaagatgacatttgggcaagacccagaggcaggaaaggggccaaccagtggcactgtgaatgacatgaggccaaactcagtcttgccaggatgtttacccgtttgtgcttgttcttctatccagatgaattctgaccacgctttgaacacttacaataatgctggaggaccctcagtcttctctttagaggaggcctcacagtcctgcagctgtgcccactgagtgtgccccggcagcctgagcccctggagtggacagtaagagagagcgcacaaaggcagtggggtccaataaagaccaaggttgagaccaggagcacctccaccttctttgttctggaattgccctggtctctttttcttgccagcaaaccactttagttcctactttctcctctctttgaccctgtgcccaagcttctcagcatgtgagcttctcctctaagcactgtccacatgcgcccagaaccttgagcagtggagctcagagcagggttgacgtgagtaagcagacatgagtcaggctgagactccacctaatgactaaggatcaacgtcccacccaaagttcccatgtctagcccttcagaaaggacagggaaccataatccaaagtaaaacagcctactccctaggaatgacagcccacagtcctgagttctagggacctcaaataagtctctcccttccaggcgccaggtcaccatctataaagcgatacatttggattagttaatcctcaagatgctttccagttctaacactgcataatcagtaatgtatcaaatgaaattgtgcaaggtaattgcagctttgaagtacaatgtggggtagtaatggtagcagtgatgagatctatgggctcctaccccaagtgaatcaccagaattggaaatggtaattgttactattaatataataatgtcttaaattgcagagtgcttttccatttacaaagcatttttatacacattatcttgtgtgatcctcataagaacccagtgaaagtggtaggaaaaatgttatttctttggcatagatgaggaaacaaagttcagtggccattcaattaggagtgacggtgctcagccctgagcgtaggactcaatgcctcatcttctttctgctgcttggtgctgtctttgctactccaacaacctgtgcaaccatctgtgattttgtctctctagtttttgaccaggttagttcaaggcatctgcacaataaggaaacccaggcattcccctggaggggaaagcatccaaattgtgcccagagctgccttggctcggtccatccattgggctcctgggagcacagtcctcgccaggaggggaggtagcagtattctccatttgtctccctgcagctcaaaatagaacagatgatgtatcacagctgatctcactgcagcatcagatgttttaaaataattaaataaagagaaatgggagtgtgaagaaaaaggccccaatttttcaacgctagtgtcccatgaaagtgaaaagaaagggacaatggtcaaagtcaaggtgagggggcagctcccccagaggtgccaggtttacagccgttctgtccctgccatccaagctttcctaccagtagcaatactgtcacccctcaccattcggttgcaatttgcaaaaggcaagagacaacttcctttcttgccacactctaggatagaagaagcactccagccagccaccaatttcccctcgctaagcagcccttttctcccatgcccactacatgcagagggtgacccaggcacacccagagtgggtgctcttgtgtcctgtcggatggggccagtcagcatgagagctctttgttcaaaccccgtctccctaccatttgtgtccctacctaagtgcctacccttgcccacgacacttatctccctagacctcagtctccacggttctgaactgggagttagaagcactcatcttacttcctcatagggttgtcagtgctatgaggatggagtgagatcacacttgagaagacacttcaaaaacttacaagtcccacagggcactaagagaccatggttcaccaagcacctggtcaggactgataacaatggcgtatggctggcctttcccagcctccctccagttagatggactggaagatcaagttctggccagcagaatgtgggcagagtatctgctctataaagccttcacacacgatcctgctccctctttttctcctctgccagctgaagacccagaggaggattctgggtacctagaaagggcagagccacagacacaccctttgattgtgttacatggctggagttgagggttgcttgctacagcagctaggccacctggactagcaaaatgtcccagtggagtagctgcctagaaaatctcacaatgaggttgtaaattcaagtgagtggaaaaaaaggttttagtggtcgggcgcagtagctcacgcccgtaatcccagcactttgggaggccaaggcgggcagatcacgtgaggtgaggagttcgagactagcctggccaatatagtgaaaccccatctctactaaaaaatccaaaaattagccgggcatggtggtgggcgcctgtattcccagctactggggagactgcggccagagaatcacttgaacctgggaagtggaggttgcagtgagccaagatcacgccactgcactccagcctgggttacagagcaagactctgtctcaaaaaaaaaaaaaaaaaaaaaaaaaggttttagtagcaaacagtcaagtttcctcataattcttccacccagtaataggataaaaatgagaccatataaaagatgtaccccggcacatggacttcggggccccatagttctgtgacgtctgtgttcaacctgtttgtggaacagtcagtacagcacacaccaaaatgcagctcccatctagattgttgctgaggtgctcttccttttctcaaacacctattaatagatttacactcctgacaataaagaagcgcggatcaacctctaactagccagacaggctagtttttgttttgttttgttttttgagatggactctcactctgttgcccaggctggagtgcagtggcgcaatctttgcctcccaggttcaagcgattcttctcctcagcctcccaagtagctgggactacaggtgcgcgccatcatgcccggctaatttttatatttttagtagagactgggtttctgacccatattggccaggctggtctcgaactcctgacctcgtgatccatccgcctcgacctcccaaagtgctgggattacaggcgtgagccactgcccccagcccagataggttagtttatccaatcacagtatcaaatgccctcctaatgtggacaggccatgctgggccacataagagactaataagccactagaaaaaaagtgggggacaaaggacatgaaagacaattcacaaacataaaacaaatggcccccaaacatgtaatgttcacccttactcatacaaaataaatcacgtctcacccattagactggcaaaaatcaaaaagggtggcaagatctcgaattgccgaagaagcagggaaaaggcactcacttgtactatctgtggacagggacactggttcctctccagagatcaatttcataatatctatcaacttgtaaatggcaagtccctttcaattcagcaattccacttctagaaatctatccaaaagaaatcctcatacatgcataaaaagactcatacacaagattattcattgtttgaagtgcaacagatgggacatggcctaaatgtccaacagtacaaatcacacaaatacatttggctactaaacagatgaaaagtctaccccaaagtttacacgatcctgctccataacatccggagattgggggttgggggaactggcaatcaagcgcatacccacagaggttgtaccaggatttacatgcgcacaagaagggatgctatggggaagcattatccttaagatgctacgggagcacaatccaatgttcgacaaggtgtgaatctgtttccatgcagttccttggtgttgtgcttattttaaacatatggaaaattagccataatgcaaataacacagcaacagctgtgttttcatcttcttggctattttgacgtcacagccatcaaatacaagctccaaaaaagagcgaatgatattgttcccagcagcacatgccaaaaggccacacaccttcccacgggatgaaggattccagggacatctctttttataggtgtgacttcccctctttgcagagtagctatttagcaactagagggcaaagccaggcaactgagacttaggaacagaattatatcagagaaattggcgacaacctttctggagcgaaatctaacagtgtctattaatattctatatagacatacaccttttgacttaggaattccgctctctcaacaccagcatgaaaggcaacatatatgagatgtagtggagaaagaaaccataccctgacaacaacctgaaagtccatcaaaagagaatgattgaaaaaattatggtacctctataccgtgaaaattctgtaattatattttaaaatgagatctatatctacaggaagatatagatctcatctctcctgcctcaggagagatgttcaggatgaaaaacgtagttatcaacaatgtattgtatatttctaatgcatatttcaaagtagctagaagagaaagaatttcagatgtccccaacacatagaaatgataaatactcaaggtgatggataccccaaattccctgacttgatcattatacattccacacatgtaacaaatatcacacataccccataaataggtaaaatattatgtatcaataaataataataaattgaaatttaaaaagaaaagcaagaggcaggggacaagaatgtaataagatcccattttcattaaacaactgaaaagccatatacaaggctcacaaggccctacccaatctgccctcctccaattccttcccctccttctgtgacttcatttcctgcctttattcctgtcacatgctctgctctgtcccattgacaggacacatttctaggtacatcctgccccagggcctttgcacttacccttggcctcagtgctccttccccagaaagccatatggctttctcccaagttccttttggtctctgtgcaaaactgaccttctcagtgaattctaccctgatccctcctttaaaattacaaaacagggaggaactttatcctgttttatttttctccatagcacttatcattggctgcattcacttctctgtaagatatttttgttttgttttgttttcatttttattgagactgagtctcactttgccacccaggctggagtgcagtggcgcgatctcggttcactgcaacctccgcctcccaggttcaagtgattctcctgcctcagcctccccagtagctggattacaggtgtgtgccaccacacctggctaatttttgtatttttagtagagacagggtttcaccatgttggccaggctggtcttgaattcatgacctcaagtgatccgcccaccttggcctcccaaagtgctgggattacaggcatgagccactgcacccggcccactgtaaaatattttaatcccctggactgtcagctccaagagggcaagggtttttccctgtcttgttccctgtggcatccccagcacctagcacacagtaaatatccagcaaatttttgctgaatgaatggaaaacctgtttgcctatcttgacccgggcctggggaaataagtggaagggtccaccctaggccctaagcacttggccaggaaagctgcaggagaggagtgcatggcatccgagagccatcaaacagtaaataagaaagactttctttttctccatattatgattccaccagttgctgtgaacatatgctatttttataacttttgaacacacattaaataaaacaaaaaagcaaagatgtaagtcagactcagaggagcagtgtggaggggaggggagacaacgcaaagagagagggacccaggccacgccaaacaaccgcctggctctctcctccctcagaagaacccatccctgccccgcatccagtgcagcaagcgtcctgggaaggtcaggctgtggctcatgaaagacactacagagtagatgctaacccaaatccgaacactcccagactctccctcccacccagctcagctggtactagaggcagacaacgaaaagctggcagaacaagacaaatggtggagaaagtaaggtctgaagaaggtggggtgggtagaaagcagcaaaaaggaatgagggttggtccagggggccaggccccagctcagcctcctagtcactgagtcagcttgggcaagggtgctctaacctctgagcctctggttcttcctccctaaaagtcaaaataaaggtatctgccttgccccagtgggctggatgtatacgatactgctttatcatgctgtacaaatatcattagaaagagaatcagcagcgtggatgcctcactggataatgcaaaaccccgccccacacggagccttggtttcctctattgtgttttccaattatttgctgttggtctatcaaaaatgcatttaatatgcattttaatatctgacctttggccacctggctcaactctgttgcttctaataatttatacattcggagtctacgatttcctccagccagatgatggctgcaccagaaaataatgatgccttcatctcttcctttccaagacttatgtctctattggttttctcttgtggtattgcgctggctctgacctagggtgcaaggttgaataagagaggtgatagtgggcgttcttgtcttctttttaacctgaagggattgcatctcatgtctatctatcaggaataaggtttgctagagatttcagtagctatctgtcttcagattaagtaagttcccactgcgcagagttgacgatgtgtgatcatgaagcacctactggatcatattgaatgtcatttcagcaattagagagatcattacatgattgttctcctttgttttaatagaggtctgcaaaacaaggggatgcctctacccaatactgcctttcagggtcaggaggaacaaggcctgggacccggaagataatgacaccactcccacctcagccgccagcctgagcccctgatggtccgtcctcctgtgtgccacccctcctctcctcaactctgtagctctctgggccaatctccttcacctccatcctgaactctcactagtccttaaaatgccacagacttgtccctgtgtgaagtcacaagagaaagctcactgccaaccatctccatgtcacaagaagtcaccctgagcatacgctgtgggaagcaggctgatcgcatcattttttcaggatgagcagttcaggattctgatgcaaagactccacatccaccttggcacatgctaagattcacatgaagctattccaaaatggaacaacatacctaggaggcagtgagctccctgctaccaaagatgagaatgtccccatgacatttgctacagaggtatttctacaaaagatgaagagtgacccagagtcatctgtaaaatgaaggtaatcagacctatcaaaaggtaatggaggaggaggaggtggcagcctagtggggagagcaggaggtgggatggactgacattccaagcacctgacatacacctcgtcacttagtcctcacagcagcccctgtggctatcaggacacagagaagttgctacaaaacacacacacagaggccgggcacagtggcttatgcctataattccagaactttgggatgccaaggcaggtggatcacctgaggtcggcagtttgagaccagcctgaccaacatggagaaaccccatctctactaaaaatacaaaattagccgggcttggtggcacatgcctgtaatcccagctactcaggaggctgaggcaggagaatcgcttgaacccaggaggagaggttgcggtgagctgaggtcacgccattgcactgcagcctgggtgacagagcgaaactccatctcaaacacacacacacacacacatgcacacacacatatgcgcacatgcacacacacacatacacagacacaccttgttcaaggtcacatagtcagtaggtgacagcgcccaggcatgcaccaagggcttctgttccagtccttaagctcactccactccaccactccccctcccaggctccagggtatgcttgtcaaactgcctaacacagtgacagccacataatgggcacttaatgattctccccagattcagatggtcagacatccctcccactgagcaaagtcaattttctcatctgcgaagcaaaagagagacttcatcttggcccttcacaggcaggaaggtctgactgcctggcttttacggtcagcccttgccacctttgcaaaatgtattcagaaacatgatctcctttgagcttcacacctctaagaggcagggtctcggcagagaaggtcactggggctcacgtggggaaggttctgcctgaggtcccatgctgaactagcacactcacatccagggacatcagccacctttactatctccaccccaaagcctcatgagtgaaaaggacggacgatctctaagatgtcatgaaaacacggagatacaattgaacctatcttcaaacccaaatgtgtgccattgactaatgtgtgatgtccactctctaaatggtgaagtgaagaagcagtcagcataagattccgccaatcaagcacaaataacaccatcgccttagactcggaccatgtgatgacctttatacccgtggattacatattgactctcctttcataatctaggcaccaaaatatctgctggcagcttattcccatcagctgcaggacaaagtagcttctgcatttggttccaagacaggagtcagcaagacactggaggccacagtccaatcccaatggtctgtttattgtctgaggtcattaccatggtgtctcctctccccgggccctggtaagcaccaaggccactttatttgtcagtgactcaaccaggaaccacatggacttcaaggcaacctcctggccctcaaggacacagagtagctaagccaaggatacagcaaattttttggaccaagagccaaagcaggtggcgcagactctgctaatgatcagatccaggcagtacagagttctgagcaagggatatagcaggagtccagctccagctcccttgatttcgagaagagccacaccacctaagaaactcaccttgctcctcatcaaaactgccctattctaaatggcactgagaatgagactgtcctttatacttttcaccatcccagttggtgggaggggtcttttgaatgtattcccacttgtgagggacacaaaactcaccaatgcctgacagcaaaatctgggggcaggcttcccaggtctcccatgtctgccctggcactgaagcctggtttgggggagacggggatgcgcttgtgataatgccaactcttcaggttctgagcactctcatgtctgtcatagaataggataggggttcactattgtagcatgacacgggctcagaaaggccacctattgtatgagcacatttagatggaatggccacaaggggcaaatccgtacagacagacagcagttcagtagcgtctgaggctggggaaggaggggtgtggggagtgactgctcatgggtatggggtttgtttcttttaggttgatgaaaatgttctggaattaaataatagcaatgattgcacaactctctgtatatactaaaaaccactgcaaatgagtaaattttatagcatgtgagtgatacctcaataaagctcggtttttaaaatttgatggtgtagaagaatatggaggtagcacactaggaggtgcttccctgccccacaagctgtctgtcatttgtcacctgggcactgggcacatatcagtcctacctagcagcccttgcaatcctaccataggagaccagcaccccacacgggcatttgttcagccctccagcagcccctcctgccagccaaccaccctcatccctcccgtggatttcggggttctgagtaaccaaagcaagcatgggaacattctcagagcatgtccaggggacacctccgggaatatgcattcatctcagaggggagctgagtgcttatttgacaagcacaatgtaaccaagccaagaatggggaagggtatgaaacaagagaggcggccctcttccttctcagggaagccggggctggcaggaagtggggctgcaagtccaacagctgacaccatcgtctatgttcctctgagctgtgtgcaaggaagagtacagtctggggctgcaggcatgacagacttcagagggaaacaaatcaggcataaaaactgctagaggttccattagcaagacagagcaaaaaataggattcccacatcccccctggtgccctcagggctccttgtaccactaaaaataaagcaacaggcaatggtgtttttaatgccagcgttcgcaggacttcctgcagagtcaggcttgcacagcttccttcggtcccccccacccatctccaccccctcagccatggatttctgcagcaccaggggccagcaaggagcccaggactgaatgagatgcgtccatggatcatgaggctgagatagatttccctctgttgtcccacttcaaggatgcagtctggagcttgcaatccaaacagggagacaggttctgtgtcccttcaggagaacagggtctgagcatttgtgtcataagcagggaaggagagggacctcagatccagtccatgattggacacacctccctctaacctctggcatcctggcaggcatctgggaggaggagttagaagaggaaacagctggggccgtaagtcaggcgagttcacacccaaccacctgccccattacacagcagaaagcacctcccttactccttccacagcccacaccccacaacccagcccccagggctgcccagtactagctcttgacagaggactctagtctctcagatcaagaacagccctcagaaaggcaatatggctctcagtgattctaagtgcagacactggcattgggctgcctgattcaaatcctgcctctgccacttgctacatgtgtggccttagacaagttacttaacctcagttcccctacctgcaacatgaggttaatgacatttcctgcctccaggactaatgtgaattgctcacaacggtgcctgacacataaaggtgtgtgataaaggccagatattactggggaccaactaacactatctttcctagggagccactggcatctgaggctggcagccttctcttgattctccaggttgccctgtgtgcagcaggatgccaacttgtcctggccccgaggaagtgaatgctaggagttgctcctctagtctaggtgacaatcaagtcagttcagtggtagggacaggattcaaaccaagctttgtctgaccctaagcccatggctttcactaccattctacactaaactatcacctgcaaaacccacagtgggcataaaaagcctcttttgtcaaggacagtgagggacatagtaacagaaactgaaagagaagaaaaaaagaagtctcaagaaaaaacaatcagcaggcatgatatttattttagtttttaaaagttgttggccaggcacagtggctcacttctataatcccagtactttgggaggctgaggcaggaggatcacttgaggccagcagttcaagaccagcctgggcaacagaatgagacctcatttctacccccaaaaaatttacttaattaaaaaaaattagctgggcatggtggtgtgcacctatgtcgcttgaactcaggaggtggaggctacagtgagctatgattgcaccactgcactccagcctgcacaacagagcaaaaccccatcccccgccccccaaaaaaaagagttgcctaattcttcatctcaggtcccttttagaaaaacttatgtcatatcccataaaccaggctatcattccttcctaaagattagtagacctaagtaggcaactagaaaaacaacacatccgtctgaggtctcaggctcacctggaaatgcaggtcctggcctccctgcctccaccctcccccaccccttccttgtcaggcagcttgggccacccaccatatgccgctgcagcccataaagactctggaacatttcaaaggccttggcccccatcaggtgtggctccaaaaaacacagggtcacctataaaaggttgagcacaaggaaacagccataaaacccgcagtcctaacagcagacacccagtggccagaacaaagcagccagctgccgggctttccaggaaccacagagggacatccctcccaaggaccgcgcccagccgcagcccaggggcacatggctgaaaggtcctcagaggccacctggtaagaagggccctgtgttgggtgcttgctagttgccagggactgtcccggatgccctccttgaagagggttaaggaggtaacacaggaaagagctggcatggtgcctgcagccctgagggcctctaaaagagatgcttcatctttcctgagcttcaaagcacccggcaagtgggacgtgattcccatcttttaggcggcaaaactgaggccctgaggagtaacacaactaggaagtgagcttcaagccaagtctgtctgttcatctcatgctttctcgtgggttcctggagaggtcagatgatgggctgtcagtgctcaaaggggcctggagacctcccagccctctgctgggtaccctccctacacagtgcagccaggcttccaaggcagcctccctcctctgctgggacagtcgtcaggggtgtttcagaaggagcaagccccgagcagcctccccacactctggcccagttgagggaggtgacagggcgccatctcctgctccctttctggaaagctttcccacatcccaggccaggccctgcaggccctcaggctggctgatacatggcaatgacaacagaaatggctcacacttggtaggtgcttcctaactgccacatcctttacacacaactgcacaaatgctctacatcagggatgcccatgttatagaaaactaggacttatggaggatgtgcaacttccccaaggtcatgcagctatcagcagccgagctggaactgaatccatggtcctcaccatgccacgctaccctgcttctgcctgaacgcaagcaggtgcagataagccgcaacacccatgactatacccacacactaccatcttcccagccgcatggcagtgctgcggcctagacccatggctcaggctctgccatccacccttggtgcagccctccagcctcccagacacccctgcatcagcctctctctaggtaacagataatactgctgaaataccaggctggctttaagttttgggtcccactgtcccactgtcctaagtcccactctgacctgtgggactaaaaggagggatgggacaatcattgctgtacaagcagctcctccagagaaatgcccagacccagagcagcaacccctcatggccctcaaaaaggcatctttggccaggcacagtggctcacacctgtaatcccagtgctttgggaggccaagaggggacgatcgcttgaggctgggagttcaagaccccatctctacaaaataattaaaaaattagctgggcacagtagtgcgcacctgtagtcctagctacttgggaggctgatgtgggaggatcacttgagctcaggagttcaaggctgcagtaagttatgaccatgccactgcactctagcctgggcaacagagtgagactatctcttaaagaaaagaaaaaaggcaccccttcctagagtccagaaagacgtctgtatctggcagtgcccgtcttcctaagtcctttctgagggtcctgagctgaggggagccaaggatgcagcttcactccatcactgggtggtctcctctgggaacttggagtattcccttcctgcagcaggaagagccaccaagagtttatcgtgttcagtccttttagtcacctaatgcccacaggcaccttgacaccatacaaagaacccctctggggaagccaacaaccccaaaacccgtgcaacccttgcaccctctgcagccagcccttggtagtggccttactgtactctccctctccatgactcagtttgcctccaataagccctggggcctcaagttcagactcacccaactagacagaccagaagtgagcctctgccctgacatcttcaggcactcttttgtcaactactcacaaggatttatcagataggaagggaaaaggacagaaagaactgtgggataaggaaggctctgaatgtcagaaaagggtctgagtaggatgatttgagactgaagaagctacgtggtatcacttaggagcaataaaggaaagattagggcaggtgaggaggataatggacagtggagcctggccagtgccagctgacggactagaccgatcttcctacctctgcttgcaaaaggcattgcttcctgcttagcatgcctcactgattcccataaaaatggcattcatctatatgctgaggtgggctgaatcatggccctagaagatgtccacgtcctcatccctggaatctgtgactgcgaccttaactggcacaagggactctacagacataatttaattaaggaccttgagatgaagagattagcctggatcatccaggtgggccctaaatgcaatcacaaaggtccttcaaagagggaggtagagggagatttgacacagaagagaaagtaagagatgtgatgatggaaactgagatggagcaatgtgctttggatacggagcagaaagccacaagactggggatgcaggtggctactggaagctgcaaaaggcaagaaaaacgacttgcccctcagagcctccagaaggaaccagccctgcagacgctttgactttaaaagcccagggaaactgatttccgacttctcgccttcagaactgtaggagtatatttgtgttatcttaaggcactatgtttgtggtcgttacagcagcaagggaaaactgacacccacactcagccactcgagaggtcccttctcctgctcaacactgctagccattaggggttaagtaattcacaaaagagacccatccctgccttcccgtaacatattgtcatcctctttcctccatcctctttcctagggtccctgtggcctggactatgctgctttctgcctaagtcctccccgtccttccagctctcattccttccatgaagctttgttccagcctcagagtcttcaaagacaccattcctctgcacgtccccctgcacccacccctggctaatgcctcttcatcctgtagatctcatttcttttttttggagacagggtctcactctgttgcccaggtaggagtgcaatgatacaatcttggttcactgcaacctccacctcccaggctcaagcaatcatcccatctcagcctcaagagtagctgggactacggggatgtgccaccacgcctggctaattttttgtatttttcgtagagatggagttttgccatgttgcccaggctggtctcaaactcctgggctcaagcgatccacccgccttgacctctgaaagtgctggggttacagtcatgagtcaccatgccgggcctgtaggtctcatttctgcagggaagccttccctgagccccggccaaggagaggatgcacccccacacacacacgcattatagtccatagtctctcatcacactccaggctgaagtgtgcatatacgtgtgtaagaggggattatctgttcaatctagtcactgatgatggaattgctcagacctctgagggcagggaccttggttgtcctgttcaccagtgaatcaactctcagcctgttatagacacttgcattgatctccctctgcccagaactgctttatttaacatctctatcaaaaagaaccgttgcatagacatttttccaaggaaggcatacaaatggcccacaggtatataaaaaggtgctcaacatcactaatcatcagggctacacaatcaaagccacgatgagttataacctcacacctgttaaaatggctataagcaaaaaaagagagagagagagagcaagtgctggtgtgggtataaagaaaagagaaccctgttacactgttggtgggactgtaaattgataaagtcattatggaaaacagtatggaggttcctcagaaaaatcaaaaatagaactaccatatgatccagcaatctcactactggttatatatccaaaggaaatgaaatcagtacgtcaaagagatgtctgcattccaatgttcacagcagcattattcacaatagccaagaaatcgaacctatctaagtgcccaccaacggatgatggataaagaaattgtggtacatgtacacagtggaacactattcagcctttaaaaaagaaggatatcctgccatttccaacaacatggatgaacctagaggacagtatgttaagtgaaataagccagggataggaagacaaatactacgtgatctaatttatatgtggactcttaaaaagttgagctcataggagcagaaagcagaacagtggttaccaggggctgggatgggagaggaatgctggtcaaagagtacaaactttcagttaaacaggaggaataaattcaagacatctattactgtacatcatggtgataacaattaataacaatgtattgtattcttgaaaactgctaagaaaagagattttcagtgttctcaccacaaaaaataggtatatgagataatgcatacgataattagctcaattcagccattccacaatgtatacatatttcaaaacaacatgttgtatacaataaacaagtacaatttttatttatccagagaaaattttaataataagtgttcattttaaaaaaaaaaatacagccaattggcactctcaggcctgcgtcaggaacaagaggaagtcagggctcaagtttcaaaaacacagactgaaaataaagccccaaacatactcaaggatggaactccccacagcctgtcagcagtggacaaaaccttccatagcagaagctgcaagtaaaagatgtctgtgtgggaggaaccatttagaaaaagcagtaacaaggcgatgaaaacagaaacaaggcggccagtcacccaccatccccaattcgcccaaaggccaggtcaccctgttcccaccctgcaccagctgctcctctgcctgcggctttctggcccaaatcctgtgtggccctcactttctcctcagtcctgcctctgccatatgaccatctcctcctcaaaagaggcttctctggctacccaccaaagcagcccctctaacacacacaatcccatcccctgttcagtggtctcatggtgccactgtaaattatctcattcattgatttactgaagtgttgattatctgcaccccccaccacacacactgaaacccaacccagccctttctgttgcagtttcccagggcttcagacagtccttggcacatagagggtgccggagaatccagaatgaccctcactgtgcatatccatagctgccctcactgagccgcagcctcgggctgccccaaaaggtaagcggagtacaagggtggaggctctctctctctctagcacagaatctctttcttccagagtcggccagcggtgctgtctcttttctgctgggaaagataggaatggagattccttgaggtcagacacagtagatcctagtcagaaactcccattggctaagtgagagaagccagacacaaaaggccacatattgtgtgattccacttatatgaagtgtccagatcaggcacatccagagagcccacacagagtagaccagccagggactgggagcagagggaatagggagtgactgcttaatggtacaggacttccttttggagtgatgaaaatgtagataataatgatggttacacaactttgcgaataagctaaaaaactaccgaactgtatgtacactttaaaagaaggaattttatctcaattaaaaaaacaaaaaagcacttattgaaaaatgccatggagtggttagcagagcaaagctctggagtccaactgtccaggctcaattcctggcttaagccatgagctatgtgaactgagccaaattacttggcctctctgtgcctctgcttccttgtctgtaaatgggggtgataatcatgccaatttcacagggatgctatgaggattaaatgcaaccacccatgtgtaggggactttggctaactcctttccaaacttccaccttccccattccttgcagaccttgttttccatttgagatccataaggttctgaggatactgacaataatccctggcttcagccagttcagttacagcaactctcagaacctgtgctaggaatgctggtgcaaaggtgatttatttcctgacaaggttgagcagatcagcatgtgccctccagagctgcagcagccatgtgtgaacccagaggcaaaccagcctcaggacaaggccaactgtaaggagagcagattagagtgacagaaagaaactgggtccatggagacatcgttgagccaccggatcaaggctcatctgaagtcatccacctttccaactatatgagtcaatggagtccctttaatgttaagcccattgaagtgagcatttctgctacatgcaatcaaaagcttatcactgattcagctacgtaaagtccctcatacccagcccggcacatagcgagttctccattaagtgtgacttattatcatttttttttccaagcttctctgctgttccccaaggccagtgttcacccagatgtctagatacagaaactgttctactggtttatctagatccaatcctatgtccctgtaatggcaagccacagacaactttaccaaaaacccttgctgtgtgcaaaatcagtgcacacagcaagcattcatggggcgaggtactgtgtgctcagacaagactaggtacgcaggggacagcacatcagggaaggacaaggcactctgatcataagtccaaagaggagttcataatctaatcagcaaggcaagatcaaggtccacaaaacagtaaagtatatatttgactagtgacatgatttaagaaatgcaacagtgcaagctaaaggagtccagagaagaaagagatgggaatcctggtggcattctggtttctcctggctcccaatgctcccaacacatggacctaaccagatccaaaaacatcctcccaagaacatatggaggccacaggacatcagagcccagcaccagaccttgctcctgcaaatcccaaagataatgtgcacatttcacggacatggccaaagacccaggcacattctaggtcatggtcacgaaactggctgaactagtcaagaagtcctatcatcttttcttctcccaatttattttctttttccctctttttctcccaatgcagtaaaaatgtgatgcatgaaacaattattcttcagaactcaggggcaggtggggagcctcaaatctggagaaagcaaaatgtaaatgatgcaaaaagagatcaagatccatgaatattcatcttcctctcccttctggtggaaactagatttggaggggttcattgcgctccatttcctctgaattcctaggagcgcttgtggtcggcatctcctcattctgcctgaagaccacatgcaactcatagggctcttgcctccaagaacaggcggctgcacaggcgcatacattgtaccaacctgtacaccttatgtctgtgcatgccctacatgtatgttagacttcaattttaaaaaatgaaagtcaaaagactggtcaattccttctggtcctcaaggcatatttccaatgtgggggtaccttcctctcttcacttcacggtggaggatgattctctactctacctcctcacctccctgacacacctccttgccccaaaacaaaacagtgaaaatgaacaatcccctctaagccatttgcttatggaagacaaagctggagctgactcctttctggattctctctccctactccccccacccccactgagcacaggcatgcaatagatgctcaataactgtttattttgggaataaattacaaatggtatggaactatctcacacacaataagtctgtaagttcctggatgtctgagcttgtcttctacctcttgggatgcctgtgtggccctccccaaaaccccaccaccaggtgatttcttaacctctatgagtctcagctcctgaaccacacttgtccttcaggatcactgtgagaattttaccagctaagatgtaaagtggccagctcagaatgtgatatattgtaagccctcaataaatagtagctccctggacccaaccttcccccacaaccttccccagttgcagcacagagtttaaaacctcccaggagccccataaactgtggccgaccaggactgaccagcttcagctctgggtgctctgtgcctctctccaatacacacagtgcttcattaaagaactcaaagcttatctggcccaaaagcaatgcttttatctaaaatcagaccacatgggcaacaagtgaagcaggaagcctatcaaggcatttgggccaactggttttggctgccaagggagccctccttataggaggcggttcagaccgcaggccggctcacatacaacactggtgtacacggaggggttaattagcagtaaacagatgccatgattcacctctgtgctgttatttccccgtgtgcagctaaaactataatcactctgttctccgacaggatgtttgcgttcaagccaaaactgcctcctctatccaacttgctgcagttcggttcagcacagggcaatgaggaacttggctcctctcacgatagctggtggctggcctgacagaggccccttcagacagggaaggaaagaggagatggatggggtagagaagaaaaaaatgaatttgtcattttatcaaacacaggtgaaggctgtctgctggtgggaactgctcctcaacacttaacacccacagagctcacaaaataccctttcttctgaggcagtcaggcatgagaggcttcaggagccctgtgacaagtcattggcaagaaggagctggggcaaatttgcaggccaatgcctgggtcacaccctccctaccactgcccaggcctgggtgggtgtctagtctacttggagcctgggacctggtaaaggtggcctgaaaggctcaacctcagcttccagaaaaaattaaataccctgagagagccagaaaacaaagagattcagtgcccaaaatataaatgtaaccagtgtggagtattagtcaattcatcagcaagaggttactgaatgctcgtttgttcattcattcgcccaccatctaccaaatgcccaccagagacatgccacgtgtttggtgctgggaatacagaaagaaatgaagaagatgtatgtcctgtctcagtggcccacagaccagagtgtgccaaatcctgaaggatccagttaggagcttacaatctagctggaaagctaaagaagggaagcatgcggaattctccggggctcatcgccatccctcacctaaccagtgctttgtgtaagatagactcaaaggtgagcttgaataaactgacttctgctaaatgccattattctacctggatacatcacaaaaatgggagccattacctactgagtatttttcatgtgctaggtggaactttctctgtggtcttcaccctacatgtaatggaaactgaggcatgaggagggtagacaacttgcccaagaccacacaggggaggcaagagaggaacccaggtccttgcaccccaaccccatgccctttccacctcactgcatgagcagaggaaggagcccccttgtccatccctcacccagccccagctcagcttgggctcccccaagcaagcaccacatgactgacactcttggaatcctcttcataacctggcccaggtatgggacaagttgccaatgagcaacatatttgcttaaccaaatgcctgtggcagaataagcttgagataaaagggagtgtgaagtggaaagaagacccggaagtcttcatgaaggaacttggtgtacagaaagatgttttgggtgcctcagaacacataatccctgatagagaaaagagtctggagacaaataccagatgttaagcaaccttaacacaggcgcctgggctgcctcagcctatcagagtagcacaggttcctaaataggggaaagtgccaactaaaaagcccaccaggcaggagggctgggtctggagcctggcctttcttctttgttcagagcccaaaaggtgcctctggtccattcaccattcaccaggccccagagcagccccaggatcaccagatgggtccaccaggtccgtcctgctctggctaccaggcttctaagcctcttttcagaccctcagccttctgggagaaaccattccatgccctccagcactttccaccccttctgttccttttgacatcatctccaactgcctgaggctgcagaaggtgggtggtgtaggggcagaacaggcaggagcacaatcacaattcttataaaaatgcaagggactgctggagccaccagggaccctcagaatggcctcatccaatcctccgttttacaggtggcaaactgaggcctcgcccctgagttaaccctttcaatgcctgacatctcgtactgcaaaattcttcctttcctctctctccattcccctctccctcgtccttcctatagtggtataggggtgtgccgtgggtgatgagaggcagagggaagggagcatttctcaccccattttcctccaaccctactttctgcctccatctttagcactacctcactgtccgtcttggtgctcactgttggcccctggctaccctgccccttccagtggtctcctgtccctcagttcagcacaatcctggttatattgacaaaggagagggatctaaaataaaggccaacttcatcataacagggccatttattgaggacttacaagatgctaaatgctattatactcacaaaacctttacgtggctggtatttttagtattcacagtttaccaatgaagaaagtgagctttgcaaggttaagtaaattggccacaaccaccaagctaatgcaaggtagagccaggactcaaacccgcctttgaccaattccaaactaggctaagagcctcacaagactgaatttaagagaccaaaatgaacattcaaaatgttgcactgtggatgcaaagatggaaggcacagagtcctaggcttcagagatgctacattccagcagggggtggacattccacagacgtgcaatccaacctggatggactagagtggagacttaccagaaacagagtgaccaatgacctaggaggttattgtcaatgcccacattaggggaaaatgtcacagtctcccaaagatgaccaaatgaaagtaacagtaataactaacactttcctagcccttggtttgtagcaagtgctaccctcagcatttaacacatgatcctcccaacaaccccaggcagcaggaggataatgtggggtgacatctcccagcatttgaaagtcaatttgaagaccgggtgcagtggcacatgcctgtaatcccagcactttgggaggctgaggcgggtggatcacttgagatcaggagttcgagaccagcctggccaacatggtgaaaccccgtctctactaaaaatacagaaattagccggacatggtggtgcgcacctgtaatcccagctactcgggaggctgaggcaagagaatcacttgaacctgataggtggaggttgcagtgagccgagactgcaccactgcactccagtctgggcacgagagtgaagctccatctcaaaaaaaaaaaaaagccaatttgatactaggaactgtttgagggcgttttcagtattattttattcccactttccaagtgagtgaactgaggcatgcagaggtgaagtggcttgcccaagatccaaaggtcagcaagcaacacaactatgatttaagcctgagtaggctggctccagagggcatgtccctgatgaccacactgaactatctagaatgagagacgttgctcattgagacattacaattctggtccattggattttagaaaggcaaccgtattacttatgttactactcacgtttgagaccctgttttctcagcagtgaactgttgaacttactttgctgagacataaaattggacatgggtagaaggggctacagtgaagtgcatttccaaggtgaagcacatcaccacaggagtgagacaagaaacccgggaagcagcctctgtcatccatgagccttccactctcaatgctccaggcaaagagccacgccaggtaagattcaaagtgggagagggcagactgggagatgatgcattcaaatcatgagggcaggctcaggtaactactgtcaattcaccacccctgaattagggccaacgtaaaccagtgacaatctctttgaaacatgaagcagggaggcagttatgccccttagtccctttatcctgaaggtgtttaagaagctgagtagctttcaagctgcagacagggataagaagaggcagagctgaaggcactccagagcagcataggaagagggtaagagttaacaatctgaagacagaaaaccctgggttctaatgctggtactgccacttattaaggatgcctcttgggcaagtgacatcacatagccattgcaagccccagtttttgtacatctgtaaaatgggaaaaatacagatagtatctacatcataggctgatttagaggattgagataatgcatataaagtgcttgacaccatgtctgacacctagcaaatacccagtaaacattcagttttctcattgggtcatgataatggttctggcagagccagctatggacagcagaagccctcagtgtgggactcgggagccccttcagcagtccaggtgttctccaaatctatttcaatctcctgggtgcagtgctacatttcccaggatcccttgcagttaaaataccatgtgatcaagttctggccaatgaactgtgtgggtagacgtgatgtgaatgacttccataactacccctacaaaactacccctcatgatccttacttctcatcccctatcatccggacagatgcagagggtccagcagagaccttcaggggcccctagaagatttcaggtccacaagtgaaaggagccggggtctttaatgactgtctgaagtgtgtcttcactgcaccctccacacacaccatcaatggtactttgtatgagcaatacgtaaacttctgctgtattaagtcattgacatgttgacctcttgttacagaggtggcctagctgactaatacacagtttatcaaacctcaagatggactcacaggtccctgttgcctcaatgattccatcgccactgcacacaccagagtctagataccataaatatggtccaggagagaaaccagcagcgtggtgtggtaactggcaactggccaggtatggtaagcataaggtaaagcctgcagcaactcaagaaatgcagagggaagactactcgtctagaagaaacaggatggcccagcagcaatattacctgtgctcatagctactggttcttcaggagaacaggaaagagcatggtctcaaaggccaagcatatcagaggccatatctgcctgggatctacccagaaaagtgactgaactgctctgggcttcagtttccacaactgccaatcatggataacaataccctatgttctgtgacatcacactggtatcttcaaaccagccagggcaggaatatttataccataggaattgacgaacaccgtacatagggactttcttctctagaaatcccgttgttaatcacttaccagcacatccctggataaacaggagtcagctaagtggaaggggagaaggaggacaagaaaagagaagtccggcagtgtgaacagcatgtgtgaaggcccagaggtaaaaatcaaaaggtttaacgaaatgaaggaagtcctaagtggctgggtgtggagagcttgggaagatgttaagaggaacctagaaagagggcaggagctggaccttgtgaaaggacttcactaaatagtaattatttgttccagtcatccatggctatgtaacaaattaccccaaaatgtagtggcttaaaacaatcatttcattttgtttatgacttttaagtaaggaattcatagagggatcagctggtgggttcatctccaatctatgtcaactggggttggaggatccacttccatgatggcatcttcacacatatgcgtggtgccccagtagtgtctctctgtctgtctgtctctctctctctctctctctctctctctctcgtatgcccacgcacatgcttcctctcactctcgctcttccccctgtagtggccaacttccctaagaagtagcattcccagataacaaatgaactgccagggttcttccaacatagcctcagaagtcacatagcatcatttccaccacaatccatgggttacaagcaacccatggattacaggggctagctctgccccaaagggtacaacccaagaggatgaacgtgaggagtcgtggttcactgagggcctgctttgatgaccagccaccacattgagcgacccctggtcactgccctctaggaccacctgccaggcacagatccagaaagaaaccaggaccagccctgtccacaaggagctgtctgcagaggagacaggatgcctgtatagaaaatagggctgcagcatcagacggctgctccccacccaggatggaaggacaaacagagaggacgcatcagggaagggagaggcagagaaagctgactagggtaggtagagaaggcttcccaggaaggcggcattcccagcaagatgagctaagacttggaggatggaggaggtggagggttggaagggaaggagtaggccatcactggggccacccccagccttctatcacatttggatcactatggaccacgccaggtcatctccgcttttcccagcagggatgttgatcagacctgggcactctgcagtgatgatcagcagctcaagagcaagggtggctcctgaccgtgaggggtcagcaccaggcccacaagcctgtctgttgcaccagtgcccaggaggggctgtcgactgcagaactgttttctctggctcgacctcacccagaaccagcggcagaaaggccagttatgcaaccatcctcaccacagcctgccagcctcagaggctgggcctggccgccgggcctggccgccaggcctggtaaggagactgctgtggcctgcacagcacaaggccatcctgggccccaactgccactttccatgcaggtgcaagacgctctgctgacaaatacctggggaaagcaggagctgtgggagggaggtaaaaatagcacagttggcaacagagaaggcttttctaagtcctcagggtcctattagtccttgtccatgggatacacatgagctggcactgagcattctctcttctccaaggctcatgcttagaacaggcacagaggcctgggaggcctcttgtatcatgtcaggagctgcacagtgatcagaagttagggagagcgcctgttgcagaggctggatttggaggatatgctggggctgccgtcataaccccacatccccagtgggttctctctggccactccctctacggccagttctgttttctccccatttttggaaacccaaattcttgatgtttctgttattcacattgccattaagaattatgggctttgcactgtgtttttaatttgttgtgtaagggttttacacaaacacagctagatgcctagaaaagacaatgtatatgggcatgcaggctgtgcactgcacaactccagagggcttcattcatgaccaggatgtgagtggcgccctggaatcatgcaatgtggttaccggtattgccagagaggaaatgatgtcttacatgaccccatatccccgggaaaaggccagccatgctaataaagatttgctaactaaccaatttgtctcctgcttccaaatattccatgcacggggtttggcaggcacacggccacaatgcgcaatggcctagaaagagagccatattgaaatataataatgtatttccaggccacggaggtggagaggcacaaggaattgatctttctaaggcaaggaagattcataaccactgaatgagttaaccactaccttcttctgagtgtgcagattaaattctctgtcgcaccaacatccaagtgcgctaaattttaacagacctggaatttggatatatttatttctctttcacagaattcccattcttttactaacacagtttcagagtttgagatatgagcatatctcatgtgggataataaggcatcattccacaccaggttgcacaggcccatggtttaatgatgagacttcgctggtgggtgcaaactttgctggtcccccatgctctcttgaatctgtgtgcatctcacacatacgtacatgtacacacacacacacacacacacacccctctctcaagtttttaaaaacctacttaaattctgcatcctacctccaatatactctgtgtacagtgtaagtgttaataccaaaaatagtgtttttctgctgggcacagtggctcacgcctgtaattccagcactttgggggccgaggcaggtggaccacttgagctcaagagttagagaccagcctgggcaacatggcgaaactccatctccaccaaaaatacaaaaaattagccaggcatgatggtgcatgcctgtagtcacatgcctgcaagtcccagctactcaggaggctgaggtgggagattgcttgagcccaggaggtggaggttttagagaaaaatagtgtttttctccaaaacttcatggaagactgttgacactcagaaaaatgacccaatattgattctgtgcctccacataccccccagcacagagatgtggcacatgtgctgtggttcataaaatacatttatatgtcatctgatgtgaatctcatagcagtcctggagttgtacattgagtaacctgcatgactgtatatagcccactgcctgtcaggtagagaaaaggtgattatcccattttccagcaagaaaaactaagactcagggaatgtaatagaactagacaacatttaaggttccttctcatcctgggaattgacatacctgagaattcagtagtacaaaactctctgaacttgtcaagggacctcacatctctccaggaacaacacaccactcctcttttcagtcctgtctatgtcatcagagtttccctcacactgtggccaggaagagctaaggaggtataaatgaggtgtacagtgtgggattaggtgcatgggatccacagcccacctgcctggatttaaactggctctgctcctcacctgtgtgtgaccctgagcagttactcaacctctctgtgcctcagttttctaatccataagtgaggataataataccaccgaattcactgggttgttgtgaggattatataatacatatagtttaaaaacaaccagacacacagtaatcactcaaagtttgttatccaaaaaaagaaaaacattctcattctctatgcatccattttctaacctgtaaaatgggaatttaaaaggggactacatcacaggattgttttgaggattaaataacagaataaacataaggagcttaaaacaatgcttaatgcatagaagccactcaaacaagtttgttctgattttttttcccctaagaaaatagtaactccaattcccacagaaagacttcccaaaacaaaagtaccaataagtctgaaaataaatgcaagacctgaggaggaatcattgctgttttctaaaaccagtgatagacaggctatcttagagaccggaggttcttgctttacattcattttctgaggtcaggaagtaaaaaggaacatgggtgaacaggcactggtgagatgaggaagaaagaacaggaacatctcagttgctagtttctgttttcaccatgaaaatcattttaaagccctgcctagaatttaaatagcatcatccctggagatagctgttttagtttcattacagtctgtgttcgtagagtacaaatagaaaccttcgtgattttattagtttccatgcaacttaggagagatttgcatgataacatttcatctcctgactttaaaaagggaccaattaaaaatacagcacttgcattgcctgtcacgggaaaatgaaaaggttcacagagttttaaaaacctctgccatatctagtccatggtcataaatcaagtattcagtactacggtggcaatcactattgtctaaatttttagtttattttgtaagaagtacttggaacagctgggtgcagtggctcacacctgtaatcccagcactctgggaggccgaggcaggtggagtacttgagatcaggagttcaagaccagcctggccaacacggtaaaaccccatctctactaaaaatacaaaaaaaaaaaattagctgttcatgatggtgcatgtctgtaatcccagttacgtgggaggctgaggcaggagaattgcttgaacccaggagacaaaggttgaggtgagccgagatcgtgacactgcaccctagcctggacgacagaccaagactccgtctcaaaaaaaaaaaaagaaagaaagaatatttgcaggatgtttgcacccctgaaaagagttaaactatagtacagaagaaacaaaatgtacaagtaagtatttttgcctggattgcagcaagtcctacacaattaccaacaccccaaagctacctggtactctgtggatttgtgaagtgttaatgtaatgtatctgtgacaagttaaaatttaatgcatggctccggtagcataatcgaatcgatgttatgtaacctaagagaactattccagtaagttctgatgtgctggctgcttacggttcagggggagtttttttcggaggttactgagtatttaggaatcatcccttcagacacttgctcttttgccacagaagctgcagttatcttatccctgctttcggcagctggaatgctccgtggaacagggctgagatgaacgttctatctccaaggctgcgttttggggcaagttaaggaaaaggatcaaagtaagttgatttgcatgaccttctctttaatcagatgtttctttttatgttcaacctcaacaaagccagcctatcatagcacactatttatagtctataatctaagatgttctgaaccattcccccacaccaaaaattaaaattaaaacctcaatagtggtgtggctatatcattagaagtaatagtagagtcacaaaaacctatttctgagactttttttttaaatgacaggtttgatggtatttccaatggggcctgtgtccctagattgtaattcttaaatatgtcatcaaagtcaatattgaagttctggggacaagtcaatcaaatttcactcttgtgttttatagtagaacaagaacttctccctggattcactgccctcaataacttaatctttggttctttatcaggtaaaaatgatagttttaaaatctgacttaagaaatggctttatattgaaatcatgaaatcagagaatttgttatatgcatgagaaaactaaggcctggagcctatgacttgtctaagacactgtagctagtcacttgtcatatgtcaaaatcaaaaatccggcgctcccttaacttcactctaagagtagacaccattaaaccagaccccacaggcagaaagagggttgttctcttcatttgtctgctctcaatgtgggcagggcctacatcaaagtcagcctgggtgcttctagaggggctgcaatctttagaggaagaatatcagctgcccaccgagaaaacaagaacgccaccgtaaagaacatgtcagggaaggaaatgtgcccaaagataatgctggtcatctcctggagggggaatttggaggaatgtttttcccttttctcaaatgtttatttataattgtggtgaaatacacagaagacaaaaatgtaccatcttaggctgggcacagtggctcacgcctgtaatcccagcactttgggaggctgaggcgggcggatcacgagatcaggagatccagaccatggtgaaaccccgtctctactaaaaatacaaaaagttagctgggcgtggtggtgggcgcctgtagtcccagctactccggaggctgaggcaggagaatggcttgaacctgggaggcggagcttgcagtgagccgagatcatgccactgcactccagcctgggcgacagagcgagactctgccaaaaaaaaaagtaccatctcaaccatttttaagtgtgtagtacttcacacttaaaaatgtgcatgtttcacattgttgtgcatcccatctccagaactttttcatcttacaaaactgaaaccctatacccattaaacacttccctccctctggccctggaaactacccttctactttctgtttctatgagtttggcaactctatgtacctcatgtaagtggaagttatccttttgtgactggcttatttcatttggctgatgtcctcgatgttcatctatgtggtagcacgtgtcagacttgccttcctttttaaagttgaataatactctgttgtatgtacctaccacaattcgctaatctattcatctgtgaatgaacccttgaattgcttccacctttggccattgtaaataatgctgctgtgaacatgggtgtacaaatatctccttaagaccctgcttttaagttttttggatatctaaccagaagtggaattgctggattatatgataattgaatgattaatttgttttgagaaactgccatactgctttccaccgcatctgtaccactttgcattcccacaaacactgcacaagggttccaatttctccacatcctcaccaacactggtgattttctatttttttttttttacagtagccatcctaacagatgtgactgtgtcctttttgtttaatgcccctgcacggcctacgttttctacaatgaacatgtagtatatttgggattaaggacaaaatataaaatactgaagttaaaaagtaaatcctatggagaaaacagggttgtgaaagaacttaagaaatgattgggttttttttttttagactgaggcaaactgttgagccctcttgtgggctcagctagagacatcattcctatactcttcaagaatctaccacctgatcggctgtggctgccacaagccacaggagaaacggccataattcatgggcagctgaaataattcctctaagctctgggaggaaagtgttcccagatgcaggaaggagaacaacaatgtatattaagctgttgccagctaatgttggtcataaaaatccctagcacttgggtaaggcctttcatcttccaaatctttcctccaagccttagaacacttatctctgagttctccatttgaataactggaggcccatttttccccttccagagccacaaagggtccactttccaaaaccacataaagagaaaacaacgtcaatgtggcaacttctcccaaagaggagcagaattctgctcttggttaacaagcacacaaagaacatctcccacaaacccttccaacgcttcacctctgagccacacaggccgcgtgctatcagttcattccacagaatgtctcgtttgaagagctaaaattttccaaacgtgaactcattctacccactggtagaatgctttactccttggaggtgaagtcatttgacatgatttattcattaagacaaaggtgaggtaactaaaaccaaaatccatccaattagctatttatccaacctctaactctcagaggagaaattcttttttccttggtgtcaacctctccctctacctcctgccctccctcaccttcttcctttgtgtgttttgctctcttttcttttctggtttctttctgttcagcaaaataggggagatgacagcagaggcatacaggagccccagaggaaaggagacccaatgagcaggtgggaaagaaacagcctcctattctaagaagcggctgtattcaagtgatgcaaaaagaggttcaagagcactgtctgtctccctaggtgaaaaagagtcaacacctagaaaatggaatccaactcgagtttcctaacaaaggctctgtaccctacatccaaattcttggcagggcccccaaattacaacccccacgtgaaactgagaagggggctaaaccttggagatacaaggcacgtgacattgataaggaggtgaatttatggcccagcaacagtcaaaagcctccagtcacagctgctgacaagaccgaagagacctcagaaggcaaacttcaagaaacaaccagaatgggtcgttttctgaactctgggcaaaggggcaaagggaaaccacactgtctcaggaggacgaagaacccagggaagccatcagggagaaaaataaagtggccttcatggaggaaacacaagttaaggttaaggtcattctacgtctcaacactgcggacatggaaacaccacccagctctgtcccttcctgaactggatttagaatttgaaatctaccatccaccaaggcttgttctgcatgtcccagacacagactagaagcaaacaaggactagtgcaaacagaaagatctttccaagttcatcgtaaggtgggtttgtccccagtggaatagtggcctcaggagatcataaacacactggtagggtgggcttccagcactggggaggaatcgcacagggcctgaggccccaaagcttccttccaccactgtgaatttatagttccatgcgcttctgcacttgttaaatcaggtcgctatttgttgtctactaatctacaaacctgaagcccccagccagcagaggccactctcgatcccaccccccagccccagttcactcccaaagatgaagacagagaggactgtccagtctctaaaagggaagaaggagcaagaacaagacatggaaccagaaaataaaataaatactcatcttatactcccaacttgaaatgcacatacaggcagcccaacagcctgtagataatttggtttacaatgatatgcaaagatgcagacccatcgtggctgaatagtttcgtacagttagaagtgaccctggaaagaatattactgacagtcttgccttaaaaactcttttgcaaaagacatcatggtcccagacttcagcagttaacagatggaaattaacttcacttcaagtcaaaaacctaaaatctcgccgggcgcggtggctcatgcctgtaatcccagcactttgggaggccaaggcgggtggatcatttgaggtcaggagttcaagaccagcctgactgacatggtgaaatcccgtctccattaaaaatacaaaaattagccaggcatggggcatgagaacctggaatgccaggtactcaggaggcactagaaccctggagggagaggttacagtgagccgagatcatgccactgcactccagcctgccagcctgggcaacacagcaagacggtatctcaaaaaaaaaaaaaaatctaaaatcctatttttcctttttaaaaaaacaccccttccccaagtaaaagtcaactctgataatggggagatctacataatgtttaccttaattacttcttccccaaattgaagtattcctccctattgtgctagaaaccaaaattaaacagcaccaactttccacagaaaccctcaggaatgacagccactaaggaaaaaaggatgtaaaagaaaggatggagcaagaggaggagggggagaaggctggaattcaggctttcctgtgaattcgctttgaaatgcctagaggccactggatctgagtccccaagaaaatctggtagagaggccagtgaaccagcataaagaatagaaaataaaggagatgtgttaaataattttgattttggccacgtgaagaagtattagtcatacaggtaacaagatcttacagggagatgattccaaggctcggcttgacaacgttaagtgtatatccattctgggcctggagtgccaattacatttccaaattggcaattagacacaatgtcccaagacaatcaccaaataatgccaaaaacaaagcaagttccatcttaaagcagccattcttttgaaactgcccttccctcccgtgcctgactcatccacctcacaaacaactgcccattatgaactaaatccttgttagctactgatcaagagaaaccaggtggcatgaataattaaaatccacgaatgattcaagcaccatgttgtcaacaaaccaagcccatctctttcaccaggagtttctccatagcatctaacaaattacccaaaaaagcaggaaaatatatttgccacccccaaccaatgcattctcgttcagcccccagctaactactggaaagagccttccaacatctacgtgtgtttacatttgcatgactcagttcctgccctcaaggagtttgcaggcaattcagagatcagatgttcatattccatgagaagataactgttttttcctctgctcagcctgtcaagtactaataaaagccctaacaagcagggagtcagaactgggtcttaattatttttcccccagcacctagcttggtttctggcacatcgtatacacttaatatgcaacaaaagcaaaaacaacaacaataattataaccagaagacttctttgagggcctactgtgtgcaggccgccacgatgctaggtccttcttcattctgcctgctgcagacactcatggtgctcccctctgatgatgaaacaacataaaaagcacatctcatggaaaaagtccctgacagtgtgagctgtgaaaaaccctggtatggtgagaaaaggagctactttcactttcatcttctggaattcttaagaagtgcattggagggccacacagcacggtgccacgcgtgtcccccagtcactccacgggcagctcttcagccaattctttgaggttgaaccctccatttgggaaggcccacccaggcccctacagaaaatcaggctggcagtcttaatgcccactgacttcaaacactccagagggagtggtccccagccagcctggggcatcaccgcagtgcagccctggtgacaccaccagcctttaattttgcaaggaggtagtttggctgggttgccctcctggacttcgggaagtcacaccctttgcagaatgaccaactggcacgaggaagagcccacacattggtgggtaacacacagaccacaccctgtaaacactgctctggccaccacaacccaaccctaaatccacaacgctgatgggttccttaggagcaggcacctggaccatcagttttcgcaaataagagcccagcccgaaccacagctaccctggtctgaaaggagttttctccacccaacgatctggcagagcaaaccttctgcttctcatcccttcccccttcaagagctgggaatttccacatttaaaaataagcctgtcttcagggatggactgcacggaggctgagggatggaccagatccttgatactcaaagtgtggtctgcacagcatcagtatagcctgtgtctcgccagaccagcataatctcaggtcccacactggatcttctgaatcacagcctgcattttaacagctctcggtgattcctgagcatattaaagtttgactaagccaggcacagtggctcacaccactgtgggagcactttgggagaccaagatgggaagatcacttgaacccaggagttcaagacaagcctgggcaacatagggagaccccatctctgtaaaaaatttaaaacctagccaggtgtggtggcacacacccataagtcttggctacttggggagctgaggcaagaggatcacttgagcctgggaggttgaagctgcagtgagcagtgatcatgccactgtactccagcctgggcaacagagtgagaccctgtcccaaaaaaaaaaaaaaaaaaaaaaagtttgagaagcccaggcctagagacactctccagtccttggagataaagatgtgatattcccactgaacattccccaggttttctgtccaaagtgctaggacacccttgcctccgagggtccctgggtttccttttctaggtgcctaatgcgtggggttccacccacccaagaagcagttctaaaagagacatccttggtctgctccctgactgtgcacagaaaggcatggccctgtctgatccccagggatgtctccaagggacccagtgttccccacacggcccagggcctggcatcacagcacaaacagccctttcactggaaccacaaaggcgaccttccaggggatctgcagcttggcaaggtggtattggctgctgtgattcacagattagcatggtcactgccagtgtgagccgggacgcccactttgggaaggaggtcctggcattgcaatcgaatgccaatgtaactgtttctgcaccaggcctctcatgccctgatgagagagagagaaagagagagacagccccaaagcaagcacttactcctggctatcagccaccaatgaatgtccccatccagggaacaaaatagctgtgaggcaaagagaaggtccatttggacttaccattggaatgctttatcccccaggccaaacagcagggggcaggcagctcttcttttcctcctgttgtatgtttggtcaagtttcctgggcacctagaagcagggctagcccaaggctcccaaagggaggccataggttctcagtgtcctcctaggaaatgctataaaatggggttggtgaaaaaaaccaccccatgaggctgtgctctatcacagacctcaatttgcaggtgaggaaactgaggcacaaaggcatgacgtctttgcccaggatcacaggctgaaccttgggcactgcacagcacccctgacactgaagcaagactgctcacaggtagcacatttgagggcattttaaccactttctctaccagcaggatgccgccaagcctgtgatgtggccctccaaaggggaagctcagccacgccatgcctgctgattttttttcacaaggtaatttaaaaggcaggtgtgccacagaacacacttggggaaacctggcctagggggtgtcttggaaaagctggtctgggtagacagtgagtgtcctggccaagagaccgtgacatcacttgggagacaggtctatgagttctggacttgggataacagggatggaatttgtccctcctcaagggtacaatgctggacaaccatacctgcccaccaaatgccacagtgtttcccttctgccagcccagcagctcctggtcccccatactgtcgatgttcgtccactgataccccaccatcaaaactgtaaccatcctgccaggaccccatccgtgaagcctacctctgctgccctgccctaactttccagccttgcaacagccaagagccataagcccatgtctcagtctgactctaaatggttttttgatctatgacagtatacttcaggatctaaagcctccttttggctcaaaaactttatttgttatagtctgcgcccttcaggggctataagttcaatgaatcaaagggaaaataaactcagcacttcatgaagctatgatagttaccacttacaagaggcctgctaagtgtctggcatttgcagggtgctatgtgcccattattcctgctccctataagaaccctacaaagtaagcatcagtatgctcttggtataggtgatgtaaccaaagctcaacatggttggcagtcaaagatgccctgctaataaatgtgagatccatgatttgaacttgggtttgcctgattgcagagtcttgtactaaagtgtgcatttccataaagagggccaggggctggacgccgtgcctcacgcctgtaatcccagcactttgggaggccaaggtgggcgaatcacaaggtcaggagatcaagacaatcctggccaatgtggtgaaaccccgtctctacttaaaatacaaaaattagccaggtgtggcagcgtgcgcctgtagtcccagctacttgggaggctgaggcaggagaattgcttgaacccaggaggcgcaggctgcagtgagccaagatcgtgccgctgcactccagcctgggtgacagagcgagactccatctcaaaaaaaaaaattaataaaaggagagagagagagagcaaggaatgaggagcacgagctctctggacaagggcaggtcagctggagctcccccgtgactaggacccaagaactcctccaaggccaccccaagtgatctgctcaaaaaggagtatctcaaggtcatctggtgcagccaatccccaggacaggatgagatgaggcacaagggccaatctggaatcaagagctccacggcactgaagctccagccctgattgactgcgtcaggccagaccctgggtaattaccaagctgtaatgggatctgatatttatattagtcacgagcctgacagagaaaacgtgttgttttctcaggcacagccatggagacaacatctcgataattcattacacgcagaccatccttgatcaagcccaagcttctacaaggccaacagctcaaactgagaatggaaataactctatgcccagccacactcaggcccctcaacaaaccacagctccaacaggaagttggcctcagtttccccagttatttaaagagaagtagaccacatgctggaagacgagcagaagatggaaataaagatatgtaactgtcccaaggctgaattcctaaaggaattgctagggaactgcaaaacacattctgagctagaaactttaaccctcattcctcaactcctccctctctcctatatcgaatcacagagcaggaagggacattagaactcacagaattcaatccccacattttatacacaaggaaagatagacaccagagaggttaaataacttcttcaaagtcatggctttattcaggctaccagagcagctccctattcaatatagtctatgacaggattgaacttcacaacgtcacacccaagtgaatagagagctctgatgaaatcccacaaggaaaaaaacaataatgtgaaaaagtacagcaaagaacacagtactggaatgactgtgaccaagttcccaacaggaggaaattgtaatgttttcttcttcactttctgaaaaagtccacatgccactcttttcaaaagactaaagtcattcactgtttgagattcagaggccaaaggtactaatgaagagatgtcccacgatgcatgtccacagtcttgggttcctttgatcaaaaaggtttggtgcgatcccagagaccaaacgctcatgaaattggagctccttgctgaattttatctcccacagaatttcagacctgctttcctctggactccagctcttgatcaaaccatcttggggctgaaggagggtgagggtgaacccatctgagggctggtagaattttctggaaaggcagcctatgttttcttgggaaatctagcacaaaaattattattctaagcttaagccaaatacatgcctgtgtatcgagtcttgacaaaactaccaaatacttggaaagaaaaaagaaaaaaagacaaacacacacacacacacacacacacacacacacacaattgcaataaaaatacagacctcaagcatagaaagaaaagcttttaaaaggcctaacttaccgttactgcatataatgagctggctacctatggcttaagtgagcaaatctaggggcaggtatcaagagattctaggtgtgctttaaaatggacttacggtatcaaaaggaacctgcactcattctatactggcctcacatcttccaaacaaaccaccatcacctctcatccctggcagatttcttacagcaactcacttccagttatgtccactcagcaggtcttggggctacaaaacatagccaaatatttacgaattgttttttctaatcgttgccaaaaacctattttcttgagtaaactgacagaagttatgcttgctcatcatttaggagatcctttgtgtgtgcgatgggattagcatttcattacagacactgcaattgcatttatgtaccccctaacataaaaagactttggaagctgtgtttaggaccccaggttcacaaaaacaccacaacttattttcaatcatggaaaaagttttcattatgataaaaattgccccctgcctgaaagaaagcaagctgttaaaaagttcacccagatcactctatctagggaacatttcagaggcacacaactatgagctatctttcccctaaagacagtcgctgaatctcagtaaaccggggaacaaaattcccgagactgttgggggaggtggaggagaaggatggagagagggaatgtgggaatttgaaggctccaggaataagctgttctcagcaggaaggctagtcagggatctggtgtatagggctttgcttaacctgagggcttctctggaaggtgggaggtttgcctccttaacaaataagaagaaacctctacggctgagaaggtaattccaaagaaaactctccgaccagcacctgcaggcctccggagaagccagagaatgacgaagagaatgatggttttcatatttctccctttgttccaatacaccagtattttccaaaacacaaatgtgctgccacaaaacacagctgagctccagcacccaacaggatgtataattaatgatcaggagagacaggctccttcccccctggtgttttcatagccagccttcacccatagccccaggcttccctacttctctcagccgccaaggaggctgctacaagttgctgtgccctgtagaagtttgaggggtcctcggtttaactttactagaaaagatgtgaacatgtggaggctgcaatgtgtatctaccctgcactattcccctggatttcccttccctccaaaacggttcgcgcgtgaagtcccctaggatgggaattactcagaaagaaggcagctggctcactctcttttttccagttctttcttttttattctgcagttttctatcagtgtcgggtcccccactccagccagtggctgtggggaagggaagacatctctagggacacgactacagaccaggcagtgagcctagcaaccatacatcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccgtttttttccccaaagagcccccagtggggaggggaggagtggccagctgtcaactggattccacaggctgagctccccaggaccctcgggcttcgggagtgaggaggaccccacgccaggatacacacagctacccacccctacttcgctcttcctgctacctatgtgcccagggtcccgcgtgtggctggagggtagagtcaggaaggccagcgggtggtctgtggcctctgacagcagcaggtggtttctctcctttttccttattagcaacagaggctgcccaacaaagagtaggcagaaatgatcaaggacgacctggcctggggatagtgcaggccccgatagacaatagagttccctgaagggttgctttcctctcatatagtctcagactccatccatcccgtgaggagggcagatgggggaagagggactccagacttcattctggctcaccgttccccatttagggtcttcccttctccccacttaagatgaagaaggagtccgtgtttgttccgtagcgtgtctccgtacaccaccaggggaatcccccttctgacactttcagaaactttgcgccccctgaacagcgtccgtcctcgtgctaccagctggaccccaagtttttccagcgctaattaaatcgaggatgatcacgctcttccctcattgctgcagtggtttccccaaagtttccagctcattagtttaagcctaattggaattctcaggttcctttcagctcttcccatggaaaaggcccaagttagcatccttagctttacacctgaggctgtctccgtgagagtcagatcagccctgcccttgtccttggaggtctctggaaggaagagcgagcaagggaggctgagctgggcagagaggctgaagaggatgtttgaagcttctctcttgcttgattcggaatacattcattgggtttagagtacacatccactaagaaagagtcaaggccaaagtcaaaggagaaaatggaatgaggtaagagttcttgagtatttggttctcaaaaagaagtgtatgtaaaagggagctgcagaaagtgtgctccagaaaatggaattgtctgagcctcctctccataccatcccatagtacctccaacctcggcctctgtgttcagccactctgaatgcatccctgccacaccagacccaagcatgcaaaggccctgggccttttctggtactgggttgggggagcgggacccagaagtgctgtggggatgcgcaggaaggtgactatggcattgaggttcctttattagcctctcaatggctgtagtttgctgcttttgtgcctcagcaatgccaagaaagttaaggacattccttaaatcaaggccaagatttgaaatttaaaaataaaacacccagaacataaaaagggcagcaaaggataggactgtctccccagtgggatatgaaacctccagaatggattccctcacccacaaaattgaaattttgcaaaccagcaaatcccctctggggccttcttagacattccctacagcctggattcccctgaaatgccagtctggggtctactggtaagcagccgatggccgtgacttctgtcaccccaactgcaggatctatagctttttctcctccatcatcaccttcatcacctcagcatctttggagagggtgcttggaggcccctcagatgccatctcctgctctcttcatcacccctgcctctgctgattgaagcttttagcaacttctgtgctgtccaaagcctcggcttagtcaggaatcatcagaaactctcagtgttgatgtcaatatcctttccttcctacaatccccagtctctcacctcctccctgaatggcctggctggtaagcactgagagagtgctaccatccaccagaaatagacattcccaggcctttgcccagttctctctggccatttccacattgttcacaaacttttgcaccacttccagaaaacttggcccctggcattacaaatttaggaaaaggctctgcacagacagaacctcaaacttaaaaggaaccttaggtatctttgatttgatgtgtttcttcatttatacaatcaaaataaagccagaaacttccctgcctacctcgaagggttatatgtgaggatgaaaaagaaggctgggcatggtagctcactcctgtaatcccagcactttgggaggctgaggcggtgggatcacctgaggtcaggagttcaagaccagcctggcaaacgtggtgaaaccccatctctactaataatacaaaaattaactgggcatggtggcacatgtctgtaatcccagctactcgggaggctgaggtataagaatcgcttgaactcgggaggcggaggttgcagtgagccgaaattgcaccactgcactccagtctggatgacagagtgaaactgtcagaaagaagaaagaaagaaaagaaagaaaaaagaaaaaggaaggaaggaaatattatacagatcttaactataattactgtgaccccaaaaatggacaggcaagtctaaccagatcttctgacccctgagctcgtaattgtatgtgcacatgcctgcatgtcatgctgtccacagcatgtccacagccagactgtggccagactccagggcacagcagagcccctccagcctaaatgagctctctgactacccaacaccactccttttcttgccagtccctggacagccttggaaatgggaaaggtatagagaagcactctaagcccagcacatcttcccctaatgtaggtgtgtctgcaggctggaaattgaggtccattgcacaagaactgaaagtctcaacagaagtagaaacttcaccctctgttctgaaaacaccacgagccttatttttatttctaaattcattcaaaagcttcccagagagaagggcagcctctgtaccatgtgcatgtgtgtctatggcagctctcaaagcaaatcagaggtttcaagcttaaatattctaatctgaacagtcctaactgatttaaaagaagtaaaaggaagtgcataaacatacatactaaaaaagcagagtgactaaggtaaaaggagaacaaaaaagattatttgctaaaatgttggccagcatcgcaattaatgtgcaatggattttcttttcctccaacctggacctagttccaatactctgacatcaatcttcgcgattttgcgatggagaagccaggtggtgactctttaaatgatctagcgccctctggtggattttcctggcacatgacattatttcatgaatgttcaaaaaagggacttaatttaacagtctgaaatttgagatatgaaaattccaagaggaaaaccctgctggaaaaaaaaaactacagggagtaggaaggaggcatggatcaggaagatgttggtccaaggatacaaaaattcagttatacaggaggaataatttcaagagatctaattgtgcaacatggtgactactgtggataaacaatgtttttttgtatacttgaaaaccactgagagattttaagtcttctcatcacaggtaaatgataagtatgtgaggtaatacatgtgttaatttacttaagttagccattccacaatgtatgtgtattttgaaacatcatgtacaccataaacacactttttgtcacttaaaaaaataagaaaaattgataaaaaaacaacaaaaccctacagcttcaacagtatgaattatctagttaccagtcctaccagcatataagctgttgtggataaaggcagctaacaaagttcatgttattactatgacttgatgtcagatctcaactgttactgccaccagtaaccctgcccttccttgaatcaccactgtgttttcttttaaagtcagcagtatccctctttctaaccacccttggtcttcacagtctctttgtgaagtaaaaaagtgcagtagtggccaggcgcggtggctcacgcctgtaatcccaacactttgggaggctgaggcgggcagatcacctgatgtcaggagttcgagaccagcctggccaacatggcaaaaccccatctccactaaaaatataaaaattggctgggcgcggtggctgacgcctgtaatcccagcactttgggaggccaaggcaggtggatcacgaggtcaggagatcaagaccatcctggctaacacagtgaaaccctgtctctactaaaaatacaaaaaattagccgggcgtggtggtggatgcctgtagtcccagctacttgggaggctgaggcaggagaatggtgtgaacccgggaggcagagcttgcagtgagccgagattgcgccactgcactccagcctgggcgacagagcgagactccatctcaaaaaaaaaaaaaaaaaatagctggatgtggtggcgcatgcctgtaagcccagctactcaggaggctgaggcaggagaattgcttgaactggggagatggaggttgcagtgagtcaagatcgcaccactgtactccaactggcaacagagcgagactctgtctcaaaaaaaaaaaaaaaaaaggctgtagctattttcccactttacaggtgagaaaactgaggcttagctctgccaggttacttggcacgacaaggaaagtctgttacctctgaagtgatttatctgtttgtaatttataatgctggagagtgggacttacagaacaagctttcacatgcttacatttttatagatatttattttatatttacttctgcttgtaagaataattcatatgtattataaactttggaatataaaagtttcatataagcttcaagtcagtgacaagaaaaaagaatatgtcacatagaatcttaccaccccaaaataaccactattaatatttttatatatttatctcataccttttccttgggtgtgtatttctgcaaaattagggttagattaaacatctaacttttatcctattttcccttaacatgaaactgttagcattttctctaagtcattaaatatcatggaaaacactattttaaaaaatgataattggataacatttcagtagatggcatactcctggcatttagatgattccaaagtttaatatgttttaaaataaattataaaactgtgtgcaaatgacttctagttgtcaaaaaagatgtccagaagatttccactgacatgcttccatcctgtctccagtgcctcgggagagcaggtgtgtgtaggaaagaggtgcctgtggcagtcagtctggccgtgggatacttcccagccctgccccaggtcactggcctcagatcagccaattgtgatgaagaagctttgagccagggcatgttacccgcaaagtaattctcttcttttctaacacatcaaagccagtgcattggaagaaaataatgctgtggtctcatcgtatcctcctcaatcattgcgccacctgcctgccaagatacaaacttgcaagaacatcatcttcattccccaaaggacatccatggctaggtcaaagaaggcacagctcaggcacaatgccctgcctagaattcacctttcaccaccattctgcaggatttccagaataacgattctgcagattcctgtgtccctttcctctctgtgatcagtgtcaccccccagcagaacaccactactgtgggccttgcctctgggaggtaggcagggcaaaaatcagtccacccatttttgctagtgggagaagaaggcaccaaaaggaaaaagattttcctcagtgctacagaacttgtcttcctgactgacagaccaaaaagctttctaatccttttcttagagtattcctgatttaatctttgcaaaagctctagttcaatgcctgggcagtccaggacttgacttcttactcctagtgctccaaaataatccaatgaccgcaatctaagggactgtgcagatgaagcagggacttactcctgcctcttcctggtagcttttgcaatatttgcaagtaagaacaatgctgagatcatccttcccacttacaaaccctcttgggaataaggagagaagtcaggaagtacaacatctctaagagtttcatttacttccaattctgacttgctttcctggtgtctgcttttgtcataatgttctccaaaacaaggtccctttgtttcaggaaaataagtcattgtaccaaaaaaatgcatgcacttttatgttcatcacagcactattcacaatggcaaaggcatggaatcaacctgaatgtctgtcgatggtgcactggataaagaaaatgtagtatgtgtacacagtggaatactatgcaaccaggaaaaaaaatcacattctttgcagcaacatggttgcagctggaggctgttatcctaagtgaattaacacagaaatagaaaaccaaatatcccatgttctcacttgtaagtgggaatcaactctcgggttcacacagacgtaaagatgagaacaatagactcacactggggactccacaaggaggagtgaggaaggggagcaaggactgaaaagctgcctattgggcactgtgttcactgtctggatggtgggatgaatagaagcactaacctcagcatcacacaatatacccttgtaacaaacctgtacgtgtaccctcaaatcaaaaataaaaatggaattttttttaaagccctttgtttcacagtggcctccctggaaggtgcatcccttcttcagccttgttatcccacagttgccaagcaccctgcttcccaaagatgatcatttgatggtttaaaaaattataaaccatgatgcttttatgaaaggtaaggctctttctgtgaaaccaggaaattctgcttttgctatatttttgcaaagataaacatttttttttttcagagcaggagtgaaagtttatttaaaagctttagaacagtaaggaaaggaaggaaaggaaagagaagaaggagagtacaacttggaagatggtcaagtgggcagcttgagaaaccaagtgcatagcttgacctcttgacttggggtttcatatggtttggctgtgtccccacccaaatctcctcttgaattgtagctccctcccgtaattcccacgtattgtgggaaggacccggtgggaggtaattgaatcatgagggtgtgtctttcccatgctgttctcatgacagtgaataagtcttatgagatctgatggttttataaaggggagttccgccacacaagccctcttgcctactgccatgtaagacatgaccctgctcctcattcgcattccgccatgattgtgaggcctccccagccatgtgaactgtgagttcattaaacctctttcctttataaattacccagtctcaggtatgtctttattagcagcgtgagaacaaactaacacagggttttatactttggcctacttccaagatcttgccttaaccctccccactcctgagatcttattgggaagctgctgatcagtttcagctgttttctatctgtcaggagactgctgttccctggctctggctgtgaccaattattactttagagaaacagttaaccccctgaccatcacctgatggttgcccaccactcctaagtgtgttgtggggagccctctcctgccttgctcatacctgactggctacctactataacacgtcccccctcaagagtccaagatcctaaacctttgggggaaaatggatgaaggtcagtcttctgcaacttcttcctgctgacagaggggcggtggtggttctgtgggtcttggcctcttgctagctgtcagggccgacttgggtccatgaattggtgaaagcggtatccagccaggtctaagggagacaggggcaggattttgcctctgtcgtgtcccactgatgaacaatctagaggttccctttagaaaggtgactcttgaatattgagaggacaatatctctcactgaggatcatctggagcttgatgtcctttccccttaaagaggaacctcagatctttcagggccttgcaagtgtattgaggagctgagggcattgcttccaactctggtgtcctgaagccttttcacggcttcactcgggtatgttgtatccagctggcaatctctagtactttaatggccctgggggtaaataataaaacagtgaaggggtccttccagaacaaaaacccaatctagcagtgtcctgcaaaaaagccataaatacagaccaataaactggtttctgggttcaagagggaagttcagtaaaggtcctagtagaaggtgcttaccatatttcagcagaatgctgttagagtcccagaatgtaagaatcaccattctaggaatgctgcctggagccaggaaggagaggtagatcctcacctttggctagaaactgagtctttgagtctcccaccagggaaatttccccagtggattttgcgtggacatctgactaatccagaaagagacctgaaggtgggagagaccctgccatcttcctggccattctagaaagtccaaacacaaagagaaatgacctcccgtttctctgagcactgcagccactacaatttcgtagcatccacagagtgcctcgccagctctttctctctgaggacctctgacatgggcttatttaagcgcaaactttagatgcttccagaaagatggcttgcctacagcactatgcagctggaacagggagactgttagaggcagacactgcccagcgtgtgtctcagacctcccttcagaaaaagcctctgtgagctccaggacactgtgctaaatgcattttctgcaagatgctacactgaattgaaagcgtgcaaaaacatccttttggttatctataaatttcattttgttcttctctcctaataacaaaattgaaagctgtaagttgaacaaagcaacctgcaaactgctctagcagccctgggaactccctgggtgatatatggtcatgggcttagagcttttcatttgacttgctcttggcttttctatcaagatctgtcttggtgacactctactgagatagatgagttggtatgcataagtggcttttatttcagaaggtaatacatattctatttaaagtacaatgacccagaagggaattccagcccctttatcattagtatagaaattcaatggttcataatctggtagctcattgaaatgacttttcattaacttcaatggttcataatgtggtggcccattgaaatgatgttccattaaattcaatgggggatattatttgagtcagaaccaatttacaaactaaacagaatgcaggcacacatcgcactgcccagagggctcgctcggctctctcttccctgggtcttccatgaagactggtgagatcagcactgcctgggagctgaggtggtaggcagagaaaaagcatgtaggcagggcatgcccttccttctaggggaataatagttgaggccagagaccataatgggcaatttacatgtcccaaaattcaatgcacatatttccctaatgcttagaccaccttcacaattttgaccatatcgtcatactgccttttcaattacttactaatatttgtcttcaatagactacttttatttacctaaatttatttcaaaaggaaattctataccactatcttcctggaaaaccaacatcactgtaagtagcaggtaaataaatacagtagtctctcacttttctgcagggcataccttcccagaacccctgtggatgcctgaagccacagatagcactgaactctacacacagtatatacaagtttttccatctgataaccgagaacactgctcaggtactaacaggcaggtggtgggtggtgcatacactggacaaaggaatgatttatatcccaggcaggatggagcatttggcaagagatttcatcatactactcagaatggcagcagtttaaaacttatgaattgtttatttctggaactttccattgaatatttttggactgtggttgaccacaggtaactgaaattgcagaaagcaaaacctcagataagagggggactactgtaataataaaataaaaataaataacaaatcaaaatataaatacattagaaataaatagaaggcaagtgtaaaagtaaatataataaatgcaaacaatgctgtaaaatcagagcttgctgttttcaggtgaaagccctccatctgaagcctagactgcctttgctaaaaggagaaattggtaagtgttgtagagatgttccaggcacaatgaccatctctgtggcaatcaggttagagagggaattgggcagggcatgactttcccactgagtgccaagaccggagtataagctcaaatcatcctttgtaccgcgtggggtcaagcagcctgcctttttggaagcactgctttcctactcgttttaattcttacacgaggctgggcacagtggctcacgcctgtaatcccagcactttgggaggcccaggcaggtggatcacctgaggtcaggagttcgtgaccagcctggccaacatggtgaaaccccatctctactaaaaaactacaaaaattagccaggtgtggtggtaggcacctgtaatcccagctactcaggaggttgaagcaggagaattgtttgaacccgggagatgaaggttacagtgagcaaagatcatgccactgcgctccagcctgggcgacagagcaaggctctgtctcaaaaaaaaaaaacttacaccatctcctaaagtatcacccccactatacagatgtggaaactgaggctcaagtaagttaagtaagcaacttgtccaaagtcacacacagagtgtcctcaaggtcagtgcacagcattatcaggggtcactcagccctctgaccctatcgccatctgggccattataattctagaaggaaaagcacattagagattttgtctgacttcctctttttagagtgagaaaagtgcagcctagaggtgtttaataacctgcccaaagcctctttgttccccagcgactgagctgaggttagaatccttatctggtgtgctttctgtcctctcaaagtccacccggccagcagatgagcctgttgggagccaggcaggtggtaaagtttcctcaccatcctcctttctgctcccagcaggcctaggaaatcctttcttgctgacctttctttcaaatgctaatctgggcctctgaggctggggtgggggggtgggagggggggcctttcccccattgggagccccactgccaggtgagcccatggctgtgagtcagcacagagagcttcagaagtccctcactgatggggggcatgcagggagtgtgccccatggcatctgggcctttgcaaagcctgtaggggccggggtgccccattagcccaggagatgcccctgcaggaggctttaaactcagcaggtgcacctcacagctcctcggtctcagacacagcctgaggtcaagacagaagctgtgaagaagctctgttgggtgagccctggggctgcaggcaagccaggacctttggaggccctgggaggctggcaggggtgagggagaatggcaggtgcaggtgccatactgcacctttgggaagagcaaaggtggtggggtgagcgggtcgagttatgagaaagttcacagaaacaaaagagggggtatgagagtagaagtgggaggacagagaaagagaaggaagaaaagaagtaaaaaataaaaggaaacagagagagaagaaaaagaaagagaagggagggagggaaggaaggaaggaaggaaggaaggaaggaaggaaggaaggaaggaaggaaggaaggaaggaaggaagaagaaataaataaatagagagacctaagaaacaaggcagagaaagggacatcacctgtcccagccagtggcctcttctgagttgctccacttccctaacaaagcacagagacattatgcctgtaatataagggggtccaaagtgcccacagtaagaaacaagtattctccccttaaaggaaaggcacaggatcctggtggcaaatttctgacaagtgagctccccacccccaacacacacacacagacagacacacacacacacacaatggactgtctcctttctcagagggatacatgcttgagatgctgggtgtacctgcaaagcacaggcctgggaagcccctccaacacagatggtcttgtcttataagtgtcagggtttgtgccagctgaaagggagcccggacttctgtataggaggtgaggacaagggcagaatctccttcattgtgtattcttttctcatcacccagaagaggattaatcatattaggactcagcagaaacaaacgagaagaagctgcacatggccaggcagtgcctcccatccccaggcagtgcctcccatccccattagtggcctgcgggaggaactttccatgggaatcccacccagcccagcctccttgcagggcaagggcccaggacactggtctctccagctgactgcacagggctttaaagccaaggatgaggcaggggaggagagggtctcagtgtaacacattctactctaccctccagggctcagttcctcaattctacaaaggaaaaaatattaggtgtttattaggtaaatatttattaagcacctaccatgtgctttgtgctattggcaatttctataaacagggttttcccatccacagcagctctccctaccacatgagagggtccctggaggagcaaccacatggattaaatatttcacaccatgagtcaatggaagtgctagctcagccctcaagttgctgcatgatcccactctggagttccatggagctgggttccaatttcagctctcctcctctctcaggctgcaggctgtgggttaggtttcttagcctcttgaatttcagtttctccatctatatagtagagagaataacagtgccttctcagtgagttggtgtgaggattgaatggaagaatcctggtaaagctcttagttagcacagtgcctggcacatggtgtccttttgttggcctttgctacaattaatgaaggcagaagtgtgattatataaacctgtacccactttctttgagtctccatcctctgatgtataccatgaggtactccctgcaacccctttagtttgaagccatgctattcttgtctttgctcccctatctcaacccaggaatggtgatattcttgtttactcgcctttgtttggtgttcaatgctgtctctccttcctgtgatggaaggattgttctgtccttttcccccttccagaacctgttctcatttccgttctcccaaggccagctgcagcctcttgtctcaagaatgtatatcttaacaacaatgaaaatcctcacagactcataatcaaaacatcttggagaggatatcttagagaaatgaggtacctttccaataaggggaatgaggatctttggtgtctttttgtgggtctttcatatcatcaacaaatacaagtgtttgttaagcatctattacacacacgcaaatatattaattaccatgatttaaaaagggagaagacacaaatcctcaactcaagatgaaaaagattcctaaagataaaggctcatttaatatgaattcacaattcaaaatttcaaaacccgtgaataaataatcacattatgagcaaatgtcaataaatagaaaaaaagcaaaatcagataagactgccaagaacttgaagtaaatgaataatatgatagagaccacaaaactagtaagtgtaaaattattagacataaaagaaggaatatgaaatgtaaaaaacacaacagaaaataaaacagatttggaaaagaaccaaatagaacttatggaaatccttttacggccacagaaattttacaactcagcaagtaggataaatagcagattagactcacttggactgtaacaattaggccaataaaaatagatctgagaaacataatcagaatgtagtatatacaaagaaaatgatagaaataagaacacaggcatggctcttatttctatcagagaacagaatgaaaatagggccaggcacagcagctcacacctgtaatcccagcactttgggaggccaagccaggcagatcacttgaggtcaggagtttgagaccagcctggccaacatggtgaaaccctgtctctactaaaaatacaaaaattaaccatgcatggtggtgggtgcctgtaatcccagctacttaggaggctgaggcaggagaattccttgaacctgggaggcagaggttgcagtgagctgagatcatgcccaccgcactccagcctaggtgacagagcacacctctgtctcaaaaaaaaaaaaaatgaatgaaaatagaatgagaaaatctaccatacacctaatgagagttccagatgaagatgatggagaatggggagaagcaataatcagagataatggctgggaagtaaaaaaaccagaattcatagattcataatgccacaaattttaagtaaaataaataaaaacccactttttcatgccttatagagaaatcataattcaccaaagccaaagaataaaatttttaaagtaacaagagagaaaggagagactacctacagaggaatgacaattagacagccaacttctcaacagaaacaactgaaacaagaaacaatggaacaagatcttcaaagaactaagtgaaaattactgtcaacctagaattgtaggctgaacacaaagtgtttttagacaaataaaaactaacagaatctgtcaccaacagactctccctgaaagaatttctaaaggataaacttcaggagaaaagaaactgaacccagaagagtaataaagaagcactgaagagcaaagatgatgattaccatatagataatactaaacaagcattgatttctaaaacagaaaaaatattaatgataattttgatcattaccaaaacaagatggaactaaaatattagaaaacaataacatgctagacagggactgttacatcagagttaaagcatatcaagattcctagattgtttgtaaggcaatagaggtatgaattaacttgatactgttaagtcaagtaaacattaaaagtttaggggtaaccactgaaagaataaaaatgaaatatatagcttccaaaccagggagggatggaaagggagataaagatagaaaagaagagtcagccaggcatggtggcttacacctgtaatcccaacactttgggagactgaggcaggcagatcatctgaggtcaggagtttgagaccagcctgaccaacatggagaaactcatctcttattttttttttctaaaaataaaaaattagctgggtgtggtggcgcatgcctgtaatcccagctactccggaggcagaggcaggagaatcacttggacctgggaggcagaggttgcggtgagccaagatcgcaccattgcaatccagcctgggcaacaagagtgaaactctgtctcaaaaaaaaaaaaaaaaaaagaaaagaaaagaaaagaagagtcagggaaagcagtataaagtaaagtaaacagaactaataaaagaaaatgctatacaataaataaatacaatatattcaaacatctgaagctgtagtaattgtaaatagattcaactcaccaatcaaatgaagaatttaattgcttagcaatgtgctatttcacagaaccatatctatacattaaagactctgaaaaggactgaggaaagatgtaccaaattgtaacgaaaagaaagcagtgtaactgttttaataccagacaaaatagactttaggagtaactagaagtgacctaagtacaatggcaggtggagaaggagagttattgaaagcagagagaactgcatgagcaaagacatcaagggaggactatccctaacaaatttcaatagctcaagttcaaatataggttaaaatagagaagcttcttcattgtaacattatgctctgttatttttaatgtatatttttgagcatgtaggcaccagacaccatgctataaattatttctataaattatttctactcctcgaaaaatctcacaatgcagatgctttgttattcagtacaattttggttatagaaaactgaaacccaatttgaatcagtctgagttaaaagtaagaatagatggatctctcactagaaaaaccccacagaaggaaggacactgtttgggccaactttggatcccatgcccactctccagctcattactgagttcaggaggacaggccaagcttgggtcaagtgcctgcccagcctgaagtgtggggtgttacaataaaaaataaaaaataaataaaagaaaacacgattgatgtacagaaggactgcttctctgaaagtaggggtctgacaaaaacaaacaattccacaagagtagattgtattatcctcattttataaatgaagtctcagactcagaggccaagggacttgtccaaagccccaagcacctacatggcagagctgatgggaaaccaggttttttcctctaaaaggctgaactttttctccaagcaatgaacataggactttgcacagagttaagttctcaagatatatactaattcattattttaaaggacctacagaatataaagaaaattgatcattttctttataatcattaaaagatttggaatgaggaacttgtttctagggccaacaaccctacagcatatgggccctcccaaggaccctccacagacaccaatgaacttggcatcatagatcctcatgcttagaactcctttgcactgataatttgtactgtgcagttcagccctaaaaccatctttaattatttcacagcttgtccaggtctagcacctccctttctcctccacaacacccaaaagagccactagtagatgtttaaatgattggctccaacactttttaactcatgaacccatctggaaaactgatgaaacctatgggctcccaccccgaggaaaagggggaatcaatgcctatttgcacatacacacacactttcagcaactttgcaggcccctgaaatgtatccaggaatccctgggagttaagaactgcctcaacaagaagggaataaaacttagtacccccaagagacagcattgggaggctattcaatcaactcaaaaagattggggccaattcacatgtgactatcttaaatggacaagaagtgctaacccataaaagcacatttcatagttagctgttgactgcaatggatcccattcagctccaattttaaaataccagctgagtgccactatgtgccaggtactctgctggatacaaactagagtaagaccctgtcctgaatccctagaagctcaagacagatgcataagcaacaatttcacttcagtgtggtgaatgctaaggtagagctgtgctaaaatcctatgggaacactggcaggaggtggaaagtaagggaaggttccaggagagaaagtctcagcggaaggaggatcaggtgttttctggcaaagaactgagggaggaggggagcattgctggtggtagaaacatgagacccacatgcatgtagagtgacatgtgtgggaacatcaagcatattggtatcactaaggcagtggttgtcaatgagggtgatttgccaccccactcgcgacatcccattaaggacatttgacaatgtctgagtgttatccaacagaactgaggtccacttgcccagcacagttaagaccaaacatccacatctatgttttcagcaagagaaataatggcatttatttgcagggcaccaagcaaggagaattgagcagctcacacttaagacccagcctccccaatggctggcaggtaagggttttcaaaggcatgggtaaatttcatgaaagcagaagttacaggcaaaatcctaaatcaatacatagaggttacacagtgggttggcttgaaaaggtgggatatctggaagcagggccttagaggtcacaggtgggtttaaagattttctgatttgcaattggttaaggaagataagctttgtttaaaaaaagaagtagagaatgttgcctatttcatgggcataacttccttcaggcccctcaggaagaactttagaacaaagaccagcaaaagcggtaagagttcagtcctcagttcccccttatctgaggtctatgtgccagtagatccatctggtaggggtctgggtttctgaagaaccactcagggacatgtgttaaagtgttacctttagtttctatagggaaccaaacacctcatggctctaacgtccttggctattgtttaagctaccatttccttttaggttatgcacttgctcactttcttctcagagccagctcggtgcctcgaatttcccttgaaggaacttaagatttccctttatttccatgtttagggtacattcagcaacctgagaggggtccctgctccatctcacgaggatagctttggttgtcttatctcgggtgggagtggagttgcttatgggtatctagtaggtagaagccaggtctgctgcgaaatatccttcaatgcacaaaaagcccctgacaacaaagaattttctggtccaaaatatcgatagtgttgagaaagcccacatcagaggatcaagtgtggatagggagttgttgcctgaattgagaaaccaatattcctgtagctttggggctgctgccatcagaccctctcttccctaaagcaatgataccagctctgcacctcatcagcaggaggaaagaatgagagtggtttgtctctgtacagtgaaaacataggttagttattgaagctaacttgacttctgcactcatgtatcagttgtgattatagaagaaggctcggctgcacccagcctgctatggtctggatatttgtgtccaccatccccgaaatttatatgttgaaacctaatccctgttgacaaaaagagtcaaactctgtaaaatattttaagagatttattctgagccaaatatgagtgaccttggcccctgacacagccctcaagaggtcctcagaacatgtgcccaaggtgatgggggtacagcttggtttcatatattttagggaggcatgagacatcaatcaaatacatttaagaaatacattggttcggttcagaaaggtgggacaacttaaagtgggggcttccaggctacaggtaaatttaaatactttctggcagataattggctgagtttgtctgaagacctgagatcaatggaaagggatgttcaggttaaggtaaagggttgtgcataccaagttttattgtgcagaggaagctctccgatagcagacttcagagacagcaggttgtaaattgtttcttatcagacttaaaagggtccctggatcatagttgattatctcctggatctgggaaggaaggaaggaaaacagaggggcaaaggtattctctgtagaatgtggctttttcccacaagagactttgcagggcaatttcaaggtatggcaaggaaatatattttggggtaaaacatttcaaattttcttccttgttatgccagagtcagattggaaagtaagtcatgatacacagggttaaataaacccatctgatgagaatttatgatttgtagggcatgactccccacaccccttaggaatttgggcaagataaaaaaaatcagagcttagtcctcatccccagtgtgatagttttaggaagtagggcctttgggaggtgaatgggattagtgcccttataaaagagtactgagagagactcctcaccccttctaccacgtgaggacacagcaagaaggaacatcgatgaaccaggaagcaggccctcaccagacactgaatctgctggcaccttggccttgggcttttccagcctccatatctgtgagaaaaaaagctctgtggtctataagtcacccagtctggtatttttttaaagcaccccaagcaaactaagacatggctccacctgaaagtaacctgtggatgacttgtgtgaaccccaaacatttgagacaggtcttagctaatttagaaagtttatttttgccaaggttgagtacgcgtgcccctgagacagcctcaggaagtcctgacaacaagtgcccaaggtggttggggcacacctttggttttatacattttagggaaacatgagacatcaatcaatatatgtaagaagtacattgattccacccagaaagacggggacaacttgaagcaaggaggggtcttcctggtcacaggtatgtgagagacaaatggttgcattcttttgagtttctcataagcctttccaaaggaggcaatcagaatatgcatctatgttagaaataccaaaattgttagaaatagataatcggtgccatgaagaaaagtcagcacgtagacataagatctctcagcaaggcaatctttactttctgcagaaagggtgctcaatcacagatggaacaatggtgagaatatacctgaacaaaggaaaagcagacatatttatcccttactcatttgggtcatccttactgctgtgtcctgcatccatttgctggagaaggacctcactgatatccgatttgctaataacctgaaactttcctaaataggtaagtgcagggaaggacaaagaaggagaggaagttgcttatgaaaggtttaaggaagcaataacatttccaaataaggaaggggcataagctatgagctaagatttgcctgggcctgtccagacatgcctgagtaagccaaagcaactaactgggctaaagtgtaagaactaatagttgataggagggtttagagtaaggaactattattcctagtgtctattattttatttttaaacaagacaagctttgaagaggaagttttctactttctacaatctcagtgagcggagggattactttgaacagaatgggaggcagatttgccctgagcagttcccagcttgaattttccctttagcttagtgatttcgggaacccaagatattttcctttcacatttgcatacccatcttcgggagtagcaggtaacccaggttattcacgggatttggtttgcctggttagcccacagtgggacacaggaaggagaattcagagctgttaccaagtgctacctgagatcacacacagttactaaggtctggagaattctctccccaaagctccagatgtaactgtgactctacagtgacttcctgactctagggacatcagaacaagttccttaagagagctttcaggaaatagcctgggaactctgtaagcagggtcaagaatccatacagtcacaggggcagcatcttgctgaggggtttgcagagggttaccacaggaaagagaaaccacccatagcagaggggcagcaggaacaaccgccaccaagtgggtcactagccatgggagcctctgagtcctgctgacagccagtggctggaacagcaaccgagacctgcacaggagccagggcttccaaagcttatgatgaaaactcccactgacatggtcagagagagggtctagttccaggaacttatttatcagagtgctctctccccatcttggcatgtgttactggatattgtgatttttttttttttcgaggcagagtcttgctgtgttgcccaggctggagtgtagtggtgcgatcttgctgcaacctctgcctcctgggttcaagttattctcatgcctcagcctccaagtagctgggactacaggcatgcgccaccacccccactaattttttgtattttcagcagagacagggtttcaccatgtggggcaggctggcaaaacttggtctcaagtgatctgcccaccttggcctttgaaagtgctgggattacaagtgtgaccaaccacactcagtagatattgtgatttttaataagaaatatatatttggtcttcatccaagcacaagtgctaggaaactaggaggtttcctagcacacacctcctaaaacccttagagtagcagaagtgatttgtccttttgtatactaatgggttgactgttggctgggggcccctggatagcctcagaatggggactggttgccagtggaaccaaccttgtgattggaggattgggatattcaactcttccccctgacctccagggagggggagggctgaaggctgaggtgatcatcaatgtccaatgatataatcaattgtgcctacacaaagaagactccataaaaacccaaaaggctgaggctcaggaagcttctggattgctgaacacatggaggaactgggagggtggcgtgcccctagagggaagctctgcaccccttcctttataccttgccctatctgtcttttcttcaagctgtacctgagttgtatccttttataatgaatgggtaaaattaagtcaagtatttccgtgaggtctgggagcaatcctacctcataatcaaccaagaggaggggggcgtggaaacctccaatttacagccacttggtcagaagcacaggtcacagcctgggatttatgactggcttccgaatgggggcagtcttgcagtcttgtgggactgaatctttaaccctgtgagatctgactctaacttcaggtggatggtgtcaggattgaattgaattagaggacacccaactggtatcaaagatctggttgcatgagaaaaaataacccacacacattttgttgaccagaggggaagtattctgtgttgagtgtgaatgtagaagggaaaactgttcttttcttcctattatacagtcatccttaacatctttgtagaaagcatcattgattttcaacatatccatcactgaaaggaaaagccagctccccaccagcaaacctcaccaggaaaaggtccaaacagcctgagagggaacttaattcactgtaactagtactcagatcctggggggaggctatggcctgggggaggatgatatacaggtatacctcagctgctggtcacaacaaaaacaaaccctgaatactacacccaaacatgctaagctgactgtgggaaatcggctgagataaggcaaacagaacacaataagaccatttatcctgaaacaaactggcccttcagtttccaagagacacccataactcagccctccaggaagaacttgcacgtcagttgcctcgttctctgggcacagaacaccattaactttaaaaatacaccaacggttgtacgagagacaagtcatcaagcatggtgctgggaacagggcggtttgggctccatttaaggaaaagcactgggcacttgcaggccacagacttctgcaacggaatcttttgaaaaagcttctccttccgtctggtgatcccgtcagcagcaggcctgtcccctaggtcaggtagcctggaatttcaatcccccaggtgccagcacttctgcttctcaacttgcggtccctttactaaagtcaaaggaggatggaggctgtgcctctacttctggaccctacttttataaatatcctgcaatgtaattatttttatgaccaaattttcttttgactgttaggcctcctctgggaccatgtaattacccagccctatttgcaagtttaagtgcatggctctgcggtcatctgaacacaggaaaaggctttgccgtgcatctgtacgcatattgccttcatagccaagttattcctaaatcgttcaccagtttaaagatgtgtcccataaaaaccttcttctgggctccatccaaggcggtggagccagcatggccctggacggatatttcagggaggctgagagcgaccgcaaggaagcattgtgcctaatcgtggcactcgtccggatatcgtaggaaaattatgaccgaaaatacctcctgaagacagaatgaccacacggcctgcggcagactggcggtgtcaaggtgttcagctttttccaagaatggcacagagaagaagaccacagaagagctaagcttcttggaaaatgggtgtgtcatgctagggaaagcactggcagcgcaggaaataaagaaagctccccacgtaagccatctagcacaagggaatgtatggcagagagtcaacagccacgtcttggcagtggaggatctaggttcaaaaggcagctctgcacctttctagaaatatgaccttaaacaatttggttaactactccgattgccaggttccccatctatagtactgaaaatcattctatccataggttgtgtaaggatcaaagaagataacagacataaaatatttagcattgcacctgataaatagtaaatatttcacaaatgagagtattgagagtattattaccctcaatggtaattattattattattaagagtattatcattttctcattattaactccttatagctgcatagtgttttagaatttgcaacaggctgctctattcattcctttttttgtctgagaaaaatctgactaggtaatgtattaattcatataattaaaaataaaaatgatatacaagtacatgatgaaagcctagctcccaccccgtctctatccaccttctcccctcctccacagctgcccttgaaggtaacactttccttaggtcctacatatgcaccagtgtttctttctacaaatacatatattcagcttccccccattttttacacaaaagtagcattctattcacactattctgctatttgctatttttactttatattaataaatcttactatggagagatcctactttccatattagtatataggaagcttgctggatctctttctctcatacacacacacacacacacacacacacacacacacacacacagagagagagagagagagagagagagagagctacattgtattcctttgcatagctctatcacagtttatttaaccagctccctctgaacggacacctgggctgtttccaattccagtcgtgtattgctcttgacactgccacagtgaggccccttgttcatcgtcatcttgtacaagtgcaggcacatccttagaatgaatccccagcagtgagatcattggtcaaagggcacaagcatctgtgactgtggctggttattgctgagggctccccattgggattgtgccattttgcacctccccaagcaatgtacaagagggagcaatccttttaactcttttcattgtttcttctgctagctgcccccatgtctccaaatgttatgctcagccagtttcttttcttctcttttttttttaccatcttaaccttatttaagcacacaattcaatggcagtaagtgcataatgtttaagtgtcaccaaagcatttatcccaaactgaaactatgtgcccattaacaagaaccccccattccctcatccattcttgtttatgctggcacttgcccatatagcatagttggagggaaataaaccttcctgacaaatcccccaaaacactcccacttgctctctgaaccatcgtactcgtttaataatagaggaacaaaggctttcattgtatgataagagattagccttgtagaaaaaaattctcctggaagaagaaatcaaaatctttaaatttcacataaacttgtgaatggctcctttctatatgcagctctctgtgtgggtcaggtagaggatgctggaaagggcagtggggatggtatatcccatggtatgtggggtcaggggactcagaaaaagaatgctatattttatctacttcttagtctaaggactaagttgcctagctgtcggatagaggagagtgaatttggctttgcacccagcaagtacttggttttctaagacatgcagttctgtgggcacctccctaatgccatcgccctctccccagatttcccagctgtgtcaatattcctcttcccaagctccaagccacctgaggaccacatgccagggggcattgagagataggtaggatgaggctgagagagcaaaggaagtaacagtaagtagaaaggacgctgcacataaagtgacaagctatgtggacaagatgatgtatgtaaagtgcttagtagggggtctgtatccagctactgttcagtgaatggtgatgatgatgcagatgaccgaaaatgataatggtaatgatgacaaattcctcaaaaatcagctgcctgagtagtggctcagctcctaaatattggagcagctaacctccttatactgatctgaaatccaatccctccaacttccaatgggtcttaattctacattgggccacccacaatctgattacacttcccattacacacacgtcagtgggttaaagacagcaatggttcctcctggtatctcctcttcttcaatctgaatatctcatcattcttcaaacatccttcagaaaacttggtttctagaccctcatgaagcattttgacagattgaaacaagggagacatgaggagaggagctccattccatgaaagtgagatgggccacagatgagaggcaggtagaatttgagacccagggacagaggaaacagggtgagaaaggagtgactccttgggtcagaggcccaaagaagtgactcttcagaacttagttcagagcagtgatccgtgagagcaccaatacaggactatcagccgggttagccctggaccaaggaatgccaggatttgatagggctccatggctgagtccctgggaattctgctatttcattactaaatctctgaggttcacctccatgtgagcccatctaagtagggtattaagaaggttcttaacacccccccaaagtcaccctttccatctttaggtggaaagttatgctatgaagactttggcctccacattccaggggctaagtcccacccttgaacagaaaatgtctccctcatttccctgtaataacttggtggcattgcaggacagagtagagggacaatgtatagtagaacaggcaggggatactgagtggctttgttcccctccctggaaatccctgtggacccaaagactatacaggagcagtggcattatcactgagatctactaattgatagtggttaatagtgataatctgattaatctattaacctagttaataggttggcagatccctggtgtttacttcaattagatcccatgcatttgcacatttttttagtcctaggtgatttttttcatctcaagttatccaagtatttgtcctctgctgcaactcaaaggcttgttttcctaaacattcattcatcactttccattgagaaaatctccatccattattcttcctccttacatcactctttagttctaaaaacctccccagtgcaaataccacatcaacactccctttttcttttctgttttttaaaattattttttattatactttatgttctgggatacatgtgcagaatgtgcaggtttgttacataggtatgcacttgccatggtagtttgctacacccatcaacccatcatctacattaggtatttctcctaatgttctccctcctcaagccccccaccccctgacaggccccagtatgtgatattcccctccctgtgtccatgtgttctcattgttcaactcccacttatgagtgagaacatgcgtcaacatcccctttttctattaagcctagcagcattccaaaaaggaaggtagatgtagtctttcatacagagaataaagcactgagaaagaaagttcatgcccatctggtgtcctctcttaaggaagccaccaccacaacagtgaacagatgagcaatcattggctccctacttctcccagctcactggactcagggccacatagccaagtacaagatgcctggttggtataaagagttcccaattatatcaccaggcctggttatttctgcatgccaggacagatccaggtggcccacactggggggcctgggagctaccttcatttttggattcaccttcacagtgtatggatgtgaagctcaagttcaggctctgtttctgccttggccccagggagaagatatgtgcagtggcacgtagccaccattgccacctcccaagttgtggctacaagttcttcctggcaaagtccatcttcattgatgctctccaatttccctctccacccaccatctcttttcttttttggatgataatgactgcctgagttagctcttatgagtcaattccacctatttttggtcaaactccactcctggtttggtcctcttccaagacaaatccagaagccacagggggctggagagttgccctggcagagagttgcccaacagaacttcaattaatttcccaggttgccatcaggacctccgacatgggagtggagctcagcgtccaagcctggcagggaagttggctggcatttggggaagacatttaggatgctgggtcctccttacttatgcctttaaatatgaggaccagttcctgactccaatgctctcccaaacacaatggggcccaatattagaattccacatattttctaaattcaaaagtcagaatgaaggagaggtggagaaagacagcgacaccaacgaagacacagaagcagacagaaagctgagagaggcagagaggcagactacaggaacagagggagcctcgttccaagttgcctagcccatttctcacactcagacacttaactgtgctcacccctcatgttcaaactcatgcccctcttgttccccagcacctgcagtggttctagaatttttatgtaagaagttgaccatctagttggaagaggggctaaggaactagctttgaggctgcatttgcatactgggcacacttttggttttgactaagtgctcacttggtgtggccaatgggaactgtcagggggtttccactgcccagtacaatttctgttccatcaatcctgccacgtggtccagtcattctcttgcccctcaactcatgatgtccagactcatgtgcctagttgtgctcatttcacttccttccttttacccagactctgcaaagaccttcccaggctccatgtctcaatgagacccaattaaataccatattgctcacttatgtggcagctgggtacagtatctggctggatgccagggactgcctacaagccttgcatctgtacaggactttgcagtctgcaaagtgcttttgcatccagcatcttatccaactctcacaacagccttacatggtagctaggagagtaagggtcattgttccatcttaaagatgaggagagacaagaatggtagcaggtacaccaacttcagacacacagacccgcatggaaaccccatctctgatgtctattgctttgggtgagctgggacagttctgagtctcagttttctcatctctaaaatgggcccatagttacctaccttgcaaaattgtgttagatctagaggtaacatatttaaggtgcctagcaaagtacatggaatcgggtataagctaaatggtagcaattttgaagattgatgatgatgatagtggtggtggtggtgatcatagtgactgtactaaccaagatgttagtagtggttttattgtttacctatactttctatcttttctatagttaatcatgactagcatgatttatgaaaaaatggtttaaatatttctcttttttttgagacagagtctaactccatcacccaggctggagtgcaatggcatgaccttggctcactgcaacctccatctcccaggtttgagtgattctcgtgcctcagccatccaagtagctgggattacaggtgtgcgccaccacaccctgctaaatttttttgtattttttctagagacagggtttcaccatgttggccaggctggtctcgaactcctgacctcaagtgatccgcccgctttggcctcccaaagtgttgaacttacatgtgtgagccaccacactctgccagtctttcaagtattcctgataagaactttattcttcttctccagagcaacatgttagttctgcaaaaactccaccaggaagctggcagccctgggcaggtgctgtctgaatgcctggccaaagcctcattccccacgctccatctcactcaccacgtattcaagtccaggtaattgtgcccagcagctaccagttcccatgtaattgtccccaaattgctccgggtggcctttccaggcagaagctctccacaattagtcctttcatcaagatgttgaaagacaagtgattattttggggaattacgtgtcagcaagaagatgcagctttaatagggcactatagggccctcatgttaattacaatctggaagatactatcacatcatttcttcatccacagctcattaggcattccagcctcagctccctgacacgactgtggatttgttacaatgtgcgaaggaaaaaaagtatctcaaatgaggacagtgtaaggattctgtggatgcacccatatgcaggtggtcagcaaacatcttaataagcctaatcttgtcttggattcaaagtaacatgtatacctatgagagcaagcatatccatgcacacaacacacacacacacacacacacacacacacacacgcagcactcttagaacatcttgcgaaaaatatccaaatgcttcctgattacattcttctgcttcactttctttagctttttttaagcaatgaggagttattttttgaaataggaaaccaaaatcttcaattaagtattcagtatttcttgagggcctacatatggccaagtctggtgtgggtaccccaggggataacagagaaaaacacatgtcctcatggagtttataatctcattagggagaaagaatcagtgcccacaaaacaaagcactaaagaaacaacaggcctggcacagtggctcatgcctgtaatcctagcaatttgggaagccaaggctggtggatgacttgaggtcaagagttcgagaccagcctggccaacatggtgaaaccctaactctactaaaaatacaaaaattagccaggcgtgatggcgcacctgtaatcccagctactcgggaggctgacgctcgagaattgcttgaacccaggaggcagagtttgcagtgagccgagatcgtgccactctactccagcctggcaacagagcgaaactgtcttaaaaaagaaaaaaaaaagaaaagaaaagacaaaaagaaaaagaaaagaaagaaagaaatgacagcaggaaaaaaggagggtattgtcatcttttaaatgcctctggcactctgagagaaaggtctgggcataagggatctcaggaaaaagtaaaaaccaaactgggcttagcctggagggatgagtcatgttgtacaggcatgagacaaacatatagaatggtctttcttgagaagaggggatagaaggcagaagacaatgagagagacagagaaagaggcaaaggagagagagaaagagaaaatgagagagggagggggaaagggagggagagaatcagggagggagagaatgagagagggaaaggaagagagggagggagagaatgagagaggaaggcggagggagggagagaatgagagaggaagggggagggagagaatgagagaggaagggggagggagggagagaatgagagaggaaagggggagagagggagggagagaatgagagaggaaggggaagagagggagggaaagaatgagagagggaggggaagagaggaagggggagaatgagagagggagggggagagagaaagagggagagaatgagagaggaagggggagggagggagagaatgagagaggaaagggagagagagggagggagagaatgagagaggaaggggaagacagggagggagagaatgagagaggaaggggaagaaagggagggaaagaatgagagacggaggggaagagaggaagggggagaatgagagagggagggggagagagaaagagggaaagaatgagacaggaaggggaggagagaatgagagaagggagagagaaaggaagagagagaaaagagagacagactaggggagagaaagaaaaagggggaagaaatacgaagagcagtggggacagagggggaacagagagacagagagaatgagggggagacagggagactggcagagacagggagaaagagagtaacagggagacagagaaagagagagacacagggagaaacagaaagagagaggagagagcaatagggagagagagggacagggagagagagacagagggagagacagaaagagagaggggagagggacagggagagacagagaagagaaagagagacttgggggagagaaagaggggcagaaatatgagaggaggagggaggagaggtggggaagggaggacagggagacagaatgagggagggggagaaagagaggtagagagagatggacagaggggagagggaggaagacagtcagggagagagagagaatgagggcatgagagaatgggagagggagggagggacggcacacaaacacgtaaaggagaggagggaaattgccaagcaatggagacccggagagtgatcttgaatagcagacagaaggttggggtgactgaagagagcactatttcacattcttaggcagagtgtaaggtggtaacagaagtgagctaagtatttgtgaaggtcactggggacgctgtgtccagatctttggaaccctgctcttttggaggaacttcatggagctagctgagctcgttgagcctctcaggttgtcaatttctcttagaagtaaaagagcgctgactgcggaagtgagaggcagggggtgtgtgcatgtgcgtgagtgtgtgtgtgtgtgtgtgtatgtgtgcaagtgcgctacatgctgccttgatgagaccatctgataggtccctgccatgccaacctggcactcttgttctttgggcacagatgaaagagctgggataaaaccagctgggattagggagttaatgatgtgcttggccttgggaaagtttgaggggatctggcttcctcaatcttgttacgcaatttataaccccgtcttccaactcggcagcccctccttccatgtcagtattattcttgactaagaattgctcttgcttgctgagggtgtacctatttgtggattgcttgtcacctacagttgaagggaactcagattcctaaagggcagtgtcctcagatttagtccatttttgtccagcctgtaagtatgagctgccatgttcattttccccctaccacccaagccaagtcattttagggtctggccgcaggaggccagtgctgggtcagctttgagccacggcaggaggtttacagggattaaggcaaagcgagggacaccagatttggtttcaaagtgatattcaccaggatattggattgcattttaaggagctactaatggagatgtgggtgagtgggggccagcccctgaagattttccattccgatagtgaaatcgagtcgcccagtgcaggctgtcatatggggctgctgctctactttgcttgtttagaggggagtcaatgacagtggaaggccttgtaccagggccagggatgggaaaagccaccacaggcctctctgtcttcctgaacctgtggaccaccagtgtaggctcaggagtagatagagccaataaggggtgctgggagatcctcctaccagaatttccccattaatgactcctctgcagacagccaggaaggctttgggggtctctgagaaccccttacatagcatcaataatcacagagacacaggagggggaacctgacatggtgtgaggggagaataagagaagggataaggagcaaagagtggacctgtagctgaatacaaagcctaacaggatcagaattcagtctgggctctgggagggggtgaaacactagctaaacgttactgacatcactatttcgccaaggtcagccttcagggacacaagaccttcagtgttgctgactcagaagttaccttttaatgcaaagcctatgcttaatccctctcatctctccttaccaccaggccaaactgtttacccatccctcttggagcctgcggtctccggcctccctgccttccccaggggccattcacagcacctcctccaagtcaccttctaggcactgtggaagaagctttagcctgggggtccccagggctggaattctagctgtgacactggtggtggttggaccttgtgaccctccaccttgctgagagtcaattcatggatgtcattatctctaactcttgagtcctagtgcagattaaaggaaataatgaatgcatgtgagggggccaagcaccaggcttggcaccacagtaggtactaaattatttctctcccttcagaactgaacccctgaggttgaggactgggtgttcttggtctgtgctttgggccatcccgaagtggctggaaaggagtgatgtgttcagggagggctaccaagtagccagtggccaaggccccagggctctgagtcaccctccacagggtcaccaaccaagagatctagcctccgcctctaaaccaaagttgagtgactgttcccagcagttccaagaagcaacagccaaggcctgtggatctggataaagagctgagaaacaccctggccactgtacattctgctcctcccacactgctaccctccccacccccaaccctgccccaccttcccactgtcctactctttgctggcaggggcaaaatcaatcgcatcttcagggggatgaaattctcccattcactctcctcttccccttcagctagcaactaaaaaagtcacattttattatcaagatggaagatcttaagggtggtcagtgaaaagcagcacagcccaacagaaagaaccagaagactacgacatcatcctgctctgcatttattagctgggcaatcttgagccagttgctgaacctctctgaaccgccttttccatatctgtgaaatgacaatgaaaaaggaaatctttgcagggcttttatgaagaagggaaagcaagacagtgtatatgaaacggctttgttaacaggaagtgctgtgaaaatatgaggcggttatcagaaagaacatgcgttgtaggaggtcacctaaggatatctgtgattgtgtcacctcctagaacacatcttgattcctgtgtttgtttcctgtgtgataggcagggccctaagctagagggaagctgcagtgaacaaaaggccacatccctgccctggaagagcttacattctagtcggggaaacagacagtgaatgaatagcatgacatagcatagagttatgggcaggagataagcaggtgaggctcaggaagtgtggggtggccagagtcactattgtaaagagaagggccagggaggaaccttctaaagagggttactggctctcctaagaggcttctcatagcaaactccccctccttccgctgagagggtttgatggcaggcaacagatgacttaggactcctctaatggtctttaggaacaggaaggcaccaccaccattatcatgcaacattgttctggaagtgcaagccaatgcaattagataaggagaaaaataagaggtaaatgtattagaaaggaggaagcaaatttaatatgatttacaaatgatatgattatatatctaaatcaactaaaaaactttagaaacaaaaagataattgactttggtggcttcttcttatataaacaaccaccagttaagagaatatactggaagaaaaagtaccatttataatatgaagaaaaagaaaaacacatccaagaataaatttcacaagaactgtgcaggatctctataaaaaaaaaaaaaaaaaaaaaaaactttaaactgccacttaggaattttaatcacacttgaataaaagacatattcttgaatacaaaatttcagtgttgtagaaattttggttttccttattcaaagcaatccttgttaaagtatcagcataatttcttttggctatacaaacttattctaaagtttatctggaaaagcaaatatatgagaatagctaggaaaaatgatggagaaaaatgaaagtgggcagatggacttcctcatcagatatttaaatgtatttattgtaaatctacaacaaaacaattcggtaaagtgcaatttggcacagacagatttacaagagagagtccagatataaacccaaatgcatattggaattgggtataccataaaggtataattcaaatcagcaataaataaattactcaataaataaaatgggaaaactgcttaaccattggggttgggaaagaactaagctggaaacccatttcacaccttatactaaaacaaaattacagatgaagcaaaaatttaaacgtaaaacgtacaccttaaaagttccagaaagatacacagatgactttaaaaataatcttaggctagagagagtctctgtatgcataacacaaaacccaaaagtcattaaaaatattgaccatgtaaagttgtgtaagtctgtaggtttagaaaaatagcatgtaaaaggtcaaaaaacgaatactaaacatatttagcatataagttaaatagactacttcttgggtattttgtgtactagttaggataggggaactactattatatttaaaaaaaaaaaagacctaaagtgtatgatggttcaagtcaagtggtttcagttaaccacagaaaagggaaccctctcctctaaatcattcaaagaccaggctgacaggtcttaccagctctaaccccgggtgtcatggaggcgagttggtgggaagttcccatgggctaggcttggcagtagcatatgtcatctgtacgcacagtcccttggctagaactcattcacatagccatatctaccctaaacagggctgagaaatgtagtccctcgctagatgcttcttcccagggacaattctacacaccagaatgcagagcacacatttctgatgagcagttagccatctcagccgcatcgttcatgcatgtcacacgtagaaaggcagagggcaaatattgctaaattaaaaagagttccagaaatctattcaaaaagacaagcagagcagaggctatgaactcacagttcatagaacagaaaatgcagatactcattaagcaaatgaaaaatcctaaagtttgtaataattaagcacattaaaataaaagcaacaggaagatgccactttttatttatcagactggtaatgatgaaaacgtttggtaagagttgataagtgtgtgtaccatacacaccttcaaatactgttggtgggagtatacattagtgtaacacttttggagaacgatttggtaatatcaataataattttaaatacatgtatcttttgtttaacccaacaattccacactaataaatgtgtcctatactggttaaagtacactaagtcatatgaataagaaagctcattgatgcattgtatatattagcaaaaaagcaaagtagacagacaaaaactaggaacaatttgtatatctaccagtaagaaacatatgtctatataatggacgtggtacagtctgttaagagaataatgtggatccatttgtcctaacagaaagatctccaaaatacccagaagatgctcacttaatgggtcttcacttaacagacttaccacatcgtgtgatgcttagtccctacagaaaatacaccacgtgatgaacatggcctactctctggcattccaggacccttctcctacaagttgagtagggggcttagcaggagcaattgtgtttgtcgccaggcctggttactcaagttgcatttgttattttttattcataactaaatactacgaaagaactaattgagcatgagtacaaaataagagtcagttctctgaaagctaagggaaatgctttgaaaatactcaacataagtgagtttttaccaaaaaccaaaatgatgttaaaatagatgtgaggtgactgtgaaagacggcaggcaggagtgatctggggaggtttctactctcagatatcttgcaaaatatctttaaattctcattccaacttcgggaaagaaacgtaaaccacaaattgtagattacgcattactcattacaggtatggttttgactgacagtaatatgggactccaattagctgatgcatcctcataaaagaagagccttaatatcacattaaaagttcatccacagatacctatgagcttaaagatggattttgtaggtgcaataatattgttattacgttcatttgtttgaatttttaccttttagagatgcaggctgaaatattagggaatgagtaaaattacatctgagattggcttcaaagtaataatgcaggccaggtgaggtggctcacacctgtaatcccagcactttgagaggccaaggtgggatcacttgaggtcaggagttcaagaccagcctgaccaacatggtgaaaccccatctttactaaaaaaatacaaaattagctgggcgtggtggtgcacacctgtaatccctgctatttgggaggctgaggcaggagaatcgcttgaacctgggaagcggaggttgcagtgagccaagatcacaccactgccctctagcctgggtgacaagagtggaacaccacctcaaaaataaaagtgataacagtgggagggcagatacagatgaaacaaacttggctgtgatttggtaatttttgaagctgaatgatgggcccatgagggtttattatactattctgcctaatttttgtatatgtttaatattttccataataaaaagtagaaaaaaagtcagaataatatgtgtttatatatcataaattagaataaaatgtttaaagtatgcatatataatttttataactactctcttaacctgctctttaaaattaaccagcagtgacagcatcagataaaagggttttggctatatcatttttttaagggtatagatacagtatgattgtattatacttaaatatgctggtagatgtatctgtagtgatgtcagttttaccccaacacaaggaaacatcacagcacttttctaaaatcaaatttaatttactccaagtccccatcccaccagtgataaaagtgttcatctcaagcattccagagtttcttctcactccatctagtgggcattcactaagggaaattatcattgctctcttcctcttcctcctcctcctcctcctcttcctggtcaagatagtaacaaaacaacaaaactctaccatagaaacagaccccattcctttatcctggtgccagaagtcaccactgcccctccacaactcaagctcccaaataactgcctccctgctcccttctctctgtccccagccttcacgccaggcacatacagggatgtaactgacctccgtgaggctgacaaaggcaggtcagggcattctgtccaggcacttctcaagcatctccatggacctcaatctccctgtacaagagtccagccctgccctgccacagagagaagcggaggacagcccaccttcttctgaaaaaagatacagcaactgaacctgcctttacatccatcctggctggatggtacatcttctctaacaccctgctgatatagtttggctctgtgtccccacccaaatctcatgtcgaattgtaatccctacatgttgcaggagggacctggagggaggtgactggatcataagattggatttccaccatgctgttctcatgatagtgagtgagttctcacaagatctggttgtttaaaagtgtgtagcacatcccccttcactctctctcttctactgccatgtgaatacatgcttgcttcccctttgcccttctgctatgattgtatgtttcctgaggcctccccagccatgcctcctgtacagcctgtggaactgtgagtcaactaaaccacttttctttttaaattacccagtctcagatagttctttatagcagtgtgagaatgaactaatacacctgcctcatcccaagtttgcccttctccagaaaaggtggctaactcagaaagctcttgtcactttgaagtaagtgaagctcttccatttctggagtcttgagggccctcccttctgaaagcttgtctgtccctaagcatctctcctaattacctttttttagtcaaattttggtggggttttttttttttatcattgatagtttagagaagttcctttcagcttcacaatttattatcagtattatcatccacaccttcagaatgtcagaagcatctgaaccagagtgactccatctagaataggggctgtgaaaatgaggctgagacctgctgggttgcaatccccagagattaggcattcttagccacagaatgacataggaggtcagcacaagatagttcataaacactctgctaacaaaacaggatacggtaaagaagtcacccaaaaccatctccaagatgattaggaaaatgacctctggttgtccttactgctcgttatacactaattataatgcattagcatgccaaaagacactcccaccagcgccatgacagtttacaaatgccttggcaacatcgggaagttagcctatatgatctaaaaaaggaccctcagttccatgaattgcctgcccctttcctggaaaactcatgaataatccaccccttgtttagcatatgaccatgaaataaccacaaaaatagccaaccagcagcccttggggctgctctgccaatggagtagccactcttttgtttctttacttactcaataaatttgctttcattttactctatggactcgccccaagttctttcttgtgcgatatccaagaaccctcttttggagtctggatcaagacccctttccagcaacaagaattgttagcaaactggggaaaacttttattcagattctttcatatatcagcagaaaaatgtcaagacatttcaatttttcttaagtgtaccattcagtggtttttattatattccctaattatctttgaaatgcatttctttgaggctttgggctatgatttctaagactcttcaattaaattgctaattccctgggagaagaagatgcaaggccatcatctttcttggaagtagactttggtttggggagtaggggcagaaagggaactcccatgtgctgaatgtctgctgtgtgccatgctaaggagaccctttcatcacatttcaattaactatagaccggggcactctcctcctctaaatcattcaaagaccaggctgacagagaccttatcagctttaaccctgggtgtcatggaggtgagttggtgggaggttcccatgggtggtttacagtgctgggaggtagctctcacttatccacctggtttggagtatgagaggaagctacttagttgcatgtggtgtggctgtacaggtcaggtgctccctttcacgggaggctttccagggccaccagcttgtgctgtggctgtgtgccccaggaccatggacagcccatgattcaggcagtgggagctttgctagccactgctacgcagagcactagacagctgaggtcatgtctggggttcctggacccacttatatattttttaaaaatctatttagaaagtttccaggccaggcatggtggctcacacctgtaatcctagtactttgggaggccgaggtgggcagatcacttgatgtcaggagatcgagaccatcgtggccaacacggtgaaaccccatctctactaaaaatacaaaaaaaattagccgtgcctggtggcaggtgcctgtaatcccagctacttgggaggctgaggcaggagaattgcttgaaccctggaggtggaggttgcagtgagctgagatcacgccactgcactgtagcctgggtgacagagcaagactgtctaaaaaaaaaaagaaagaaagaaaaagaaagttccccttatttgctttgtttatttgcaggacttggctagaagtaggtccccaaaaatatcatagctgttactattactgctgctgttattcccccttttccactcttctttcccctcctctcatgaaagcccttctaaccgcaaaggtgaactggctcctctctgccttcccactattcatttaggctgcgaatcagcagatgttcctggagatcaagggtggggacagggactttgaacatggatgccagcaggagaggcatcccgccgacctccaccgcctggggccaccacctggtgccatggaaagaaccatgcttttaaagcgcacagcggtggcctggcctggttctctggttctcctatttattgtctacaaatgctagcttagccgagtcacttctccttgctagatttcagtttctccttcctggaaaagaagaagattggactagataggatctacttttcagccttttcattcagcaggtattttgagagggcctgttgtgtgcatggccccggtctaagcagtaggttgggtagagccgtgagtgaggcacaccaagtcttaccagctttctgattagcagaacattctagcagcctaggttcttggatttctgagggtccttggtgcatttctccagctcctgaggcctcgctcctggtttctgcttgggggtacttccagcttctgagccaaagatactgagaccagccttgggtggtctgccctttgcaaagaaattcacagctcaccagggtcagggggtaaatgtgaccaaaccccagtcactcactgcctacctccctctctgccccacaatggggatgctgacggggctgggcacaatgtagtgaattcttataatttatgctgcctcaggatccattttggtttttgttgttggttttgtttttgtttgtttgtttgtttgttgagatggagtctcgctctgtcacccaggctagagtgcagtggtgcaatcttggctcactgcaacctccatttcctgggttcaagtgattctcctgcctcagcctcccgagtagctgggattacaggtgcccgtcaccatgcctggctaatttttgtatttttagtagacacagggtttcaccatgttgcccaggctggtctcgaactcctgacctcaagtgacccaccctcggcatccattttaaatataagcttacttttctcacaccagaagcagggctcagttatccttgacacagtctctcctgctacacctccccgccgtccttcaatgtcatacacagctgctccctggtgctcacctccccacgggacagctagagacaacctattcagcccgctaactttcaccccctacacagactgcagatatgccacagtgaccccctctcagtcacagcatgacctcctggaactcatgcctgcttgctcttttgcatttaaacccaccaattaaaattccctatgggaaatgtgcatggataatgccctgggcttcaataaaagccctgatgcatagggggccccccactttctctttctttgtgcaccccctgatcattccctctctgttgtggaggaggggctctaggcatgccgtgaacttcccaagacctgtaagtaataaaacctttatttctatcttgtgtctctcctaatcgttgaaggggcaacctctattataaagacctgaaattaaaacacatgggaagcagtggctctgagcttggggagccaggttcctgactgtcaagcccttgccacagccaagaggttgctcaggggctgccaggggtgggtgcagattcccacacagttacctaggagaaaggcatcaagagggatagaaggaatgtactccgggaaggccagcttcaagggcatgaggtcatgagccacccagactgaggacagccctatggggacagacagatgacagagtgggtcctgaaaaactgttcttgtatccactgtaatgggctggctagcttgtggccaacccaaatttctcaggcatgcaccaagaagaatggacccaatgaataaaagctgtggcagccagatctcagagcacaaaatccaactcatgccaaattcatatccgctgtacatttagaaggaccatagcatcgcagtcaagatcataagcattgcggccgcttgcctgggttcagattctggctttaccacctgctagctgtgtgattctggacaagttacttaacctctctgtgcctcagttttctcatctacaaaacagagataataataataactcccacctaatagggttgacagaagagagacagaccctctcatattgtcttatattgttttatactcagtacctgttttaagaaaaaacaacaaggaagtaaaaccaaagacaggcagcccggcgccaggcccgaaacctggcttgggcctgcctggcctaaagccagtagttaaaaatcaactcataacttagaaaccgatgttattcatagattccagacattgtatagaagaacattatgaaactccctgccctgttctgtttctgtctgaccacctgtgcatgcagcccctgtcacataccgcctgcttactcaaatcaatcacgaccctttcatgtgaaatctttagtgttgtgagcccttaaaagggacagaaattgtgcattcagggagctcggattttgaggcagtagcttgccgatgctcccagctgaataaagcccttccttctacaactcagtgtctgagaggttttgtctgtggctcgtcctgctccagggttatggtgagaatcaaattgctattatattgtattagaacagtgaacagcacatagtcaacgccaccacataagtggtgttgctacttctttgtgacaatcaccccttattttatgtagcatataaagcttacaaattccctccaaattcattgtttgaaacacaaacttgttgactttgttcattcatccactagattgtaagtgttatgcaggtagggaaatgttagttgttttattcactactgtgtccttgaagcccatgacagtgcctgacacaaagtagttgctcaataaatatttgttgattagatggatagatagatgggtggatgaattcaacaaacatttatagaagcctattatatgccaggcactgaggattcaaaggttaaaaaccgtggtacttgccctttgaaaaagacttgaattgactcataattcacttctataatgatgaaatgcattactctggaattatcagccatgagagtggtggtactcagtgctgattttgcccccataacctgaggaactagacacaactcaagcagggatagtggccctacatcagggagccttcccccaaaaggctggagggagggaatggtaggcacgtgccctgaaaatcactgtcttgttggctctgttggcgatatgaatgtctatcatctatctggtactatgatggttttttgtttttttttttttgaggcagagtctcgctctcgcccaggctggagtgcagtggcgtgatcttggctcactgcaagctccgcctcctgggttcacgccattctcctgcctcaccctcccaagtagctgggactacaggcgcccgctactatgcccagctaattattttgtatttttagtagagacggggtttcaccatgttagccaggatggtcttgatctcctgacctcgtgatctgcccgcctcggcctcccaaagtgctgggattacaggcgtgagccaccacgcccagccctatgatggattttgttttgttttttactattgtgtcttaaatgaactggttccacatttccatgtcatcctctctgccctcatcttttaaagtctatttaaaaaacagacttcccaaaaagctgtggcctgagctttttgtatcatctataacacactgtcccatactgtcattatgtccaatagagttttcatacagtgaatctgaacaaatccctctctccctagacacagtaggagggaatggtagaagattccctttccccacatcattgctcctcttgttttttggcattgtgggtaaagcagggacttgggaattgaggcttgagtttaaattccaggtgtgcattaagtaaataaaaatcaaaactacaaggagataccacttcacagtctctaggatgactgaaacaaaaagacagacgatgagtgttcgcaaggatgtagagaagctggaaccctcagacattgtttgtgggaatgtacaatgctacagctgcatggaaaccaatctgacagtttctcaaaaagttaaacatgaagttaccgtaggacccaggtatataccactcctaggtatatacccaagagaaatgagaacatgtacttccacacagaaatctatacacaaatgttcatagcagtgttattcataatagccaaaaagtggaaacaatccaaatgtcaatcaactgaggaatggataattaaaacttggtatatccatacgacagaagataatcattcatccctaaaaaggaatgaagttctgatacatggattgaccttgaaaatattatgctaagtgaaagaagccagacacaaaaggccacatgtgattccatttctatgagatgcccagaataggccaattcacagagacagaaaggagatagtggtttccagaaggaaagccatccccaaaatgcatctggtttaaacatggtcatcttattaagttcttaccatagcctggaaaaaaaaatacaattctatttaaaactcaccagggattgcctggttaaaggattcattatagaaactcttcctgtgttaagagcataattacctactaatttaccttccactcctccggcctaattttcccatcatgaacttgtttcaagccagctgttgctgtattctgacataggtgctgtgcttagtatgagtgggcatcatgctgctgaccgcctgctggtgaaaacgtttcaaagcattctgccaagttttaaacaaagcctcaaatgaaacctgcctctctgactgtatcactctcagtgataaattggcttcccccacccccccccaccttcttttgaaggtgtccctgaacgaaatcaaataataacaggctccatctcaaaagcccaagtaaggaggcagacaataatctttcatcagaatcctatttttcaaaccaacatttagcctgcataaagctctcaatggggcaagacccggaagcagggtgatggggagaagagcaaggcccagaggacagtttggaggcagaagctcaatagtggagtgtactcctcctgccaggccgacaggtgcttcccgtggaaggagctgatgccagcatgaaccccttcccttccctggatgatggctggtgaaaggcaacgcctgacaaatcctccaggaatagaagaatcctgtaggggccaatggattgaatggaaggaatgctacagcaccaaggagcctagcaattgttctccaaccagaaaacttgttttacaaattggggaacagcatttgtggtgaggaaagggagagtcttccccccaggccacaggagatggcagggaaagaaacaatcaagagctaagccacctgtggggatttgtagtggggcccacaagggccattagcgggaaacacagtgcgaggctgtttacctctcagttcatccccaagccttctgattgtcttaaagaaaaagccttatttggaggtggtctctctttaggattgaacatttgctatctcaattttgacatggaccacgacaccggcagtagttccaagctaggatgaacactggttgagtttgctgtggtgggtgtagtgattgttaagggttatcctctatttatgattcatgattattctttctttcccttatgatattgatttcaagttttccttaatcatatagctatttgtgtccaaaacgtggtcacagataggtcaaaaatctgaaagaggagtgagaaacactaatctagtcgaaacctatactaatggtgtgaatcgccaatccattcctcttttgaaacacacacacacacacacacacacacacacacgcacgcacgctctcaaggggcctttacccagtgaaccaaaaaggtttccctttccacatgtgttccatgaggagattccctgcctatcactttcttgccttgccaaggtgcattttcatggatccctgtgttctccctgctgccagaagtgtccctggtcccctcccatactgagcctgcttcctccccatcagcttcaggaacgctgctccctcctgcaactctgggggtcagctcccagttgcatccttcctgagtcccatcctcccagctgcagtgtcctcagccgcccactctcccgcttcctgggatccaggtcacaaggccctttgctttcatctgggtttagctgcctatcagtacacactgaagtgatcacaaccagcaggcattgggaagtaatagttcccaagctgagcagacaagtcccctcctgctgggcactggagtcatcccccaccctttgatggctcaggaagactccagcactgcactgcgacacttatccctctctgctccttcctcccacctcactccagtggggcccctttcttcacccaggaaaagtcagttcaggtccttccccaccagctcaaaagtccctagaatcgcagttcctttcctcctggttggctctcagcacacaggtgccttctctggccacccccagggatggtaggactgggaggggctggcctgggggcagctgggagcacttaggattttccaagctttggtgtagcatctctgcaaacaggtgggttgggcttttccttctagaaacttttttcatctccactgaagcataaaggtaaagtgtgattctttacccctttccagaattttaagccaaaagctcagagctcccactttgcagcttacatttgattcaaatcatgcaatccccactccaggatcaggaccaccagtcaccaagcagcctgggtggatatggccttagactgtatcctcagggccaactccagctcggaggacagtccttagaaggtggcagcctctctctcctgccccctgccatccacctggctaccctgcaaacagtggctgaaagcctgcattgagaatgccagtcatacactcctagaaagggacacagtggggactatggcctgaatatctgtgtctctctaaaattcccatgttgaaacctaatcaccaaggtgttggaattagtattcgaacatagggctttggagaggtgactaggtcctgagggcttctccttcatgaatgggattaattaccttatagaagaggttcgaggttgttcacccctttgccttttgcccttttgccttgtgcagacacagcaagggggaagcagggggcagcccttgccagacacctaatctgctggggccctggtctttataaattacccagtctcagacattttgttattttgttatagcagcaggaacacactaagacagagagaaatatgtccagccctttcccaatgggtcagatctaaacagaggaaagtggaatagtgtagaggaaagtggctccccaaaggcaggccatcttcaagccccaaagactggctgaagcctaggttgccttttagatgtaggaacacccagtgaactgaggagagaggctggaaattgttagtcccaagactctctggtgaaaaatggtgcaagctttcaggggacccttagaaatgccaatcaaagtctttcacatacacagaaagctaatttatggctaaaagaatgatcaaaacagcagtttcctctggaaatgggggtagagactgaattagaatgggacatgaaagaactttccagggtgatggcaagattctgtaccttgattttgtgtgttgcattgtaagttttatctcaaaagaaaaaaaactgtaaacaaatattaaattatagagcagtgcagtctaatagaatgttctgcagcaatgaaaatgttctacgtctgttttgtccaaaggctagccactagccacctgtggccatggagcactggaaatctggcaactgaattcagtgctatttcacacagactctcaccctatggcttgggcagggccatggtgatttctcataaatacaaaggggcattcttgggcacacagtggttaagggactcaaccaaagtcacacacagcagcaagatggccaaagctggaagtctctgaacctcccacttctcaggagtgagcttgttcccctcacctcccagggagagaccccttagaactgaagtaaagagagctcactgaagggtagaaaagcctgagagcctcggcagatgctagaaatcccgaactctcggctcagagagggcacacttcccttcctgaaagaggacagctttggtctaacaatgatactctagtccgtttttacactttatattttagaaagctctttcacacgcccacagtctctcacttcatcctcacagcctggaagagatcctcccttcctcccttcccacctccctccctccctcctttcttccaagtggtgggcaacaagtaacgactaagggtaaaacgtttaggctttggagttggacttccagggcttgatttcgagttcccaagcagatgactttataaaatggtgcattttaacctttctgtgtctctgtcaacttgcaaaataggaataataatagtatttgccttgctgggatggcaagagaattaaataaaataatccataccaaaccccctatcatcatcatcatcatcatcatcatcatcatcaacttatttattgagctatgtacatgtcaaagttggagcaggagctgaggcgaggggcaagttcagaagcccacaggaggcagagtcctgatgaactgaactgagctggggtggctgagacttcacactaagggagggcgggttgccaacacgctctcccctcagccagagcaagcacctcagctccaaattgtttgctctcaaagagggattgccttttgctcacaaatctctcacctgcaaaaggtctgcttcctgagccaactaggagataaatcactaggatcatcatcatctttcatgttccatctccctttgcccagcaagccccacaatggcctcttctatttagaggctgcagccgaagacagaaggaagatgcacaggatcaaattaatgttgggaaaaaggacttctggcctcctatcttctactagcctattaggttgagagatggaaaaaccaaaactgtgtgtgtgtgtgtgtgtgtgtgtgtgtgtgtgtgagagagagagagagagagagcatttacatttgcagaacattatacttacaagctaagttgatccttataaatgcctagaagggcagatattttttcttcctactttttgagataaagaattgagtcagagaggggtaaacaaactacccaggagcagctgtattaaaactcgttgtgagttagcatcatcccatcaattattagatgtctgaaatgttgcttggaaagaaagcaccacctttgatcaggaaggtcattgctgaagtcacagccaggcatctgtccaacagggtcccactggcctctttttctttggtcccatcctcaggcattgccgatctgccatcccttctagaacaacctcccccaattgatgcatggcatattaaatgctggcgggcagaccattaggtagaacccactgtgctgagcctgaggcgggatggcagcaggctagggagggcagcaggctggggagggcaggagcggggagaattcagagccacacaaaatgcagaggctggcttcatgaaggtaggagacatctgtgagctcagaaaccaaggctccagtctcagccagcattcaagtccacagctgggaagaacaatgtgttcatactttggctgtcaaggatagagctttgtaagtttaactgagactttgtgtcttaattatgataatagctatgatcatggagctcatcttgtttgccaggccctgtgctaaatgccttatctagcttagattctgttgagccccatttccattgatagatcccctgtgaaatagacaccactctcagcaccatcttgcacatgaggaagctgaagtgtgccagaaggctacccagctcctggtatagaggtgtagccagaatttgaacctaagcagtttccagagcctcatgctgaactgtctgtgtaagtctcgcaccacaaaagacccttttctgagcctgggtacatctaacatatatgtggaagtttagatgcattttctgaggcactgcataacaagtggaacatctcatttaaaacccgtatgattcattttagccatggagatgcaaataaagcttctctttattcagtttactaagcccctgctcacctctaactgaagactccgaagacttcggtcacatttctgtccataacattgatgtaaatcaaataaaccaaattcttgtctatctgaacttatagaaatcacaggctgacttctgagtcttgaacttcactgtttcattttatggcacttcagaggctggacatcacaccatagtggggacatatttcctaaggtagaggccactgggcttgaaaaaagggctctgtccttttagcagccatgtgtcagagggtaggagcttcacctcctgcagcccagtcccctggtcctgcctgcccagagcagcatcaccctcagtgtgccaggcacctgtcctgccttatctaatttgacccacacaacaaccatttaagttaggtactaattacaacttgcattttacagatgaggatgcagaggctgtgtattagtccattctcacgctactataaagaactgcctgaaactgggtaaattgaaaagattcacagttctgcagggctggagaagtctcaggaaacttaaaatcatggcagaaggagaagcaaacacatccttcttcacatggcagcaggagggagaagaatgagagcagagttaagggggaggccccttataaaaccatcagatctcgtgagaacttactcactatcatgggaatagcatgggggaaaatgcccctatgattcaattacctgccacacacatgggagataattgaatggtccttcccaggacatgtggggattatggggactacaattcaagatgagatttgggtagggacacagccaaaccatatcaggcccaaagggaaaaatgttttgtctggggttggatggctaatcagtgatttggccatgttcattctatacaagctctgtccttgaactaccaacatgcctgtggatattctacaaatggaggagctctgcagaaggtaagggcctatcagaagcatgtaagcacgtccaagctccaagcactcgagctcactgagctgcctgggttcctgcctaatcctgttctctccgtctattggtctgtctaataagtatagaagaaataagagctggttcaatagatcaggagggtgactacattttacaataatttattgtgcacttcaaaatagctagaagtgaataatttgaatgtttctagcataaagaaaagacaaatatttaaggcaatggatatcccatatacacagatttggtctttaaaaattatatgaatgggctgggcgtggtggctcacgcctgtaatcccagcactttgggaggctgaggcaggcggatcacgaggtcaggagatagacaccatcctggctaatacagtgaaaccccgtctctactaaaaatacaaaaaattagccgggcgtggtggcaggcacctgttgtcccagctattcgggaggctgaggcaggagaatggcgtgaacctggcaggcagagcttgcagtgagccgagatcgcgccactgcactccagcctgggcaacagagcaagactccgtctcaaaaaaaaaaaaaaactatattaatatattaaattaccatatgtaccccctccaaaaaagtaaaattttaaaaatgaatttaaaaataattttttaaagaaatatagaaggatccatctcctctggctttaacagctcacttctgcctgatggtggtggtgtctggaaacacatactttcccaattcatcagccagctgcatgcagccctcaacacagggcaaggatttgatgagtgttcattcaggaacttatcaatgttccactcctgtggaggtgaggtcctgcagctggcaatgcatagaggctcggatcattggcggctgtccaggcacccaggcagaatgtttcacatccccagcccacgctggcagatccatgcaactgcccagaatgaagtgagtcctgaaccacaacagacaggcccattgttgagctaccatggatggagctcattgaggacttgcctcttccaggactgtgagagagctcctcctccacaaccctcagcccatctcagcttctgttaaccaccttcaccccccaatacccttataagtgcacttacatggcactaggccctatcctaaatgcttgacatgtgttaatccattaatcctaatgacccttacctgccatgctaggtttactggaaaaagctctggtttatattgtatcagattatatcacatcacattgttcaaattggtaatacaattgcatggtgaaaaatacaagagggataaaagaatataagtcagtccatatccaggtgggccattcttccatggctttaaatggagaaccaaaggggcttctcctttcttccttcagtccagccagctctgcactgactttctgccagactgtcagcccttggggcaggacagtggagcctgggctaaactgatatttcccaaagttggatcttttgaggacctctgtctcaatttttatgcatccacatagtacctttactttttattctttacttaagaattagcttcaggctgggtgcagtggctcatgcctgtaatcccaacactttgggaggccaaggcaggaggatcgcttgagaccaggagtttgagaccaacctgggtaacacagcaaggctctgtctctaaaaaaatttaaataaaaaaaatagctgggcatagtggctcatacttgtaatcccagctacttgggaggctgaggtgggaggatcacttgatcccaggagttcgaggccagcctcagcaacatctctactaaaaaagaaagaaatgattcacaacacggcttagtacttggtaagtgttagctactacttacggcatatcccttgccataagtaggagataactgaaaaaaaaaacacaatgaaaaccaaactattaattaaaaaattaactaaagactacctgcccaaagacaagttttctccttgtcaaaattcgagatgaaccaaagttagagaagtcatcagcagtggtgaggagaattgaaaggggaacagcaatcttgcctcatgatacactcttattcactgcccttcctgccttccatctagatccacctttcatggcatttgtgccccttggtccacactctggggaatgctgggccaagcagtagtttcatgggagatggaggaagaaccgtctctccagggagaaggctgttgattccacaagaggcttttacaaactagctgtcccaactccttccccacctacctctccctggttttgctgtgtctatcttccctgtgtgggaattatagtgtctaatgaaagctgttatttatggaagagtgttctcacatgaagagtctagaggcaaaaagggcttgagaccagtgtatgaagaggaactttggcccatagggattgagatggcatcttaagggttccttttaagcctggaaactggactttgaaaaaaaaaaagtgggaggtggggggttccttgcacattctgcagtatttcagaaagatttcatgttcactttcttattaagttcttgatcaacccagtgaaaaatttgggcagatgatgatgaaaccaaaacccaagatgtcacagctcccaaagtttgagctgaggcaagaatccaggtttcaccaccttctgctctttgttccaaactaagaagtcccctcttgaacacttgttcagtggtaaaggccatcagagtataccataaaacaccttgagaattgcttttatgcaataaatatttgaatgaatgaatgtattcattcagttggtgatgatcaaagtgatgatcaataagtagcttatcattgcatttttattacatgccaagtaatggttgctaaggaacttacatacattatctcattaaacctacacaacaatcctataacataaagattatagtttatcatttaggaatcatgttcagctgatggtgtatgaagtagactccagtggcttcaaacaatagttttattagggtatgtgtgtccttgggtctgtgagcactttccaaaataattcaggtaaaatggatctaagagaatccatttccagaactaaacttccacatttactctttcccaatgtctcctttcctatggctcctttaataattttccttctcctagtttacaaaagaaaagtgtatctctcgcctgtcttgaatcatagtatggtgcattgctcatggatgtcaaacaaaggaaccattcaaaatcttggtgtcacaaagcctcccttaatcaaggtaccataaatcaatgctctcattgctacccaatagctcattatttttcccttaaacacatttcagttaagggtgaaacatgctgttagaaatggggtattttggactatactgggatgttttgaattcagacatattgtagagtgatgtttaggagtgatgacaatttttatttaatgatatctcacctcttccaaactctaagtattgtcaaagaatacattgcttctgaaggaaagctcaatgagtaaagggggaaaaaaacctgtcagtgaaaaatattgaatgaagcagcatcttatttcatttggtgacacattcatggcaccttatcttttttacttagaattaaaattcagaagtgaggtttgcatgggattttatattaatatatctacttgagataataataactgattacatgtatatataaatatggagaaatttattgagttatacacttaggatttttgtattttatttatataaattagacttcaattttagaatataaattaaatctgatgctaatggcaaattgagaatatttaaccaatctcttaaggatggcttaattgaaatagaaaatggggacgtagtatttttaaaatcccctttaagccataggagaactactaaaacagtaagaaacaaaaaacaggtaaacaaaaaagctggccaagatctaggacaagacagaaattcagagatgcaactggtgccatagaggtcggtctgcttttctcctggggacgtttgataattctgcctggaaaagccaactataagaatgagaggcgaagaggctgaagagtgcttctttgttgtttgtttgtttggttttttttttttttttgagacagagtctcactctgtcacccaggctggagtacagtggcgcaatctcggctcactgcaacctccgcctcctgggttcaagcaattctcctgcctcagcctcccaagtagctgggattacaggcgcacgccaccatgactggctaattttttttatatttttagtagagacggggtttcaccatgttggccagactggtcttgaactcctgacctcgtgatccgtccgcctcagcctcccaaagtgctgggattacaggcgtgagctaccgtgcccgacctgaagagtgcttctattacttcacaagacaaaagggacacaagttggataccaaggcccaccatagcagtggtacctaggagtaaaagagaaacaaaatagtccctgaagcaacataaaactttttctttgagacagtctcacgctatcacccaggcacaagggcagtggcacgatcgtggctcactgcaacctctgacagtcagattcgagtgactctcgtgcctcagcctcccgagaagctgggactacaggtgcatgccatcacacccagctaatttttgtattattagtagaaagagggtttcaccatgtgggccaggctggtcttgaactcctggcctcaaatgatcccgccgtcttggcctcccaaagtgctgggattacaggcgtgagctaccgtacccagtctaaaccagctttaactaatttcagtctttacatctggaataaggtgatgcaggatagctggtgcccccaaacatctggcagaagcaaaaacaaatcctctctagaaaaagaaaacatcctcctagattaaacattatcttttaaaaaacaacttttcaaatacaattcaagcacacaataaaagataaccagccacataagacaagacaatatgaaagaaaagaagcagaaacaggccaagcccagtggcttagcctgtaatcccagcaacttgggaggccaaggcggacagatcacctgaggtcaggagttcgagaccagcctgggcaacatggtgaaagcccatgtctactaaaaatacaaaaattagccagatgtggtggtgggcacctgtaatcccagctactcaggaggctgaggcaggagaatagcttgcacccaggagacggaaggagcagtaagctgagattgtgccactgcacttcagcctgggtgacagagcaagactctgtctcaacaacaacaacaacaacaacaacaacaacaacaaaagcagcagcagaaacaataaacactagaaacagacccacaggggctccaaatactggcattatcatatatagactttaaaacaactatactgtggaaggagaattgtgccaccatgaccaaatacaatgtgtagaccctgtctggagcccgggttgaaaaaaaattaaattgttaaagagttgtaaagctaatctgggaatactgaaaattgaaggtgaacaaggtagtaggtgacattaaggaatcagtattaatatcacttagtgtgattttgtggttatatatatatatatatatataaatgtatatatgtatatacgttttgtgtggggggggggggtgttttttttgtttgtttgtttttttgttttttgagatggaatcttgctctgtcacccaggctggagtgcagtagggcaatctcggctcaccgcaacctccacctcttgagttcaagtgattctcctgtctcagcctcccaagtagctgggattacaggcacatgccaccaaacaagctcatttttgtatttttagtagagatggggttttaccatgttggccaggctggtcttgaactcctgacctcaaacaatccacccacctcagcctcccaaagttctgggattacaggcatgagccactgtacccaaccagttatatattttttaaagttcatattggttaaagaaatacgctaacatcttgggtttgctttttttaattatatatatttttagatgggggtctatgttgcccggggtggactcaaactccgggactcaagtgatcttcccatctcagcctcccaagtagctagaactacaagcacacaccagcatgcctggctctttgaatttgctttaaactacaattcaaatttaaagctttagattgctttaaagtaaagaaggaagcggaagtgaaagaggaagaagaaaaggaagaagaggaagatgatgaaggaggagaaggaggggagcagaagcagcagcaatgggggagggagtaaggaatacattttgtaaaggaattaaagaatattgatcgttattgaagcagagtgaatacacagaaattcattatactattttttccgcctgtgcatatttaatacacagatccatacacaaattgttcataatttaaaagttttaaaaattctgtgcttcctgtgtatatgcagataaaaggaaaaaaaaaacaatgtcagcaaaatccagaaactatacaaaaagacacaccagatttgggggaaaaaaatgggaattctagaattgaaaaacacagcaagtaaaaattgcttaaaattgtgttcattgagattctagaagataatatgagaaactaccttcatagccccagtgtagggaaaaatttcctcatcaggacacaagaagaactaccaatgaggaaaagcttgttactcagaccccattaaaaaaagaagttcttgttcatcaaaaacaaccatttaaaagtaaaaagacaaatcacagagtgggagaaaacattgtaatacatgtaagtattaatgggatcatatccaaaatataaaaaagaactcctacaaaacagcaagaaataaagattgcaacagataaatggcaaagtcttaacaggcaactcacaggaagaactaagtctcattcattatcagagaaatgcaaattaaaaccatggtgagctacctccatgtgccctccagaagctacataaaatgcaaaggtatatgcaggagttacaaagaaggtacaaatgtgtggtctttgagctgatgaacctaagtgtgggtgaggacgtgaagcaacaagcagtctcctatgagtaggagtgcaatttgggtacaaccactttgaaaaacattggcactatatactgtaattgaagacagacatgttctagaattcagcaattctacttctaggtagaacagaaatgcatattcatagcaacatgattcattgtagtaccaaactggaaataacctaaatgcccattaacagcagaatgggtaaatttattgtactaattttatacaatggacaactgtagcaaaatgaaaatgaacacatgtaagtatatgtatgaatttctcaaacacaatgttgcaacacaaaaggaaacatacagtaagatttccatttataaaaaattcaaaattaagcaaaaactaactgtattgtttagggataagtacatgcatggtaaaattataaagaagaaaagcacgcttaccataaagtcaggatagtggtatcctctagcaggaagggagggaagtgtgagtgggaaaggagaggagctgcgctttctaggatgccagaaaagagtgatagttacatgcaatgagaacacatggacacaggaagaggaacatcacactctggggactgttgtggggtcggaggaggcgggagggatagcattaggagatatacctaatgctaaatgacgagttaatgggtgcagcacaccaacatggcatatgtatacatatgtaacaaacctgcacgttgtgcacatgtaccctaaaacttaaagtataatattaataaaataataataataaaaaagagtgatagttacatggatgttggcttttgattatttgttgacttgtaaaagtttgcttagtgcaattttctgaatgtgtgtcatatttcaaaataaataatcttgactcattggtttggcaataagaactagctttaccatctaggatatttggtggacattttccaatgtttggatgaaaatatgtttaaagctggcactcagacaaaagcattccatcaaaaatattatgctgataaaggtaaattgaaatttatgtttggatatctcccaacacgttttgtgaatagcagtttaaacaagtgcccctgtgtaaaggaatgagaaggtaattaatagtcatttgataggttttggtgcatagcctttttgatacaattcccagaaactgagaacgtgaattactctaacgattgggttgcaaatcctatgaagccaatgatttctaattccttgctttcaagaaaattaaaggaaggcttaatcaaactattagctgacagaatattaaaaatggttttgatgatatatcattatgcaattttagcatgcaattcataaaaagttcaaagaatcatgacagtgctataataaaacatattccatttttatttacttatttacatgaacaaggtttctgagtgctaacatctacaaaaacaattaataggaagactagctgaatcctgtttcattctagcagtatgtaatattcaaccatgaatgaacaaaccaattagttgaagaaaaatactccattcatctcattaagaaatgcatttctcaatttatgtttatgtttattatttataaaattttaaaatacttttttctcaattgtatattcattaaaattgtaatgtagcttaatttggacaaaattttaatcctcagagatgtatggtcgcacaaaataagaaaggattttaatgtatgtgttcctgtgtatggaattttattgtagaaacattggcaaatgtaatctataaaagactttcaagcataaaagtatgttaggttgaattcctataagatacacaaaatgaaaataagagttcaagcagaaaaatgaacgatctaaaattaaaccgttaaaggaggttttgttcatggttttgttttttgtgttttttctttgtttgtttttgttttttttgagacagcatcttgctctgtcacccaggctggagtgcagtggcatgatcttggctcactgtaacctctgcctcccgggttcaagcgattctcctgcctcagcctcctgagtacctgggactacaggcgtgcaccaccatgcccagctactttttgtatttttagtagagacgaggtttcaccatgttggccaggatggtctcaatctcttgacctcgtgatccacccgcctcggcctcccaaagtgctgggattacaggcgtgagccactgtgcccggccttattcatgtatttttaagtagatgatagtgaatatcagattattataaaatttatatttctttgaatacactttgttttttgagacagggtctcgctctgtcacctacgctggagtgcagtggtacaatcagggctcactgcagcctcgagctcctgggctcaagcgatcctcccatctcagcctcctgagtagctgggactacaggtgtgagctgccacacccagctaatttttatattttttggtagagacagggttgcccatgttgtccaggctagtctcgaactcctgagctcaagcaatcctcctgcctcggcctcgaaaagtgctgggattacaggcatgaaccactgcgcccagcctcctctgaatgcactttaaagaatgatgtgacagttttagaatgttaacagtttcagtaagtcagaattacattatttgaaactatttaaacttattaagaattttagatttcaactttaaaatgtgcataaggtacatagtttttaaagcctaatggctgaaacagactaatggtttattctctgacataaaagaagttggagatagacaggttatgcttgtgtggcagctccttgaaactatgagaggctcaggatccttcagtccttctattctgccatccttagaaggtggcttctaccctcaaggctacattatggctactggagcttcagccatcatgtcatgtctggggatcccagagaagggacacaatagcttttaccaggactcctactgagccacgtcccactcctatctgtcagggagcctagaaaagaactttttctactgggcatgtggccaagagccctgttaccacaggagaagatgagaatatacacttggcaggcaattcgcagtcttagtcatgtagaatatgactccatttttattaagttgtacacttacatgtgattttatgcagtgttacatttggaaggatgtttaccaatgtatttgtggtttatcatcggataggagatctcagtttacttttacttacttctctgaacttttctacattgaattttttgatagacatggtcatcctttttttctttacctttaaacaacatgggtttgaacatggtcattcttacaaaaacattacagatatgctcatattttaaaaagaggtaaactgggaaaaagaaaaattagagactttgcagtcaacaacctgagtttaaattccactctgcaatataatttaggcatataacttaatctctatggacctcaatttccactgtataactaggttatagcctccaacagtattagaagtagaggtcatattttcttcttttgttttatatatcaaaatttagaagtcccatttactgggagtgtcttcagagagcacaacagatatatgtcccaattcgggcccatgagatacaagggtaggtttggtggatgcttcggggaaactgctcctccttctcaagagtctctcttaccggggttgttgtgagaacctatgaatcctgaagccaccacagctcaagcctcaggatgaagccagcaccaggagaaggacagagctgagagacacacagagaaaccatagtgtcaatgtgtccagtctggacttttcacttataggacccaataaatctcctttattatttaagccagtgctatggtttgaatgtttgtctcccccaaaatgcatgttgaaatttaattgtaacagtattaagaggggaggcctttgagaggtgattaggctgtgagggctctgccctcatgggtggaattaatgtccttatgacagggcatatttggtcccttttgtgtttctgtcttgccctgtctttgtcctcccaccttctgccatgtggtcacacagcaagaaggtcctcgtcagaggccagcaccttgatcttggacttcccagccttcagaactatgagccaataaatttctgttcattataaattatccagtctcaggtattctgttagagcagtgtaaaacagactaagacagccagtcttggttttgttttattttgcctgtttgctgcaagcatcctaatcgctattcagcttaaaattatgtaaaattacttttatttatattatcttatttgatcctgacaaaaaacctctcaaagtggtcaagagttataatagctgaggaaattgagagccaggatgttgaatgctcaacatcacatgatagaaaaatggtgacaaggatgggactcaaacccaagtttccttggtctgagttcagtttccttctcattgggccataatgcctgcaaggataggcaagcagaaggtgttctgatgactgaaaaggagttgtccacactacagatgcaccatggtctgaatgtttgtatcctccccaaatacatatgctgaaactaatccctaatgtggtggtatgcggcaatgaggcctttggtaggtggttaggtcatgagggtggagcccttccaaatgggattagtgcccttataaaagagaccccagaaagacctcttgccccttccactatgtgaggacacagccagaaggtgccatctatgaaccagcaagcaggtcctcaccagacaccagatctgccagtgccttgatcttagacttcccaacctccagaactgtgaggaataaatttatgctgtttataagccactcagtctatggtattttgttacatcagtctaaagccaccctgggatgtagtcaaagctttggggatgacattaaaagggcggtgcccatggcctcccgaaatcataccaggggatcttgggcttatcaggctagtggcactcaaaaccaagcacccaacagttggatttttatggggattccacctgctaagtggaatccctggagggagacacctggaggaaactaatgagctgttttcagagtgcatagaccaaggagactgggagtgagtctggtgagaacccattgaatatgggcctgaaggttggcatttgtaaattaaacctaaaagctaaaaaaaaaaaaaaaaaaaaaaaaaggtcgagaatactttgtgactactagcagcatcagcatccaacctaggatatcctttccccaagccactcactgacatttgaagttccagaagttatggtaattccttcaactttacaattgagatgcagctcctgtctcacccctcaccacccctcgggagcagggagctactcaacattgatagtcacttattctttattattactgagttattgctcctttcctagaagacagggaagtgagattattgttggcaggggggcagtgggcaagacaggaaggatccccaaaagaaagggtgttgtcagccgggcgcggtggctcacacctgtaatcccagcactttgggaggctgaggcacgtggatcacctgagtttgagaccagcctggccaacatggagaaaccctgtctctactaaaaatacaaaaattagccgggcatggtggcgggcacctgtaatctcagctactcaggaggctgaggcaggagaatcgcttgaacccgggaggcggaggttgcagtcagccgagatagcgccattgcactccagcctggggaacaagagcgagacttcatgtcaaaaaaaataataaaataaaaacataaaaataaaaaaagaaagggtgttgtcaccatgactttgggaacagctgctccctggatgtccttgggcctccctcttgtctgacctggcacagggcaatcaccactggactgaagaagtggcaaagaagcccactaaaccagtctgatgctagaaagaatgaatccttcacctcccacaattcctccctaaggcctgccgcccagaaaataaacgccaaagggaagaaacatttccatttccgtctattgacctcagagcctcttccaacccaatgttttgatgtcactgcctgtaggtgggctgagtcctgctatgactgagaggggctgaccctgagccaaaagtggaggccacagcagttgacttgcctgcagcttttttggggacacttaggtttcccaaagtttattaggcagaaggacaggaggaacaaaacacaaactggccagctttttggggagaacagtatggtcaacgtaaagtcaggtgaacaatcctagccacatcggatcaatacaagggacaataaaaaaccaaaaaatatctccttactttgtggaacacaattcagtggagtctaacagacctggttttgaatcaggctctggatgtaacctaacaatgtaacctcagacacgctacttatgttctctgtataccagattcctcatctctaaagaggaggtgatgatagcaaatgaggagaaactgaaagcttttcctctaagatctggaacaagacaaggatgcccactttcaccactgttattcaacatagtactggaagtcttagctagagcaatcagacaagagaaagaaaaaacaggcatccaaattggaaaagaagaagtcaaattatcattatttgcagatgacatgatcttatagtcagaaaaatctaaagactccaccaaaatactattacaactgattagcaaattcagtaaagttgcaggatacaaaatcaacatacaaaaatcaatagcatttctatatgccaacagcaaacaatctgaaaaagaagttaagaaaatcatcccatttacaatagcgacaaataattaaccaaagaaataaaagatctgtacagtgaaaactataaaacactgattaaagaaattgaagaggacacaaaaaaatggaaaaatattccatgttcatggattggaagagtcaatattactaaaaggttcatactacccaaagcagtctacagacacaatgcaatccctatcaaaacaccaatgacattcttcacagaaatagaaaaacaatcttaaaacttacatggaaccacaaaagacacacaacaatcaaagctatcctaagcaaaaagaacaaaactggaggaatcacattatctgacttcaaattttactacagagctatagtaaccaaaacggcatggtactggcatcaaaacagacacataaaccagtggaacagaatagagaacccagaaataaattcacatatctacagtgaactcatttttgacaaaagtgccaagaatatacattggggaaagggcagtctcttcaataaatagtgctgggaaaggtggatatccatgtgcagaagaatgaaactagacctctaagtctcatcatatacaaaagcaaatcaaaatggattaaagacttaaatctatgacctcaaactatgaaactactaaaggaaaacattggggaaactctcctggacattgtaatggacaaagatttcttgagcaataccccacaagcacaggcaaccaaagcgaaaatggacaaatgggatcacatcaagttaaaaagattctgagaaggaaaggaaacaataaagaaagtgaagagacaacccacaaaatgggagaaaatattttcaaactacccatctgataagagattagtaaccagaatatataaggagctcaaacaactttataggaaaaaataaaataaaataatccaatttgaaaatgggcaaaagatctgaatagacatttttcaaaagaagacatacaaatggcaaacaggcatatgaaaaggtgctcaacatcactgatcatcagagaaatgcaaatgaaaactataatgaaatatcatctcacactagttaaaatggcttttatccaaaagacaggcaataacaaatgctggcgaggatgtggagaaaagagaacccttgtccactgttggtaggaatataaattagtacaaccactatggagaacagtctggaggtttctcaaaaaactaaaaatagagctaccatatgatccagcaatcccactcctaggtatttacccaaaagaaaggatatcagtatatcaaagatcagtatatctgcactctcatgtttactgcagcactgtttacaatagtgaaaatttggaaatagtcaaaattcatctgttgttcatcaacagatgaatggataaagaaaatgtacagatacacaatggagtaccattcagctacaaaaaaagaatgagatcctataatttgcaacaacatggatggaactgaaggtcgttatgttaagtgaaataagccaggcacagaaagacaaacatatgttctcacttatgtgtgggagctaaaaattaaaacaatgaaactcatggacacagagagtggaaggatagttaccagaagctgggaaaggtagtgggggagtgaggggaagtggggatggttaatagacccaaaaatattattagaatgaataagacatagtatttgctagcacaatatggtggctatagtcaaaaataatttaatacatttaaaaataactaaaagattataattggattgtaacacaaaagataaatgcttgaggtaataaataccccattctccatgctgtgattagtattcagttcatgcctgtatcaaaatatctcatgcagcccgtaaatatatagacttgctatataccaacaaaaatcaacaatcaaaaattcattaaaaaataaataaaaaggaagtgattataatgatgctacctcacagaaatcttaaatgaaataatgctcataaagtacttaatacagggcctggcacacaatacatcgtattcgtccattttcacactgctataaagaaatactggagactgagtaatttataaaggaaagaggcttaactgactcacagttccacgtggctagggaggcctcaggaaacttacaatcatggtgcaaggcaaaggggaagcaaggtccttcacatggcggcaggagagagaagagtgaggattagggggaagagtcccttataaaaccatcagatctcatgagaactcactctatcactacaacagcatgggggaaaccgcccccatgatccaatcagctcccaccaggtatccccctagggattatggggattacaattcaagaagacatttgggtagggacacagccaaaccatattatacatgttcattaaacggtggctcttatttttgtcttgggtcagagagaatggaggcagatggaaaatattgcaaagagaagaaaagtataaattgtgggggcaatggggatggcactggcatttttttgaactttaataataacattgcaaacccagtaaatggttaccagacctaagtttgaacaggcaaggtgtttaatacagcttgttgattggatttacgggtccttccgggcctttcatggagcttgggcctgctttctacctttattgcttctgatgcctaaggctaactccccagggcagcttgactcccaacagggaagtctcatttaccaaaaagtctcagtgattctgttttccctgtcttttttgcttttattattgtttttatttttttagagacaagatctcgttctgttgcccaagccggagtacagtggtatgatcatagctcgctgcaaccttaaactcctgggctcaaaggatcctcctgtctcagcctcctgagtagctgagagtacaggcacacaccaccacatctggctaatttttaaattttctgtagaaatatgagtctcatgatgttgcccaggctggtctctgactcctaggttcaagcgatcctcccaccttggtctcccaaagtgctgggatgacaaagcctccatgccccactgtcatgatgattccgaatcacctccagcaagggacaccctcttcttagggctgagaataactgccaatgaggaaccatggatttggaggcccttcaagggtcagatcttggttccaccaggttcccatcctcacctgtcatcaataaccagcaccttggtctccttgtcccctgccttcagcatccctggcagattcctgatggtgacactcccaaggccacttcacaggatggaccctcatgggtcatctgggccaaacgcctccatgataaagcataagcaccagagaggaggtggacttgtctaggttacacaggaggcctggggttgctattgggctcacccaggtctagggagcccaggacagcagtcatcaccaccccactctcagtaacactgtgctcttcagtatgtagacagctcacatctatgccccatgcatgatttacaaatgtaaagaccatgcacaggagctggcttagcaaaaattgataagcagcagccctggttatcattactgtcactgtccttgtatctcatagcttcatactacacccaagtcaccataggcatgggcatctttgttttatagtaggaaaccaaggttcacaccttagcctgcaggactttgtaaaaaccctgctgtgggtaaagagcccaaaatggccagcccctcagccttttgctcccaacccccaagccctttctcctccagggcactgcctcccaccctcgtctggtcaggggaggccaccagaggaggagtactggcctggcagggaacactggcagtctcggcccttcaccaaacagcaggggaaaggcagcaagccccgccccggtggccccaagatatgggtgccaggaacccgtcattcagagaccacaaatgaagaaagcagggaggccagcccagccaggcacagctcaccccaccctgctgggaaaacccattgtgtttcaccgggcatcctggggtgctgttgtgggccaagaatgacacttgcctcacgccatcaaaaccagaagggtatcctaaggggagtaggctcgccccgcagagccacactagatggaagcaaggcgagtagccagggcagagcccaccccccgcacctccctccccacagcctgtgtagacacacaggccggcagagtcaccggggcagcaggtaggaagggcggttcaggaagccaggtacttaccacaggggagcatggtctcttcagcctcaccctcaggttctcaccgtgggctccactgggcatccataggaccctgcagttgtgggcaaaaccggggagacccatacagacatcgttttcctggggagaaagaaaattcgatttcatcagagtcctaaccctgtgcatgccttgcacagggacagacggaaataagcttcctccctacccaggtcatgggcctctgcactcagtgacaaaaatgggagagcacagagccagctccccacacccgctgaaaaaacaaggagtccctgaggcctcatgttcaatcccacccccacccccctttttaagccctgtcaactctttctcgccttcagtcatcagcttaggtgcctcttcctccaggaagctcgccttcatcttcccgggctggtttaagggcactttccgtgccatgtgctcaattccttgtgtccccactaaacctcagatcccacaggagcagtggcggtgtctgccgggttctcgctctgtcttctgctctgctaaggtgcctggcacaccatgctctcgatcccagatgagtgaatgaactaatgaatgaatgaatagcagcaccacatcaggctgctctcacataacccacatggctaaggagaggtctacgttttattttttaagaaggcagagctcgagggggccttgaagtcacatcgccggctgctgagtctacgaacagggaagcagccgcagtccccgaaaggacccgtcccagcgagccagggcctggttttccttccgcagaaggcggagggaccggagcgggcgcgggcacccctgggctctgaggggcgcgctctgaagggcggcggacttcagggccatgctggctgtccccagaaagcaggagcccgaaaccgcggggccaacgaacgcccacattctctgctacaacctcgccactcccctgcgcctctccccttgccccctgcccccacaggtaacgcccagaacgagtgcttctcccggtggggtactgaggagcctgggctgcagctgccgagccgccacagccacgctgagcccggcctggcctgcacactggcgccaccgcctggcggggagcgggactgacgcgctcctctccctctcctccagcccagatcacggaggcgcggagctccatctcctgccctgggcgaggggagtgagggagacaaagactttgggcacaacacccaccacatagaacctattctctagttgggaaacaagtcaaggcaaaggcgcacagagtgaaagtcagtgtgtgagcaaacaaaacaccagccagcagaggttaagcttctatgcaaacaggcctgcctgactcagggagcaggggagactgaggcagatgagaagctcccgccgaggccaccaggatgcccaggccttggggctccaggaaacgtggtctccacgctcaatctcggctcagccttccccagaagatgcctctagccggacagagctgggttttaatcatgccgccttcataagccaggtgcatgatctctggctagttaactacaggtgcatttccttaacctatttaaaaaaggggtggggggatggttaggaactcttgcctggttgtgttgttgttacaattaaatcatgaatatggagcatttgatgcagtgctcagaatagaagctactcttaaaagcaatccactcataatagggaacgaaggttctagaatggctactttttaaaactataaatcagaacagattcaatataagaacatcactctcaattcttactcacttccattctggagtagcagagaaagaagcagaggggccactggctgcagagggaatggcccagagctcacagcctgtcctggttaagtggcagccatggggaggccctagagaaatgtcaccaagaactgtggagacagcaaggagtaaatgctagcactgattgtctgccaaatgccattcaatgaactacattctttacaagcattgactcatttacttctcacaccacccctacaaataggtgtcattatcatccccattattttagagatgagaaagctgggacattcacagattggggacccagaccaaagtcacactgcatctaagcagcaaaactgaaattgtagccaggtgttctggctccagagcctctgctcccaaccaccagccaatacctgcctctctgatctgggagctatattcattcccacttctcaggcgagaaaactgctgttcagagcgatgaactcttgcaaggtcacacagatagtcactggcagagctgtgatttttagtcttgagctttctccctaattcaacttgggatagagaaagtaaaagctggccaggcgcggtggctcacgcctgtaatcccagtactttgggaggccaaggcgggcggatcacgaggccaggagattgagaccatcctggctaacacggtgaaaccccgtctctactaaaaatacaaaaaattagccgggcgtggtggccggcgcctgtagtcccagctactcgggaggctgaggcaggagaatggcgggaacccaggaggcggagcttgcagtgagccgagatagcgccactgcagtctggcctgggcgaaagagcaagattccgtctcaaaaaaaaaaaaaaagaaaagaaaagaaagtaaaagccagcccctctccagccgtcagaattacaaaaggtgaaccggggacctgttggcaatcacatttccgaccgtgtagcagaagctggtctatggtaagagacgataaaaccaccacacagagagaagcaaagatgaggctccgccaacagagttcaagtcccagttccggccattcctgaaatccagctgcaaccttccctttctaaaacttggttgttcaaattcagggtttgactccaggtgtcaataaagccccactgtgtccccaagttgttacaagttggggaatagtcagttgcaaccaaaatgtgctctgccacagaaggtgacatatggaaacaagaggcagaaacccagaagtccagaggatctggaaaaatgagaggaaagagaagccgagagcagcagaaagaacaaagggtgcaaagctataaagagccttttgcccatcttgccaaaccatcagctctctcacttgtccctgagcttgctgcttctgcccacagactgcttcccaaacagctgtgaaaatatcgtgaactggtgcttttgaacatttcctcttccaaatgcatgcaagtttcacagccccctgagtcccacacgtagacaatcacttataccaattcctccttccgataaatgttcatgccagctaaaataactccccatccttcagatccccccacaccaagtagtctccctaagtgcgtgttcttcctgccccccactcccccgcacccctccagcagggtgcttctggaaaggcagatggcatgagtggagagctgacccccagctcagtcttcaggaaggcagggctgttgatgagtcagcggggtctgcactgaagcatctggcccaaattaccaggatgaagactttttcggcaaattgctcacagcccaacaggcagcactccacgcagaccaccccagcgctgctgttagtcacgcgtgcattttaatttagctacagaagaggaaggagcaaagagcacagaataatcctctccttagagaggaaaatgggacctcgggagcttgcatggcttccctcaggtcactcagccagtcagaaaagaagcgctcagcaggggcaggctccctgagcgtgtcctaatcctagtcctcgcagaactctggtcattctgggatcagcatctgcagtggtcacattcctcaccttccccctgcctcccaccaccgtcacttgactttctctcagagctcaaactagaagggatctggttcagttccatcaaccattcattcattcactcatccattcaaagtggcgaggctggaaggggccttagggctcatctggccaaatccttcccatccggtgttcactgggctgtttgactctaagccacaaacattgactctagctaactgaagcaaaagaagactcagagtttatttaaagtaaaagaagaagctcaaagaattggaaaattttttaaaaagctgaagacttgtgtcctaataggacaggctccagggaccttaaaagcatgaatttaatgatctatagagtgcatcttctagcacttttccactggtgtcttctgagtgggctcgttcatgaacaaaacgttttcccctttctctctctcccttgcctcacccatggctgcttctaggtggtgtagcaggcagggaatgggcagggaatgtaaaataaaatacatggcctcttgagggctcatgcagacagattgctggaccctacagagttcctgattctggggtagaactccagaattgtgcatttttaacaagttcccaggcgatgccaatgtcgctgttctgggcaccatactttgagaatcaccactctaaggaaacttcacttaagttttgtgtcacacttagctggggagcatggggcacgctgagaaatagtccccaccacaactgtactcagtgggatcaccaagtcccacaaggctgaaatcaatgggattttcaaatgaaaaacaggatactatgactaaaagagaggatagatgttaggcaggaaaaaacacagaggtacactgtgcccctccccaggtgacatttgaatgttcgtgacatctccaccaggtggccccctggcttaggcttgagttcctccagtgacagaaggctcaccattccaccatacccaatctatttgtggatgctccgataattactaagttctgagtcttgtgacacaagactcagagttacaattcccctctatgtagcaactcttcaaataattgggggtaactctcaggcttcctggggtcagtgggttaaatctctccagctacttctgcagttcttcatgagacatgtggaggatcctccttgcaatcttgaaggagcccaagatctctctttgttgggcaggtgacacctttattgcaagcctggtatctgacaggcccagtgcttcttctggcaacacagtagcaaaaaaggcaaacactgtgcctactctcatggagcattagtgagtaatcaaaatggaactgtgttctacagataagttctcttcagcatgcaacagtgaggctatcacctccctcattctaattaacatgcttctattaatgcaacctgagatgacatcaggtttctcagcagccacatcctaccattgacttcttaccattcttcagaaatctttagaaacatttacagtgcgcccaaccctatgctggatgtcacaggagtgcaacagaagcaagaggcctggtctcagcctctttagaagccactgttagtctcactgaaatgttggttaactggcaactggacaagatcttcaggtcccaaaggagatcctcaaggagtcatcgtcactgattccaaatccagggtctcattaggagcacatggaccctctgcatcagcagagcctctactgggggccaggcctccaggctgagaagtctggccattatatgtcttgaacttcctccaactgcagcagacgggggctccctgtgccaccccctctaaggggtttcctgaatggtcagctctaaggcaggaatcaggagagaagctgagaagcatcaaagaataatgagctggaaggagccttggcaatcccaagtccaaccttctcattccacagaagaccctgggccccaagaagtgaaggggtggttcgagtgcccactgttgacagatgaatcctaggatccagctcctctcttgccatgaaaccccattccctgcccaccacacaccacccagaaacagccgtgagtgaggcaagggagagagaaaaaagcagacacattttgctcatgaacgagcccactcaggagacaccgatggaaaagtgctagaaaatgcactctacagatcattaatcaattgatgcaacttaagcaatatatcagggggaaaaacctttgttgccaataatggaagcgcctaagacagaacattcttcagtgccggctgggcaacagaaacagcaggcggccataactcaaagcccagaaagcttttgtttttaaacttgcaatgccaaggaggtgagacaagggagccaattctcagggagacaggccatgcggagccaaatgcgttcaggtgatatactgatcagatggtccagatacagttattctcagaggaatgatggctcattaacgagccaagctgttgaccacagctctccaggagaagggaaatgagggctacgtgttttcaaaaccagagctacactcgatgtgacacaagaactagacatgcatgagtgtggagaatcacagtgaatggaaggaagcaagacccttctctcccagacaccttgatgttgtgggttagccttcattagaataggactgattcctggatgggtgacatcatgagctaacacgtgtgtgctgcttactacttgccagacacagtttgctatagttgggatgtttttgctccaaatcacatgttgaaattcgatccccagggctggtggtgatgggcctgatgggaggtgtttggatcttgggagtggatccctcatgaatagattaatgccctccctgggggatggtggagggataagtgagttctcactctgttctcgcaagagctttttgtttagaggagtgtggcacctcctccctcctctctctcttcctctcaccagcgatctctgcacccataggctccctttcaccttccaccatgggtggaagcagcctggagctctcaccaggagcagatgctggtgccatgcttcctgcacagcctgccaaactgtgagcccaataaacctcttttctttataagttatccggccttgggctttcctttatagcaacagaaatggactaagacactgtgccaagcactttgtaaatattaactcctcacaataacactgggtgtgctatgactaccccattttacatatgagtcaactttgtcacagagaggctgaggaacttatccaaggtcacacagctagtagcacagccaggttaggattgaatccaagtagctcagttaggaatgcctgacttcgctgctgtaccactaacagctagaagaataaggagttgctgctgatgctcccagcgtgcccccataaatatacagactactctagtactctggtcttctaacctgccatttgggacctgcctaagctttccaatttgaggtgctgttctctgatatcacaagaaagtacctctataaattctggccatgataatatcttttcttccacttgttgattacagatctctgatgtacagccaaactgcattatttgagttttcttagcatatatagaattgacacattgatataatgtgtaatggccatttacttttttccccctttttttttacttccccgtaatataaagaagagctgcatttgatcctaaactcgagtggccacctctgtatactaaatgagccccaaggataatctgccccattcatcaacactttctagtttgcaccatgttggtgactaaggggacaccaggggagcagatatgatctctactggcaatgaattcagtctcctgggaagattcggtgcaaacgatagttgcaataaaacatggtgagtgctattgtaggactgtgcctaaatgcttcaggaacaaaaagaaagagaacccagctcttgagatagcagcagaaaaagaggttcagcagggagacggggtcagattgaacacagctaaggaggctgtgcagtgttacaggagttgtgggggggcggtctctggaaggatctaggtagggggatattttagttaggaaaaccaccccacccttctacatgcatggagggcaggctagagggcagcagtgctgggagaaagacaactaagtaggagatgacggggccaggcatggtgactcacgcctgtaatcctagcactgtgggaggccaaggcaggtggatcacctgaggtcaggagtttgagaccagcctggccaacatggtgaaacccgtctctactaaaaatacaaaaaactagccgggcatggtggtaggtgcctgtaatctcagctgctccggaggctgaggggggacaatcacttgaacctgggaggcagaggttgcagtgagccgagatcccaccactgcactccagcctaggcaacaagagtgaaactccgtctcaaaataataataataataagaagaagatgatgatgatgatgacgcatagaccaggcaggagatgagagttaaactcaagcagaagcactgaggatggaaaaagagaatggattaaataaaaagaaatcagaggtaataaaaatgaaggttttttcccctgtgtggttcacttggacttcacattcatttgccataaaattttgcatctgacttgatcctgactgaagcatcgtggagatctggtttttaggttaagttcaaacttctgggaaacacaagtcagaccggaagatcagagtttccatgcagatatgatctctactggcaataaattcagtttctggaaaacatttggtgctatcagtcctgtttgcttttgagcaaattatttgcattttctgaaactcagtctcatcatttgtaaagtgagaattatgatatctacctctgcatcttatggcataagctaacttgggtgccaatattgtctcatcccttttcatcttttctaataatgataacaacagcaacctccaacatttactgggcacctaatatgtaccaggcactattcaacatgcactaattcatttgatcctcacaaccaccttaggagatagattctattattgtcaccattctgcaaataaagaaacggaggcagaaagatgcagtaacttgccaactccccaggctgtggcagagcaaagatgtgagctcgccttctctcataattgcctcagcactcgcctaccctgatgcacaggaagtccaacgcctcctttctgggccctccctcctcccctgtattgtccaagaatccttcttcttcagtcctgctccctggcaccagatggacaaagaacaactccagccctatgctgccattgctggatgctgccacacggtgtcgctatggaaggtgtagcctgcaattggcgctggtggtctgttgatgggatgttcttgctggttctggtccctgtccaagctacaatggggtcccaagcagaggctctgagacttcacttccttttttttttttttttttttttgagacagagtctcgctctgttgcccagggtgaagtgcagcagtgcaatctctgcttactacaacctccacctcccaggttcaaacgattctcctgcctcagtctcccgagtagctgggattacaggcatgcaccagcacgcctggctaattttttgtatttttagtgaagacagggtttccccatgttgccaaggctggtcttgaactcctaggctcaagtgatcctccctccttggccttacaagcatcacagagcttgcaagatagtgaaaaattatctggccaagttccaaaagaggcccagaatctagagaggttagtaaaacaattgggcttctgttgttccaagtttagctgcgcttctgggctttggtggcctcaagatactatgggaaaaaagttggcatccagggcccaccacgtgtcagacccaatatatgatctggctctgggatgtgaccccagaatgctgcacacttgaagtaagaataacaagaaacaaaccagtcctcgcatagatgaaaatgtgcttcaaaaatctgagtgctggagaaaacaacaaggcctgaacttgaattaaggtaatcctgtgttggtagtgctcccagtctcctggcaaaacgaataaagaacctacttttagaagacaagggcacagtataggccttaaattatgttttccaagcacaatgtctaacacagagtcaaggataaccaagtacacgtgaagataaaatgctatggatgaggccaggtgccgtggctcacgcctgtaatcccagcactttgggaggctgaggcgggcggatcacgaggtcaggagtttgagaccagcctgactaacatggcgaaaccccatctctactaaaaatacaaaaattagccgggcgtggtggggggcccctataattccagctactcagaaagctgaggcaggagaatcacttgagatcgtgccactgcactccagcctgggcgacagagcgaaactccgtctcaaagaaaaaaaaaaaaaaaagataaaaaaatgctatggatgagaataaacagaaacagcaaacagacacacccacaggaactgcaaataatggaatcatcagcagataccataaaataaataggtctgctatgttcaaggagataaaagtttatttaaaccattttggcagaaaactggaaatcataaaaagtgacataacagatatgtaaggaaactgtgaaccctgaacatctgagatggtctcaattaatttagaaagtatattttgccaagattgaggacatgtgcctgtgatacaccctcaggaggtcctgacaacatgtgcccaaggtggtcagagcccagtttggttttatacattctagggagacatgagacatcaatcaacataatgcaagatgaacacaggtttgctctggaaaggtgggacaactcgaagcaaagatgggaagactcgaagcagggcaaggtttccaggtcataggtaaataagagacaaatggttgcactcttctgagttcccgattagtctctccaaaggaggcaatcagatatacattcatctcagtgagcagaggggtgactttgggtagaatgggaggcaggttgactctaagcagttctcagcttcacttttgcctttaacttagcaatttgggggccccaagatttattttcctttcacaaaaccaaatagattttttagaattgaaaaatacaatactattaaaattaaaaattcaataactttttttctgcctgattttatctttttaacagctttattgaggtatggtttacataaataaaatccacctatttaaagtgcttagttcgatgagcctgcctatgcagaggactttttgaaggagagaaattctgaaattatgaatctaacagtttaaattaggaacgtaattcatatagactacaccattcccagctacaatcctctttcagagagagaagcacctttgctctccagtcatttacaatccttcagaatggaagcaactggctccatggttccaggttttatacccctttgaagtgtaaattaatagtctcagaaagaaaaatgggaacgtctttactacagaatgcaagcatttggcctgaggtggggtgggtgggagttagaagatgataaatcttattgccctttgaatgggagcagatggctttagtcctaacaccctctaaccttaactcagatgtcaataacatttgctcagaaagccctaattgtgaagagacatgaaaataattgcttattgacagatcgagatgcagaggatatggtgagacagtcttaacgcatatgttttattggtgtccctaaagaaaaaaataatgggaacagaggcaaatgtgaataaatcattactaaagagtgttcaaaactaataaaaggccaagcacagtggctcaggcctgtaattccagcactttgggaggctgaggcaggtggatcatgaggtcaggaatcgagaccagcctggccaatatggtgaaaccccgtctctactaaaaatacaaaaatgagctgggcatggtggcgcatgcctgtaaccccagctacttgggaggctgaggcaggagaattgctagaacctgggaggtggaggtcgcagtgggccgagatcataccactgcactccagcctgggcaacagtgcaagactccatctcagaaaaaaaaaaaacaaaaaaacccactaattaaagacacaaaaccacgtgtttaagaagccaaataaatctcaaggcagaaaattttaaaaataaatcaacatgtagatacattatagtgaaactgcaaaaaaacaaagacaaagagaaaccttaaaagatgtctttacagaggcagcagttagagtaacagctaaattctcaaaagaaacaatggaagctagaagacagtagaatgaccatctcaatgcactgaaagaaaattgttggggtgatcagacccaacaccaagtcgtgggggtacaaagtctggcagagtcaaaggattgagaaaaagacagtttgagagagaaaaacctgggaccagggggacatcactagtgtatggaggctgcgaaggccctgagctctaggagcccatgctatttattggtaatccaacaaagaaacaggtgatgagaatgtggaggtcaaaagggcatgttgcattaagcacatgatttacagctgtgatggtttagcatttgctctgctacttgagataatggagagcagattcttttaactcaagatacaatcgatcctgagagagcaaggagcaagaagccagcaagtctagacacattccagagcctcgagccctggattctatccaagccatgagggattttatgccctgggtttaagttatggtgcatcagggtagccttctaccctttagcacagagcttggtgttccaaaggccacaaggggctttagaccctggaccccgcacatattccaagacttttttatattatgtcagacatgcaaaccctgcctcagcttctgtcaacactcagcttttcccaacagaaaataactgcttatattgtttggatatttgtcccacccagatctcatattgaattgtgatgtccaacgatggaggtggggcctggtgggaggtgtttgggtcatggaggcagctccctcgtggcttggtgttgtcttcatgatagtgagttctcacaagatctggtcatttaaaactgtgtgtcacttccccccaactctctctctcttgctcctgcttttactatgtgaagtgcctgctcctgcttcaccttccaccatcagtaaaagctccctgacgcctcccgagaagcagataccagtactatgcttccggtacagcctgaagaattgtgagccaattaaacctcctttcatataaatacctagtctcaagtatttctttataaatgcaaaaacagcctaatgtagaaaattggtacctagcatggggcattgctataaagatacctggaaatgtgaaagcagctttgcaattgggtaatgagcagaggtttgaaaagtttggagagctcaaaagaagacaggaagatgaggggaaatttggaacttcttagagactggttaaatagttgtgaccaaaatgctgatagtgatatggacagtgaagtccaggctgatgaggtctcagatggaaatcagaaacttattgggaactggagcaaaggtcacccttgttatactttagcaaagatcttgactgcattctgctcttgccctagaggtctgtggaaatttgaagtgattattgacagtatctggcagaagaaatttctaagcagcaaagtgttcaagatgtacctgactgcttctaacagtccacattcagatgcaggagcaaagaaataaagttgaaatttatatatgaacaggaagcagaacttaaatgtttggaaaatttgcagctggaccatgtgacagagaaagaaaaagcttttttgggagaggaattcaagcaggctgtggaataaccacttgtacgagatatttgtgtaactaaatggagccaagtacctttatctaagacatgaggaaaaggccatgacattttgaagacaaccttcgtgcctgtccctcccctcccaggtccagaggcttagaaggaaagaatggtttcatgggccaggcccagggcccagtggccctgcacagcttcaggacactgctccccacatcccagctgctccagctccaactgtggctcaaaagggcccaggtacagctcaggctgtcactttggggaatgcaagccataagccttggtggctttcatgtgatgttaaacctgtagatgtgcagaatgcaagagtgaagaatgctaggcagcctctgcctagattttagaggctgtatgagaatgcccaggtgcccatgcaaaaacctgattcagggacagagtccttatagaaaacctctactaggaaagtaccaaggggaaatgtgaggttggagcccccacacggagtccccccactgggccactgcctagtggagctgtgaaaaggagaccacctttctccagaccccagaatggtagatccactggcagcttgtaccctgcacctgcaaaagccacaagcactaaactgagagcagccacaggggatgtaccctgcaaagccacagaggtggagctgcccgagacctagggagcccaccccttgcaccagtgtccccttgttacaggacatagagtcaaaaaagtttatttttggagctttaagattgaatgactgccctgctgggtttcaaacatgcatggagcctgtagccctttccttttggccagtttctccctttggaatgggaatgtttatccaatgcttatactcccattgtaccttggaggtaacttgttttttattttagaggatcataggtggaagggatttgctttgtttcaaatgagactttggacttttgagttaatgctggaatgagttaagactttgggggactgttgggaaggcatgactatattttgcaatgtgaaaaggacatgagtttaggaggggccaggggtggaatgatatagtttggatatttgtcctttcccaaatcatgttggattatgatccccagtgctggaggtggggcctggtggaagatgcttggatcatgggggtgtttccctcatggcttggtgctgtctttgtgatagtgagttctcacaaaatctggtcatttaaaagtgtgtggcacttggccgggcgcagtggctcatgcctgtaatcccaacactttgagagaccaaggtgggcggatcacctgaggtcaggagtttgagaccagcctggccaacatggtgaaaccctatctctactaaaaatacaaaattagccaggcatggtggtgcacacctctgatcccagctactcaagaggctgaggcaggagaatcgcttgaacccgggaggcagaggttgcagtgagccgagatcgcgccattgcactccagcctgggcaaaaagagtgaaactgtctaaaaaaaaaaaatgtgtggcacccctgctcactccccatctcctgctcctgcttcctgctttcaccatatgaagtgcctgctgctgcttcgccttctaccatgagtaaaagcttcctgaggcctccccagaagcatatgcctctctgcttcctatacagactgcagaacagtgagccaactgcacttctttccttataaattactcagtctcaggtatttcttcatagcagtgccagaatggcctaatacacctgtgaacatacaaatttacaatttcctttacccaggaaaaaaactcaccaacaataaatacaaactaaagacatattcaacagataaaatctgagggagttcaccaccagtataccagtattcattcttcaatatggagccaagaaagtgatatgtgtgtgtgtgtatatacatatatattacttacatatgagtatatatatgtatgtatatgtgtatatatatgtatgtatgtgcctgcatgtacatactcacatccatcaagacattattatttgcttaataaatacatacatattaatatattaattacatattaatatgtattaaacacatgcataatatatacatatttatataatatatagacataaatattaagcaaataaaataataatagtgccttgatgtatgtgagcatccacatgcatctacacaaatacacacacacacatttctacatatttaccctttccaacgctcttctttcctacacatccaggatttatctggtgtatcaggccattcttccattgctataaagacatacctgagactgagtaatttgtaagaaaagaggtttaattggttcatggttctgcaggctgtacaggaagcatgacagcttctgtttctggggaggcctagggagcttatacttgtggtggaaggcaaagtgggatcaggctatcttataagaagggagcaggagaaagagagagaaaaaaaggaggaagtgctacacacttccaaacaaccagatcacacgagaactcactcataatcacaagaacagcaccaaggaaatggtgctaaactatttatgatgaatcagcccccagtcgcctcccaccgggtggccccacctccaagaatagggattacaatataacatgagatttgggtggggacatagatgcaaaccatatcatcaggtgtcatttccttttaacctaaaatgtttatagtttgtagacttatgtagtgcaagtctacttactggactaatttcctcagctttttcctgtctacaaatgtctttattttgcctttatttttgaagtatgtattttgaatgctttgttaaattctttcagcattttaaagaagccattacattgtctctgcatttttaataagaattcagccatcattctttcttcttgttaccttcttaaatgtatttgccccttttctctgatagcacttaagatatcctctttaatattggttttcagcaatttgaccatgatgtgctttggtatggttttctttgtatttattctgcttgagttttaatttttctctttatgcatcggtttggattaatttaattaacctatcttcaagtttatggatcttcccttgtgctctattcagtctgctgataagtacttcaaatgaatttttcatttcagtactggaattcccattttattcttttgtagagtttcagatttcctgccgaaatttacaatctgttcacacattttgcttggcttttccagtgaatattttaacagagttgtaatacttattttaaagtttttgtcggctgatttcaacatctgggtcattcctcattctgtttttttgttgttgttgttgttgttgttgtttttctttctcttgattattcattacatcttcctgctttttttttttttttagacagagtctcactctgctgcccaggctggagtgcagtggcacaatcttggctcactgcaacctccacctcccaggttcaagcaattctcgtgcctcagcctcccaagtagctgggattacaggtgtgcaccaccacggctggctaatttttgtatttttagtagagatgggctttcaccatattggccaggctggtctcgaactcctgacctcaggtgacccacccacctcagcctcccaaagtgctgggattacaggcatgaaccaccgcacccagcccttcctgctttttataaacatgtcttctctatttagttatgtgcacatttggaaagaattagtgggcaggtgtgccctgagcaagtctctcttaattctcccttccctgttcctcctgctgccaggttctcagtgaagacttaggaagagttgatgggtggatggtcctagagaaatctctttaccctcatttcctgtccttagcctttaccaggacagggctatgaagttggtgaagaccctgtagatgagaactggcatatagatgtcattttgtatttgggactttgggggattttaatacattttgccagctcatgcaaatttgttaaaagttcagctagtttctccttgcatctgcaaaaattcccatctatagtgggttcaatcttccatccaccatacccctatgaggaaagcagccttgggtctcactttcctagcaagggctctttgcactatggaatttagtttatttccacttctttatcctcagcttgggtttttaacaactatgcttctgtagcttatccagcttactcacattatttcagtgagagcaatgatctcttgaaactttctatatcctaattggaggtggcagtctaaatgtttttcaaaaagacttacacatttaaaatatgaagagaaaaggtgagaataaagtttctgacatctgtagactattagattatccatccctttccatatccagggaccatatttaatgctaacttgactcagagaaaataccaccaggtcatttagctaggtctatatccctgctgggaaggcccaggaaggctaatgcatcaaatgcccactggaacaaaaacatcttcttttaaaaaaatcacctgttttaaaatgaaattggaggaaaatgaagcaaaaaagaatttacccctatttcatcatactggatctctgttttcatttaaaatgctctttatcctcatttcaacatatttctacttcttaatctgtgctagactagaaccaaatccagaaatcagtttttctaacaaacttactgagtctgaagggagagtttgactttctgctcaccaacaaacttgggcacagccagaatttatgctatttcacataaagaaaaataggagggaaacggcactgacccgagaggccttatgcagcaacgattctcctgaagtgggagagaaagagaattaaaaagatgaaacacacatcttctttccccacaatgttcagtcaactgctctaggccttattatgtagaagtgtacaattgatagattctgtaagaaattacctaaaaatctatacttaattggtatcaaatagtctgaaattttctggtcacaaaccctttttaaaatctgatgaagagtctaatgcaggtagcttcagttgcaggacacttgaaacgcccagtgccctccagggacaaatagaacaattaggactgcaaaaggagaacaaaaagacatttgtagaacaggtaagtggtacttagaaggaaggtctaaaagcaatcatctaagcttccacattaaagactagaaagatagaataaactgaaaataaatagaagaaaagaataaaatcaaggtgagaataagaataatgaaatagaaaatggataacagcagagataacccaattaaagcaaaagctgtatcttttaaaagtataataaaattgataaacctttagactgctcaagaaaaaacaaaaattaccaatatcagaagtttaaaaggagacataactacaagtcctatgaacattaaaatgatagaaaggaataatataaacaaacatatgcaaatacatttatggatataatgaaattatccattttttcaaagaagcaaattacaaaaatgacagaagagataatctaagttatactatatctatgaaagaaatagaaattgtagttttaaaatgtttttttcacaaagaaaataccaacacagatcacttcactggtgaagtttataaaatatttaaggagaaaataacaccaatatcacactaacactttcaaaaaacagatggagagaatatttcctgtatcattttatgatgccagtattatcctgataagaaaaacaaagtcattacaagaaaactacaggctaatagtatttcttattaatataaatctttaacaaaatattagcaaatcaaacatagtaatatagaaaaaggataatacatgtgacttggaggggggcggcacttatcccagaatgcagagttggtctaatatttgaaaaattagtgtaattcgtgacattaataggataaaagagaaaaatcataatcttgagagatgtgaaaaaacttaacagaaataggtgtttataacattaaaaaaaaaaaaaaactcttatcaggcacggtggctcacctgtaatcccagcactttgggaggccaaggtgggaggatcacttgagcccaggagttcaagaccagcctgggtaacatagtgaaaccccatctctataaaaaatacaaaaattagctggatgtggtggcacatgcctatagtcccagctacttggaaggctgaggtgggagcatcacttgaaaccaggaggtggaggttgcagtgaaccaagattgcaccactgcactccagcctgggcgacagagggcggggagaaagacggctacaaccccactggcaatggcctacataatgggtttctcacagcgtcctcccttgacagttacagtaaagatggagcgaagtccttgaaaggagatgtgcctgcctctgaggtgacttcgaaagactcgacgttcagccagtttagtccgatctctagtgctgaagagtgtggtgacgacgagaagatcaaggtggatgaccccctgacaaggaggacgtgcaatcaagcttcaggtcgaacgtgttgacagggtcggctccccagcaggactatgataagctgaaggcatttggaggggaaaactccagtaaaactggactctctccatcaggcaatatggagaaaaacaaagttgttaagagagaagcagaagccaattctataaacctgagtgtttatgaaccttttaaagtcagaaaagcagaggataaattgaaggaaaactctgacaatgtgctggaaaacagagtcctggatgggaagctgagctccgagaagaatgacacctgcctccccggcactgcgccatcaaagacaaagtcatcctccaagctctcatcctgcagctctgccatcatggctctcagcgctaaaaaggcggcttcagactcctgcaaagaaccagtggccaattcgagggaatcctccccattaccaaaagaagtaaatgacagccaggcgcggtggctcatgcctgtaatcccagcactttgggaggccaagacgggtggatcatgaggtcagaagttcgagaccagcctgaccaacatggtgaaaccctgtctctactaaaaatgcaaaaattagttgggcatggaggtgcgcgcctgtaatcccagctatttgggaggctggggcaggagaatcgcttgaacctgggaggcggaggttgcagtgagccgagatcacgctactgcactccagcatgggtgacagagcaagactctgtctcaaaaaaaaaaaaaaaaagaagaagaagaagtaaacgacagtccgagagccaccgacaagtctcctgaatcccagaatctcataaacgggaccaaaaaaaccatccctaaagcaaccggataatcccagaagcatctcaagtgagaacagcagcaagagttccccgtcctctcctgcagggtccgcaccagcaatcctcaaagtccgcataaaaaccattaagatgtcttctggggaaatcaagagaacagtgaccagggtattgccagaagtggatcttgactctgggaagaaatcttctgagcagacggcgtctgtgatggcctctgtgacattccttctgtcatctccagcatcagctgccatcctttcctctctcctcagggcgcctctccagtccacggtcatgaccaatgcagtttcacctgcagagctcacccctaaacaggtcacaatcaagcctgtggctactgctttcctcccagtgtctgctgtgaacgaaagtgaagacggcaggatcccgagtcattaatttgaagctcgctaacaacaccacagtgaaagccacagtcatatctgctgcctctgtccagagcgccagcagcgccatcattaaagccgccaacgccatccagcagcaaactgtcgtggtgccggcacccagccgggccaacgccaaactcgtgccaaagactgtgcaccttgccaacattaaccttttgcctcagggtgcccaggccacctctgaactccgccaagtgctaaccaaagctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacattccaaacctgagtcctcccaccaatgcagggatcacgttaccaacgcgtgggtacaagtgcttggagtgtggggactcctttgcagttgaaaagagtctgacccagcactatgacagacagagcatgcgcatcgaagtaacatgcaaccatggtacaaagaacctcattttttacaacaaatgcagcctcctttcccatgcccgtgggcataaggagaaaggggtggtaatacaatgctcccacttcattttaaagccagtcccagcaggtcaaatgatagtttctccatcaagcaatatttccacttcaacttccactcttcagagccctgtgggagctggcacacacactgtcacaaaaattcagtctggcataactgggacagtcatatcggctcctttaagcattcccatcaccccagccatgcccctagatgaagacccctccaaagtgtgtagacatagtctaaaatgtttggagtgtaatgaagtcttcagtatgagacatcaatggctacacatttccagcaggctgcagatacacgtggacaaaagacttgcactatctgccagatgctgcttcctaaccagtgcagttacgcatcacaccagagaatccatcagcacaaatctctctacacctgccctgagtgcggggccatctgcaggtcggtgcacttccagacccatgtcaccaagaactgtctgcactacatgaggagagttggttttcgatgtgtgcattgcaatgttgtatactctgatgtggctgccctgcagtctcacattcaaggttctcactgtgaagtcttctacaagtgtcctatttgtccaatggcatgtaagtccgccccaagcacacattcccacacctacacacagcatcctggcatcaagataggagaaccagaaataatatataagtgttccatgtgcgacactgtgttcaccctgcaaaccttgctgtatcgccactttgaccaacacattgaaaaccagaagttgtctgttttcaagtgtccagactgttatcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcagtggaaaccaagaaagtggccagtcctgggtggacgtgttgggagtgtgaccgcctgttcattcagagagatgtgtacatatcccacgtgaggaaggagcaagggaagcaaatgaagaaacatccctgccgccagtgtgacaagctcatcccacagcctgtgccagcacaaccggatcaagcacaaaggcatcaggaaagtgtatgcctgctcgcactgcccagactccagacgtacctttaccaaacgattgatgctagagaagcacgtccagctgatgcacagcctcaaggaccctgacctgaaagaaatgacagatgccaccaatgaggaggaaacagaaataaaagaagacaccaagttccccagtcccaagtggaagttggaagaaccagttctggagctcaggccttcctgaggagcaatcactcaaccactgaaaaagctgaaaatcaatgtttttaaggttctcaagagtgccatgtgtggcttcaccaccgaaaacctgcttcagttccacgaacacatccctcagcacaaatctgatagttcttcctaccagtgccaggagtgtggcctctggtacacgtctcacgtctctctgtccaggcacctcttcattgtacacaagttaaaggaacctcagccagtgtccaagcaaaatggagctggggaagataaccaacaggagaacaaacccagccatgaggatgaatcccccaatggcaccgtgtcagacagaaagtgcaaagtgtgcgtgaaaacttttgaaactgaagctgccttaaatactcacatgcggatacatggcatggccttcatcaaatccaaaaggatgagctcagccaagaaatagccacagaaggtacatgaggaaaatccctgtccacattggaataaaaaagatatttttgttacaaaaagtttgcagtataataaacagtactgtctaggctgttgcaatatgttctctttcaacgtaccttccttcacctcgttgtatatatcctcgataagtagtaaaacagtatttgagtttcaaagagtttgtatagatttaaatgaataactttttatactgtttgttacacatttgtatcagtatttagtggcaaacgatttgagttgttttgggtcagaatttttctttttgtactgtttctttaaaacagagttcttagtaacaggggcagctcctgaattcaaataaaccattttgtatgtttggattttgaagaggttaactaattacaggctaaaataatgccttttttagtgtttttaatttttagaatacactacataaattgtaagtaattgtgggtctcaaaaaccctaggaacttttaagtgtcttagcacttcctcgatgtgcctgccctgaaggagtgagctcacatgtgagacaactgcactccagtgtgggcgtgcctttttcttcaggccatgcgaagggtgtttaaagcagccttgcaggtcgctcctttcccagccgtggataaaaactgaagccaggaatctaataaggaatgctgatttcctcaattccattttggggcatggggaaggctgttctaaagaaaaaaatgggactggttttctaggcagatctgcaaggctggctttaaaagcacaaggagggaaagtaacgaaagggctggactactataaaagttacaaatacgtagttagaccaatagatttatatagtcaggtttttgtcatgtaatttattaactattacagaaacacaactaagaatatcaagtatttctctggctcttgacagaaaaaaaaatcagttgacttaaccctttgctgtcaaaagagttggcattgcctgttctaggtgctactgccaaatgttctgatacttagagttgggatgcacaacgtcaaccactgacttctcaatgcagccgcctgtgtattgcaattggccgttaccttaagcgcggggccacccgggtttagttcagccatttcaagaagtatatttaacgtcggtagttctgctttattaaaatgcagcagaggtactcttctgtcccttccgtttatagttctctgagagagttctattttttggttttgtttcgtgttttcttttttttttttttttttttttttttgagacagagtcttgctctgtcgcccaggctggagtgcagtggagtgatcttggctcactgcaagctctgctcgccgggttcacaccattctcctgcctcaccctcccgagtagctgggactacaggcgcccgccaccacgcccagataagttttttttttgtatttttagcagagacggggtttcaccattgttgcgggaagtcagggaacccaaacggaggaacctgctgaagccatgacagaagaacatggattatgaagattttatggacatttattagttccccaaattaatacttttgtaatttcttaatgcctgtctttactgcaatctctaaacataaattgtaaagatttcatggacacgtatcacttccccaatcaatacccttgtgatttcctatgcctgtcttgtctttaatctcttaatcctgtcagctgagaaggatgtatatcgtctcaggaccctgtaataattgcgttaactacacaaattgtacagcatgtgtgtttgagcaatatgaaatgtgggcaccctgaaaaaagaacaggataacagcaattgttcagggaataagagagataaccttaaactctgactgccggtgagccgggcagaacagagccatatttctcttctttcaaaaacaaatgggagaaatatcgctgaattctttttctcagcatggaacgtccctgagaaaagagaatgcgcacctaggggtaggtctctgaactggcccccccggggcgtacctgtctcttatggtcgagattgcagaggtgaaataaactccagtctcccatagtgctcccagtcttattaggaagaggaaattcccgcctaataaattttggtcagacaggttgatctcaaaaccctgtctcctgataagatgttatcaatgacaatggtgcctgaaacttcattagcaattttaatttcgcctcggtcctgtggtcctgtgatcttgccctgcctccacttgccttgtgacattctattaccctgttaagtacttgatgtctgcgacccacacctattcgcacacctccccttttgaaaatccctaataaaaacttgctggtttttgtggcttgtggggcatcgcggatcctaccaacgtgtgatgtctcccccggacacccagctttaaaatttctctcttttgtactctgtccctttatttctcaagccagctgacgcttaggaaaatagaaaagaacctacgtgattatcagggcaggtcccccgatacaccatgttagccaggatggtctcaatctcctgacctcgtgatctgcccacctcagcctcccaaagtgctgggattacaggtgtgagccaccatgcccaggcttgttttgtgttttattttgcatttcatatcttacatttatccctgaacatgttttgtacttttttttgttgttaagaaaaggaattcttttgtgtatctatagatacttgcatgatctactgtagtcaacgttcggttcctcaaaaggtcttgctgctgtcaggtgttatgcactccatccataataactgtgtgaaacacatttcatatgtaaataaacgtgggacatttggcccatgtgcttctgtgagagagttattgattgtgagtctctgacatctttgtgaagtttgggaagtgactaattgcagggacaagctacaggatgttgcagaatccttcccactcagaagaatggcatgttctctctcattagtaatcagctattttgtcactttctcattgactccatcagtacatcggtacaatccaagggtgtgaatttcagcttgaaattccattgctattacttgttatgtttgtattgctctaagttgtattcatagcactttcatatgtttctgcatttgaaccttgcaataagcctgtgtggtaggccacataggtccaaataacctagttttacagttgaggaagctgagctcagattcagttctttgctgaagccctcatagctggtaagtggctttgcatattagaacccaaatattttgctctctaaatctaatgctcgctctatgtggttatgtacatattgacaaatattcatttattcaacaaataaaaagtatgtacaaagcatgaaaaaaataaaaaataaaaacaacaacaataaactatagcttctgatctgaacggaaaactaagctgatggaggaaagagagtttcttaaaaatggcagaggagattccaaaaaaaaagtaattctagtcactcaagagaccaaaagacctcatgatcacaaagccacttatgatactaaacactcaaggtaaggggcaaaatttgtagataaaagtctttgtgaagatcatgagacacatatattagaagcaaagaacaacaaagagtcaagtggcaatcagttacttgatattgttattccaccaggcacacaaattgagaaagagcaaattactgggcaagttgagaagaatgctaccaaccctaaaccccagttaagtcactcctctcgactgtcccctgacttaactagagacactgatgaagctgcttttgagccagattataatgaaagtgacagtggaagttatgtatctgtaaaagatgaggaaacttcaggaaacacttctaaggtcctgaaagataagataatggagaaagcaggagaaagcaaaagaaagcctggacacagttggccaggtaggcataggaggagccagagtccgagcagaagtcagagcccttctggaggccagacttgaggccatagcagcagggccagttctgcagaaagttagaatagcaggaagaataataaaaagtaggaaaaggaaaagcacaagaaacattaaaaaaaaaaaaaaaaaaaaccatacatgcaggtactgcaggggaattggaaaaaagccaaaaaacacagacataagaaaaggaagtcaaagaagagcaaaagataaagagaaagataacaaaaaatgaaatctgtcaccatgtaaaaggacagattttttaaatggacttaatggctaagtctgtattcaattttgttattatgtaaagagattcaggtcttgtaaataatgacatggaagactctgtgctgcacttaaaatattgctgcttgattattggatttttacatcagaggttgatgcagtttggatatttgtccccaccccaatctcatgttgaaataaaatccccagtgttggaagtcaggcctggtgggaggtgtctgggtcatggaggtggatccctcatagcttggtgctttctctgcaaaatctggttgtttaaagtgtgtggcacctcccctactctctcttgcttctactcccaccatgtgagacacatgctcctgcttcacctttcaccatgattgtaagcttcctgagacctccccagaagcagatgccagtgctatgcttcctgtacagtctgaagaactataagccaattaaaccatttttctttataaattaaccagtctcaggtatttttatagaaatacaagaattgcttaatacagaaaattggtaccaaggagtgggacactgctatgaagatacctggaaatgtggaagcagctttggaactaggtaatgggcagaggttggaaaagtttggagagctcagaagaagagagaaagatgagagaaaatttggaactttttaaagactggttaaatacttgtgaccaaaatgctgatagtgatatgaacagtgaagtccaggctgatgaggtatcagatggaaatgacaaacttattgggaaatggaacaaatgtcacctttgttatgccttagcagagaacttagcagtattgtgtccatgcgctagggatctatggaagtttgaatgtcaaagtgatgatctacgttatctggcagaagaaatttctgagcaccaaagtgtttaagaagtggcatggctgcctctaacaacataagctcagatgtgggagcaaaggaatgacttaaagttggaacttatatttaaagaggaagcagagcataatagtttggaaatttttcagcctagccatgtgccaaagaaagaaaaagctttttcaagggaagaatccaagcaggcgatggagtaaccacttactagagatacttccttttggtaacaagtatttaaccagtctctatggagcaaccacttgctagagatatttacataactaaaagggagacgggtgctaatatccaaggcaatggggaaaaagcctccaaggcatttcagagacctttgaggcaggtgggaatgtaaactagtacaaccactatggaaaacactgtgaagattccttaaagagctaaaagtagaactaccatttaattcagcaatcccactactggctatctacccagaggaaaagaagtcattatatgaaaaagatacttgtacacatacaaaagatatagcagcacaatttgcaattttaaaaacatggaaccaacccaaatgcccatcaatcaatgagtggataaagaaactgtggtatatatatacaatggaatactacgcggccataaaaaggaatgaattaatggcattcacagtgacctgcatgagactggagactgttattctaagtgaagtaactcaggaatggaaaaccaaatatatgttctcactcatttgtggaagctaagctatgaggatgcaaaggtataagaacgatacagtgtactttggggactcaacaggaaagggtgggaagggggtaagggataaaagaccacaaatttgtttcagtaaatactgcttgggtgatgggtgcaccaaaatctcacacatcaccactaaagaactgactcatgtaaccaaacaccacctgttccccattaacctatggaaatgaaaagatttaataagaaagaaagaaaaaaagagagagaggaagaaagaaagaggaaagaaaaagaaagaaagaacaaaagaaaaggaagggaagaagaaacaaacagattggaaagagggaagtaaaaccatttttgcagaggacacaattatatttgtgtgtaaaaatcctaagaaatacaaaaaactactaaaataagaaaacttataaaaatcataaattacaaagtcaatatcataaattacaaaatcaaatcaattgatttttacatattgacaataaactatagggaaatgaaaatgtaaaatataccatttatacaatagcctcacaaactttaaaataattaggactggatttaacaaaatgtggacacaagacctatatacaaaaagctgtaagccgggcatggtgacatgagcctatagtcccacctacttggaagcctgatgaagaaggattgcttgagtggagtttgagtccagcctggccaacatagaaagaccccatctctatttaaaaatttttaacacaaaaaacaaaataaaatcctgtaaaatattgctgaaataaaataaagaagacttaaataaatagagggatatgccatgttcatggattgaaagactcagtattgttaagacaccaattttctccaaatccatctacagattcaacacaatcccattcaaatttcaacagggttttctttttttttttttttttttggtagaaattcacaagcttattctaaaagctatgtgaaaatacaaagaatctacaatagccagaacaattttaaaaagaacaaagaagacttatactatctgattttaagactttctataaagctataataatcaagacggtaaggtagacccacgatttccatgagcatgaacccactgctgaactttatttgctgtaaaatgaatttcttggccagaagcaaagcagagtgtcataccaccatggtgaataaggcattctttctgtatatggataatagttctggcaggagtattgcaggcagaaaaagcaaaggctggctggttcttccaaggaaaggtgccattgagggctcagctggtctctgctgttcaaaggttggccactcagcagtggtggtaggcattagaccttagtaagtggacagtccacatcactcttgccttggccactttgagcatgaacactttaggtagctgaggaaagaggctggatgatccagaggacagattatcttgcccacttgattattaaaatcttcttctgctgtaattactctaggtgagcattcacatgggatgcagatatcttcacttttgtggccaatctgagaggtctgtccatacacctcttcctcgaatgccttgtgaccacttttccaattgtgtcccttccaagcccagccagctaaaccattagccactgcccataaatcagtgtagatctatatctctggtaaccttttctttcccggaaataaacaatcaggggtactgcttgaagttatgcccagtaggagtattttccttcactactgtccttcagggccacaccagaaagtcctcctatttaaatctcaacacaaacaaaccaactgtaaaaagacattgatgaggcctggcgccgtggctcacgcctgtaatcccagcactttgggaggctgaggcgggtggatcacgaggtcaggagatcaagaccatcctggctaacacagtgaaaccccgtctctactaaaaatacaaaaaattagcctggcgtgatggtgggcacctgtagtcccagctactcgggaggctgaggcaggagaatcacttgaacctgggaggcagaggttgtagtgagccaagatcgtgccactgcaccccagccttgcaacagagtgagattccatctcaaaatataataataataataataaataaataaaaataaatctatctaagaaagcattctaaatattacccggcctcatcagcttatgatctcaaaatacggtcctatttctatttagacccaatttagaatgactgtaaacattacccccatctgccacctccccaagcaggggcatattctcaccctctccagactccattattccaagaagcccacaaaggggttctgcatattagaccacaaactaggcagaagctgacagccatccctatcattttctatcctctgactctctaaacccagctcccacttgtctacgtctactgcctcagaagccacttaaagaggcttaatcattgctgctgttgacaaaaacaaagagaaagaaagtccttgaaaccattccaaattaaaagacactaagatacaagacagctaagtgcaatatgcaatcctgagttgggttctttctatgattgaaatgtttgtgcccctgcaactcccatccttaccatcaaatgttgaaatcctaacccctaaagtgatgatattagaagttagggcttttaggaggttattaggtcatggaggtaagttctcatgaatgggatcagcgcccttataaaagaggccgagagacccctcacccctttaccatgtgaggacacagcaagaagtcaccatctatgagccagaaagcaaggccctcgccagacactgaatctgccagcaccttgctcttggacttgccagtgtccagaactgcaagaaataaatctctgttcataagccacccagtctacggtattttgttatagtagcctgaatgaactaagacagtcttaaactgggggaaaaaatggctataaagtcatgactgagacaactgaaatttcaatatgggctgtagattatagtatattcgtgttaaatttccaaatttggatcattgcatagtggttatgtaagagaatgttctcacacttaggaaatacacactgatgtatttaggggtataaattatcactgaaaattctccccatcaacacagcctttcagccacacaatttccttcccaatagccaacaaatgttatctccttcttggataaatcctcacagaggcatttcatgcttttacaaccaatacatgtcctaaatctcttttataacaaaagtgagaccattctctacagtctattctgcattttgctttcttttttttttttttttttttttttttgagacagagtctcgctctgtagcccaggcttgagtgcagtggcgtgggtttccgctcgctgcaacctctgcctcccgagttcaagcgattctcctgcctcagcctcctgagtagctgggactataggcgtgtgccaccacacccagctaattttttgtatttttagtagagacggggtttgaccatgttagccaggatggtctcgatctcctgaccccccacctcgccctcccaaagtgctgggaggtgatccacccacctcgccctaccaaagtgctgggattacaggcatgagccaccacacccaggctggctgtctttcttaatacagtcatgcatcacttaatgacagggatatggccttaggcaattttgtctgttgttctgtgaacatcttagagtacttacacaaacatagatggaacagcctactactcacttaggctatgtggtaatgcctactgctcctacactacaaacctaaacatgttaatttacagaacactgtaggtaattgtaacaaaatggaaagtatttatgcatctaaacacacctaaacatagaaaaagtacagtaacaatatggtagaaaagattaaaaacggtatacctgcatagggcagctccattataatcttatgggatcaacattatatatgtggtccatcactgacaaaaacattagttaggcagggcatcactgtaatcttgaagatcaatccacatcagaacgtgaagtgcctcctcattattttttaccactacctagtattccactgtgagatgtaccataactgaagcaggccccattctctggatactcagcttgtttccaatcttttgctatcccttattaacatctgtacaatagcaaacatcaagggacccaggaagattgggaacataaacatatagtaaaagtatgacattaatatgtcattaataatttcattaggaattatattttaaatggatactaagaaatgcaacgttttatgttatgagtcaggaaactagatgtgtgaaggaatgattgatgagtatgaaaaaccaagaatgtgcctgtaatcccagcactttgggaggccgaggcaggtggatcacgaggtcaagagatcgagaccatcctggccaacttggtaaaaccctgtctctacaaaagtacaaaaattagccaggcctggtggcatgcgctgtagtcccagctgcttgggaggctgaggcaggagaatcgcttgaacctgggaggcggaggttgcagtgagctgggatcctgtgactacacttcagcctggtgacagactgagactgtctcaaaaaaaaaaaaaaatagaagaagaaaaaccaagaatgattgtgaggaggtcaatgttaacagttctgtgtattaactattaaataaaccttcctggaaaagcatttgaatacaatgagttgttttttttttttttttttggaaaactattccagacatgaaacccaaatgacaattaagaatactagtaaaacaattgatggtggtgttgttattgtgccattaatgaaagtactgacaggaaaaggataggactttgcgttcattaataaaagatctaaaaaaaaccataatgtcctataattaaaacaacaacaaataaagttaccttttacttcactctgccaaataaggctatactggaagagaaagaggtaactattgacctgagagtgaagactggagtataaatgtacatatacatacctatatatacactgagactatgtatttggggattgtaggactcttttggttggtaaaaattaattccgtatcacttttatcctcaggttcttttttcctcaggtatttttccttaggttcttgaatttcaaaagatagtaacttaatttgacatacacttagacaatatcccaagagcctaaaaccacataggcaacttatcctgacctaaaatcctctcttcttccaggaatcagagtctagtaactgtcctctgccagcagactcagcactttctcttttattacaacggccttttgtggattttcactcctcggactagacagttggccctttgaaggtagaatccatatcttaatgatccagctgcacagaatgtattcgagcaagcgtagtgtcagctcctactctccagaagcagcaagcacaggctctgtccagtgtccactgtccagggccagcggtgatagtggtgcaagttgcagcatctatgccagcagcgatggcattactgtcttcactgaagcagttctagcctatgatttgggaggctggccttgaacatgaagccacctagcttaattttccggtcttattggtcagaataggctaggtcatcccatgaaacaaataaattccaacatttcagcagttttgctttccaatcacacacgggtggaggcgggttggacagcttgtctgggcggtgcatctccaggcagtgactcatgccctgggctgttcctagtgtggttccagcatcgcagctccttctctttcacaggaccatgagagccaaggatatggcaagaaattttagggacaggcctggaaacactatgcattaatttccccttatgctccgtcggcctaactgaaaggcaggctgaaaaacctcatcttcctatgtgcttaagaagcagaaatgggactggggaggatccagccagggtttacccttcaagaaattttattcttccaattttggtatgtggtatatgtgagcactctctcagagattttatgagccacctcttatcctttcagaggttcattttctgatgaccccagccaagattggtttctattgtctgcaactaatgtccttgactgatagaaagatgggaggtccaataggatatactgttcaggagcacatacctgcactcaaactccaggctcttgctttactaaacttcacacttttggcaagtgaccgggcctcatcttccataaagtgcagagaataatagcatctaccctatgaagttgttgtgaggatagagtaagttaatgcgaggaaagtgcctagcacagctggcctgcagtaagtgctcagtaaatggtatccattatttatcctcccaaggtatccagccttcagaggcttcctggaggaggtactcacaaagatttgaatgattgtagaggactgggcagaagaaggggtcttataggaaaatgagcttctccaggcatgatagatgtgttatctttgttttgggtttttacagtttgtttgttttagagacagggtctcactctgtcacccaggctggagtgcaatggtgtgatcatagctcactgcagtctcaaaatccagggttcaagggatcctcccacctcagcttcccaagtagctaggactataggcacacagaaccatggccacccagctgactgagatgtgttatttttaaattaatgggtgctgagcactgaagaaagagccatccagtgtttgagtattcccatcatgtgctcaagggaacctccttgcctgggtcccatttatcttctcctttgaaagtcagatttgggggagtttgactcatggacaaggtctgtgcgcacgctgtcttttagctctgggatgggggtggtggtgggcaagcccttcccgggtaaggcagagcctgtggggccagtgcctgtgtgaagacagcaaggacactggcaagcacacaccaggcagggttcaggctcgggcttagggtgtccggaaggggaatggctattctgaaatcccaagtctaagctgaagaccttcctcaaagcctcaggagatccggctcacggtggggacaagtatagagtatttgtttcacagcagcagtgagcaggccttcatttgcttctgtgtttttcaagtcacttgttggggtgtgaaaatcccatccctagattctccactaacttcttcactgtaaatgcagaagccccaaaggagccaatttcatgtgccagagcccaacaggcctgggctcccatcctcagtgtgttatcatggaagacaaggcaatgacaagcaaatggtctttctttggggacagttgtaaagcccttgagtgataagccccctccaatggaatgtggcccttcctatcaagaacagctccaggaggccgggcgcagtggctcatccctgtaatcccaacactttgggaggccgaggcgggtggatcacttgaggttaggacttcgagaccagcctaaccaacatggtgaaatcccacctctactaaaaatacaaaattagccaggcatggtggcaggcacctataatcccagctacttaggaggctgaggcaggagaatcgcttgaatccagaaggcagaggttgcagtgatctgagatcgtgcctttgcactccagtctgggcaacaagagtgaaactccatctcaaaaaaataaaaaagaacagctccagggaatgaatatagtgtcaggtcgagtcctctttctctagagagggattttctaaatatgaaagaatcgaggttcctattttgaccatgtcttcttaaaggatgacagtccaagttctcactgaaacaacagtagtaggcagcagaaagacagtgcagagggaggggaagaagtagaggtatggacttaaggactgggtgacatggccagggaaatggacattaatactcaacaggctaagtcaaggatgtttaatgtgcccatcccactgctgggtttcagggagctgaagggagcaatgggccagcactgaggttgagatctgattttgtcctttactagccttggagccttggtccatgttaactgtctgagcttcggtttcttcatttatcaactatagataaaattccttgccctggctgcttcacaggattctcatgatgaactaaaacacacagacacatagacacacacacacacacacacacacacacacacacaaaacactttataaagcttgataatccagaaggggttgttttaaaacaaagcattattattatagttgaagttaagataaattctagctctctgggaacctacagtccagttgtagaaataaaatacatgaaattaaaatacataagtagcaaataatggcaatctgtgctcagcacgagatagtgttatcaaacccacattcagtaagttttctgagagtcagatgtagagtgaatcaggtagaacaaatttcatagaagtggtggtaagaactgaaatgggtcctagaaaaaaagaaggttgtagaaaaattgcaagaaggaaggaaggcaattgcgtgtgtgtgtgtgtgtgtgtgtgtgcattttaagctgaaaagctcaaccaggacatacactatgctaggctagagatgcatactctgactgtgaaaggtaagaaataggtctaaagcagagataggaaaactacagccccacgagccaattttggtacaagctgtaagctaagaataatttttacacttagaaaatgttataaggaaaaagaaaaaaaggaggagtgacacagactttgtgttatatttccttataacagaaaatgttataaggaaaaagaaaaaaaggaggaggagtgacacagactttgtgccccacaaaatctaaagtatttactatctgtccctatacggaccaatatgtacatgacgattcaatgacaatgaaaatacaacatattcaaatttgtgtggtgcagccaaaacagtgctgatagggaaatttatagtactgagtgaaatgtttatattagaaaagacaagaggccacaaattaatattacaaggtcctatatcaggaaactagaaaaataagaacaaactaaacaggggccgggcatagtggctcacacttgtaatcccagcactttgggaggccaaggtgggtggatcacttgaggccaggagttcaagaccagcctggccaacatgatgaaaccccatctctgtaaccccagctatgtggaaggctgaagcacgagaattgcttgagcctgggaggtagagattgcagtgagctgagatcgcaccaaatccttgaaatcctcacatgcactccagcctgggcaataaagcaagatcctgtctcaaaaaacaaaaaaaagggaaaaaaaagaaaatgaaacaaaaagcaaacagaaggaagaaaaaatgacaatagcagaagtaaatgaaattgaaaaaaatacatagtaaattaatgaagcaaaaactggttatttcaaaaaatttgtgaaattgacaaacttctattgaggtgggtggatcacttgaggcctggagttcaagatcagcctggccaacgtggtgaaacccatctctactaaaaatcaaaaattagccaggcatggtggtgcacgcctgtggtcccagctattcgtgaggctgaagcacaagaattgcttgaacccaggaggcagaggttgtagtgagctaagatcacaacactgcactccagcctgggcaacagagtgagagtttgtcaaaaaaaaaaagaaaaaaaaaaaagactgacaaaggcaaagagggaaaatatagtatcagaaatgaaacaagagatataattacagaccctacagacatcaaaaggataataaaggaatactacaactttacacacataaatcttgacaattttgataaaatgaaccaaatccttgaaacccacacatgaccacaagtcaactaatatggtataaaaagtttgaatagcgatataactattgagaaaattaaacccctaattttaaaactcctcccccaaccaaatctccaggcacagatgccttcaccactgaattatgccaaattttaaagaagaattaactccaatgctacacaatctcttccagaatatagaaaataaagaaacacatcccaatttattttgtaaagttaatattaccctgatgctaaaaccagacaaatatatttaaaaaaaagaaaatgacagatcaacagccctgatgaatatagaaataatccttatttaaaaatagcagagaattcaataatatccaaaaagaattatataccaccatcaagtaagggttatttcaggaatgcaaagctggttcaatatttgaaaatcaatcaaggtaatctaccatattgccatgctacaggaaaaaaattacatgattatgtcaattgatgcaaaagaagaattttacaaaatttgacactcatttataataaaaattctcaaaatacttaagagggaaactttctcaaattagtaaagatcagctacaaaaaaaaaaatctacagataacatcatatataatggtaaaagatggagtactttctccctaagattagacacaaggatgtcttttatcacttctagtactggaagggctagccagtataacaataaaaagaaaaaaaaaaaaggaaataaaggctagccctggtggctcatgcctgtaatcccagcattttgggaggctgaggcgggtggatcacgaggtcgggagttcaagaccagcctggccaacatggtgaaatcctgtctctactaaaaatacaaaaattagtcaggtgtggtggctcacacctgtagtcccagctactcaggaggctgaggcaggagaatcgcttgaacccaggaggcggaggttgcagtgagccaaaattgcacctttgcactccagcctggtgagagagcaagactctgtctcaaaaaaataaaagtaaataaaatacataaaaatcaccaagaaaaagttgtcctatttgcagatcatatgatcatctataaaaatcctcagggaggcggggcgcagtggctcacacctgtaatctcagcactttgggaggctgaggtgggcggatcacgaggtcaggagatcaagaccatcctggctaacacggtgaaaccccgtctctactaaaaatacaaaaaaaaacttatctgggcgtggtggcagacacctgtagtcccagctgctagggaggctgaggcagaagaatggcgtgaacccgggaggcagagcttgcagtgagccgagatcgcaccactgcactccaacctgggcgacagagcaagactccatctcaaaaaaacaaaaaaaaaaaatagaaatcctcagggaatatacctaaacaaaacaaaaccaataaaatcatccaactcctaggaattatggtaagactgaaagatacaagttcaacatacaaaaaacacttgtattactatatatccatggaaactgaaatttaaaataccatttatgactgtaataaaaatttctaatacttaggtgtgaatatagcaaaacctatacaagactgaatgtaaaaaatgacaaaatgctgatcaaaaaaattaaaagattaaaataaataaagagaaatagagacatagcatattcatgggttacaacacccaccatgctgttaatatatacttttgctacaatttctataaaaattacagatatacacaagattatttgaaaatgtatatgggaaggcaaaggaacttaaaaagctaaaacaattttgaaaatgaagactaaggtaggagggataattcaacccaattttaagacattgcatagctacagtgatcaagactttgtggtactggtggagtaatagacacatagatcaatggactagaagaccccaaagtagccctgtacaggtacaatctactgatttttttaaggtgcaaaagtaatcaaatgcaggaagaatggtcttttcaacaaatggtatttgaccaagtagacatccataggcaaaaaatgaacctcgacctgaacctcacaacttatatgaaaatcaacttaaaatatttgcaaactactcatctgatagaggattaatatccaaaatatacaaggaactcaaacatctcaacagcaaaaacaaacaaacaatccaattaaaaatgggttataaatttaaatgtaaaactataaaacttctagaagaaaacacaggagaaaatctttaggacctagggcttggtgaagagttcctggtcatggcattaaaaacacaattcgtaaaagaaaaaaaaaggttaagtagtacatcatcaaaatttaaaactttaaaagaaagaaggcccaagcaaataaactgaacgacaaaaaaaaaatgagacatcacaaaggatagcacagaaatacaaaggatcattagagactattatgaaaacctatatgccaataaatctgaaaacctagatgaaatagacaaattcctgaacacttacaacctaccaagactgaatcaagaagaaataaaaaaaaaaaaactaaacagaacaataacaagtaatgagattgaatcagtaataaaaagtcttccaacaaagaaaagcccaagaccagatggcttcatcattgaattatactgaacattcaaggaagaattagtactagtccatcttaaactattcccaaaaattgaagcagagtgtattcttgctaactcattctacaaggccagcataaccctgataccaaaaccagacaagaacacaataaaaaaaaaaaaaaacgtacaggccaatatcactagagaacattaatgcaaaatctctcaacaaaatactagcaaacttaatttaacaacatatcaaaaagaaaatacaccaagattaagtgggatttattccaggaatgcaaggatgtttcaacatacgcaaatcaataaacttcatacatcacatcaataaaatgaaggacaaaaaccatatgatcatctcaatagacacagaaacagcttttgatagaattcaacatccattcatgatttaaaaaaaacctcttaattaggtatagaaggaaagtacctcaatataataatggtcatatataacaaacacacagataacatttaactaaatggggaatagctgaaatcttttcttctaagaactggaacaagacaaggatgcccactcttaccactcttattcaaggtaatactggaagtcctaaccagaccaattagacaagacaaagaaataaaagacatccaaatgggaaaggaagtaaaattgtccctgtttgcagataacatgatctcgtgtacagaaaaacctaagtactcttaaaaaaaaaaaaaaacctgataaacaatttcaccaaagtcacaagatataaaattaatatacaaaatgtgtgtttcgatatatgaacaatgaactagctaaaaagtaatcaagaggacaatttcatttacaatagctaccaaataaataaaacacctaaaataaatttaaccaaggaggtgaaaaacctcaacaaaaaaatctccaaagcagttatgaaaaaaatagaaaaagatgcaaatggaaagacattccatgctcatggatcagaaggattaatattgttaaaatgacaatactacccaaagcaatctatagattcaatgcaatccctatcaaaataccaatgatactcttcacagaaacaggaaaaaaatcctaaaagttgtatgaaactacaaaaactccaaatagccaaagcaatactgagcacaaggaacgaagaaaaaagctggaagtatcatactaccagaactcaaaatctactacaaacctttaataaccaaaacagcatggtactggcataaaaacacatagaccaatggaacagaattgagaacacagaaattaatccacatatctacagtcaactgatttttttttaagttttttattttaagttccagtatacacgtgcaggatgtgcaggcttgttgcataggtaaacgtgtggcatggaggtttgctgtacctatcaacccatcacctaggtattaagcccagcatgcattactgatgctctccctcctgctgcccacgccctgacaggccccagtgtgtattgttcccctccctgtgtctatgtgttctcattgttcagctcccacttgtgagaacatgtggtgtttagttttctgttcctgcatcagtttgctggtttctagctccatccatgtccctgcagaggacatgatctcattcctttttatggctgcatagtagtcgatggtgtatatgtaccatattttctttatccagtctgtcattgatgggcattcgggttgattccatgcctttactattgtgaagagtgtacaacagccaactgatttttgacaaaggtgccaacaatactttttaggaaaagaacagtctcttcaataaatggtgctaggaaaattggatattcacatgaaaaagaatgaaactagaccctcacctctcatcttttttttttaagacatctcactctgtcacccaagctggagtgcagtggcatgatctcggctcactgcaacctctgcctcccaggttcaagcaattctcctgcctcagcctcctgagtagctgggactacagtctcgtgccaccacgcctggctaatttttgtatttttagtagagacgaggtttcactgtgttggccaggctggtctcaaactcctgaccttgtgatccacccgcctcgacctcccaaagtgctgggattaaaggtgtgagccactgtgcccagctacctctcatcctatgcaaaaataaattcaaaatcctaaatatgaggccaaaagtgataaaacttctagaataaaacaggggaaacacttcaagacattggtctgggaaaagattttatgaataagactgcaaaagcacaggaaacaaaagtaaaaacaaagaaataggagtatatggtaaagtaaaaataaatcggtttacaaatagtatatggtatatggtataaacaaatagcatatggtataaacaaatagtatatggtaaagtaaaaataaacaggagtatatggaactacaaatcttctgcgcagcaaaggaaacaatcagcaaagtaaaaagacaacctacagaatgggagaaaatatttgcaaactactcatctgataggggattaatatccagaatatacaaggaactcaacagcaaaataataataatcatccattaaaaatgggcaaatgatctcagcagatatttctcaaaagaagacatacaaatggccagtaaatacattaaaaattctcaacgtcactaattatcatggaaatgcaaatcaaaaccccagggaggtatcatctcaccccagttaacatggctattatcaaaaaataaataaataaataaataaatagcaaatgctggcagggatatagagaaaagggaatacttatacactactgatggggatgtaaactagtacagccactcgggagaacagtatggaggtcactcaaaaaactacaactagaactaccatatgacccagcaatcccactgctgagacaaagggggattgtgggactactatccccagccctggaaactctgctttgtcaaaaacttagccaaaggagacaacaaatcaaagagcggctgttcagtagcaccacactgtaggaggtacattccacagcaacccccactccccagcacaaacccccagccagcggtcccacactgcctggacaatccctttgggacctccctcatttggctctgaccatttactagagccaacgtgaacttgggcttgaggcgccatctacagccgaaatggaggcagcgacctactagcaaagatttgctaagctgatatattcaataaaaaacaaaagtgaacggagaaaattggaataaataactaacccttcaatgcaaagacgtagatggatactcacaagaaacaacaacaaacagggaaccatgacctccccaaaaggaggtcatgagacaggtaagttcttatcaataacagcactggaagtaaactgtctcaattctctaattaaaaggcatagagtggctgatatagttgaatatttgtcccctcctaatctcatgttggaatttgatctccaacactggaggtggagcccaatgggaagtgtttacatcacaggggtgggtccctcgtgaatggcttggtgtcatccccttggtgatgagtgagttctcactctattagttcatgcaagagctggttgtttaaaaagaatctggcacttcctttctctctcttgctccctctcttgccatgtgatatgtctactacctctttgccttctaccgtggatggaagcagtctgaggccttcaccagaagcagaggctggtgccgtccttcttgtatagtctgtagaactgtcagccaaataaactccttttctttacaaattacccagtctcagatatttctttaaattacaggggtgtccaatcttttggcttccctgtgccaagaagcactgtgctcagccacaaataaaatatactaacactaatgatagctgatgaactttttaaaatagcagaaaaatctcacagtgtttcaagaaagtttatgaatttgtgttgggctgcattcagagctgtcctgggatgcatgctttataacaatgcaaaacagactaacacagtggctgaatggataaagaaacatgaccctactatatgctaccttcaagaaacccatttcacctacaaagtcacacacagactgaaacggaaggggtggaaaaatatataacatgcaagtggaaaccagaaaaggctaggtgtagttgtaattatatcaggtaaaatagactacaaatcaaagactgtaaaaaaaaagacaaagaaggttactatataataataaaggggtcaattcttcaggagcatatcacaattataaatcgctatgcacctaacattggaactcccaagtaaagcaaatgttaataaatctaaagggagaaatagactgcaatacaataatggtaagagactttaacaccccactctcagtaacagataggttatccagacagaaaaccaacaaaaaaagtagtagagttaggccaggcacggtggctcacacctgtaatcccagcactctgggagccccaggtgggcaatcacctgaggtcaggagttcaagactaacctggccaacatggtgaaaccccatctctactgaaaatacaaaaaaaattagccaggcgtggtggcacgtgtctgtaatcccagctacttgggaggctgaggcaggagaattacttgaacccgggaggcagaggttgcagtgaactgagatctggccactgcactccagcctgggtgacagagcaagattctgtcacaaaaaaaaaaaaaaaaaaaaagaaagaaagaaatagtggaaatagtggactgaaactatatactagtcagcctgaccaacatggtgaaaccccgtctctactataactacaaatattagctaggcatggttgtgggcgcctgtaatcccagctacttgggaggctgaggcaggagaatcacttgaacctgggaagcagaggttgcagtgaaccgagatcgtgccattgcactccagcctgggtgacaagagcaaaactccatctcaaaaataaataaataaataaataaataaaaataaatgaaaccacatactagggcctagctgacatttatagaacatttcatcagctgctgcaggatacacattcttttgatcagcacatggaatattcttcagaatagatcatatctcaggccaaaaaacaagtctgaacaaactgtaaaaatagaaatcacatcaagtatctttcctgatcacaatggaacaaaactagaaatcagtaacaagaggaacctcagagaacacacaaacccatggaaattaaacaacatgctcctgaatgaccactgggtcaatgaaagaatattaagaagaaaattttaaatatttttgaaacaaatgaaaatggaaatacaacataccaaaatctatgggatacggtaaatgcagtactaagaggaaagtatttagcaataagtgcctatgtcaaaaaagtagaaagacttcaaataaacaacctaacaatgcacctcaaggaacaagaaaagcaagaacaaaccacgcccaaaattagtagaaggaaagacataactaggatcagagcagaaataaatgaaagtgagactaaaaaacgcacatcaacaaaatgaagtttttttctgaaaagataaacaaaattgacaagcctttagatggactaagaaaaaaagacccaaataaacaaaatcagaaatgaaaaaggagacataacaattgatatctcagaaatacaaagaatcattagaggctatcatgaaaaactgtacaccaacacattaaatcaggaagttaacacagattcaatactataatgaatctataggccttattcaaatttcaccaatgcctcttaatttaatgttatgtttctggcccaggatccaatcaaggccaccacattgcatttagttgtcacatgtccctagtcttccaatttgagacagctcataattttgacacttttttgcaaaacattattttgcacaatgtttgtcaacttgcttgtgtctgatattttctcatcattaggttgtagttatgcaattttggcatgaacactacagaaaccatgttgtgcccttctcagtcttatcaagaggtacaagatgccaatatgtcttatgactcatgttaatttttagcaattggttaaggtgatgcttgtcacatttattaactgtaaagttactatttcccctttataattagtatcttctggagacatattttgagaccaatcatatctcttctttttcattctatttttgcccactaattttagcatctattaaccctttttctgtttacaaaattaaaaagtgcagccgttgccagcgctcattaaattttacctaaacacactttttaagtttggagcaaatctgactggttttcaatgtaaaaataaaatacagttgggcgtggtggctcacgcctgtaatcccagcactctgagagactgaggcaggtggatcacctgaggtcaggagtgtaatcccagcactttgagaggctgaggcaggtggatcacctgaggttaggagttcaagacacggtgaaacccagtctctactaaaaatacaaaaattagccaggcatggtggcaggcacctgtaatcccagctacttgagaggctgaggcaggagaatcgcttgaacctgagaggcgaaggttgcagtgagctgagatggctccactgcactgcagcctgggtgacagagtgagactccatctcaaaaaaaaaaaaaaaaagaaaagaaaatagaaaatataaaaattgttcttggagttaattctaaacagaactaacatcagaatcatctgaatcataaaaatcatctatttcagacaaataaaattcaccaaatgaatctttggccaacagctctttgagaacaatgttaacatcactcatagacatcatggtgtggggggcagaggaagggatagcattaggagaaatacctaatgtaaatgatgagttaatgggtgcagcaaaccaacatggcacatgtattcctatgtaacaaacctgcacgttgtgtacgtgtaccctagaagttaaagtataatttaaaaaaagaaaaagaaatgctacatttgccgggtgcagtggctcatgcctgtaatcccagcactttgggaggccgaggcgggcagatcgcctgaggtcaggagttcaagaccagcctggccaacatggtgaaaccctgtctctattaagaatacaaaaattagctgggcatggtggtgggtgcctgtaatctcagctacttgggaggttgaggcaggagaatcacttgaacctgtgaggcagaggttacagtaagcagagatcacgccattgcactcccacgtgggcaataagagcaagactccgtctcaaaaaaaaaaaaagctacattttctaggatttgacatttttagcaattgagaattactatattttgtcaatggaaatatcactactaaaagcagaatgctataaataggatgatgtcttttttttttttgagatggagtcttgctctgttgcccaggctgcagtgcagtggcgcaatctcggctcactgcaagctccgcctcccaagtttatgccattctcctgcctcagcctcccgagcagctgggactacaggtgcccaccaccacacctggctaattttttttgtatttttagtagagacggggtttcactgtgttagccaggatggtcttgatctcctgacctcgtgatccgcccgcctcggcctcccaaagttgttcttaatttttattgttctgatggctaatgacgttgagcttgagaattctttatgtattcaagatatgagtactttgtcagtaatttccaattattttcttctagtctgtagctcgccttttcatctttgtaaagagcaaaagtcttttacagagcaaagccttttaattttcttttaaattgagacggagtctcgctctcacccaggctggagtgcagtggcgcaatctccactcactgcaacctctgcctcccagattgaagcgattcccctgcctcagcctccgagtagatgggattacaggcatgcggcaccacacccagctaacttttgtatttttaatagagacaaggtttcatcatgttggccaggctggtcttgaactcctgacctcaaatgatccacctgcctcggcttcccaaattgctgggaatacaggcttaagccaccacgcccaacctaagccttttaatttttaaaaatgttttccagggtgatcatttcctttcttttaatttgcattattttgaatgttcatagaagctttattcattttttgattgactatcaaaaaatattcagatgtggtggcagatgcctgtaatcccagcctctttggagactgaggcaggagaatctcttgaacccaggaggcagaggttgcagtgagctgagatcgcgccattgcactccagcctgggtgacaagagcgaaactccattgaaaaaaaaaattgtctccaaacactagagtaactgtacacaaaatgtagctctgagctgcgcagccaaagcagggaagggagcagatgagtgacattagactctttgactagtacaaagatatttataaatatatgtacaaataatcattgtacatattcattggggttcatagtgatgttttgatagaaatgttatcatgattagatcagggtgattagcatatccatcatctcaaacattatcatttctttgtgttggaaatattcaatatcctccctctagctatttgaaactatatattgttattaactacaaccttcctacagtgatacagaagactgtaacttttttaaaaattaccttttatttgagtatttttaattgagataaaatatacatatataatttaccacctttaccatttttaagtgtacagtttagtggtaatgaagatgtttatttatttattccccctccttcctccccttccccagcctctggtaaccactaatctactgtctatgaggtgaagaggaaaggtctaagatcgtttgcacatgttttcttccattctacaggttccctcttcactttgttgattgttttctttgctgtgcagaagcttttttagtttgatgtaatccaaagtatcattttgggggccacgcatggtggctcacacctgtaatcccagcactttgggagcctcaggcgggcagatcacatgaggccaggagtccgagaccagcctggccaatatggtgaaaccccatctctactaaaaatacaaaaattagccgggtgtggtggtgcacacctgtaatcccaactacttgggaggctgaggcacgagaatcacttgaaccagggaggcagaggttgcagtaacccgagattgcaccactacactcgggcctgggtgacagagtaagactctgtctcaaaaaaaaaaaaaaaaaaaaaagtccaggtactgtggttcacgcctgttatcctagcactttgggaggctgaggtcggtggatcacctgaggtcaggagttcgagaccagcctggccaacatggtgaaacccagtctctactaaaaatacaaaaattagccaggtgtaacggcggatgcctgtaatcccagctactttggaggctgaggcaggagaatcgcttgaacccaggaggcaaaggttgcagtgagccgagatcgtgccattgcactccagcctgggcaacaagagtgaaactccattgaaaaaaaaatcatttttgctttggttgcctctgcttttcatgtcttacagaaaaaaatctttgctcagaccaatgtcctggagcattttcccaatgttttcttctagtagctttgtagtttcaggtcttggatttaagtctctaatccatttttattttatttttgtgtatggtgagacacaggagcctagtttcattctttccaggcccatccccaggagatttggtaaggactggggcctgggactcagcatttaaaacaaatattctagatgattctgattcaggtgtcctgtgaccacacttcggaaaacttgccctaggtgaagtttggcattagatttctcccctggatcagaatcaggctgtgtttgaccatctgatagggatcctgaaacatccccaagcctagcatttctaatatagggctggaggtgacattggagcaattgatgacacagagtgtgatgtaaaagatcacaaatggatcagagagaggatacttgggttttagtcccagcctggaagactctgaccaagccttgcctcgcttctgtaaaatacagttaaacagtcaccgccccgtcaaccccagcaagcaggtgagcaccaactgaaagttcctgaataactgtcatgggcagttgggaggctcagccccacccatgttgccagggaaaccagacctcctgagccgggactagactctcaggctcagtggccagtgtgactcgatccactgaagaggaaacctgcaaaaagagctaccaaagaagcctgcaggggtgctgcccctggccctgaggctggagagagtcttgaagatgaggagaaagggagaagggcagtcccttcagggcttagggaaccaggccctaacagaagtccaataaatgcaggtctgtttgaagacctgaagctgtctttcagaaactgggtctgaagaagcctcacagctgttgccaggcctgggagagctgccatcagaggccgctgctgcggagaaagtccttctgctctgtcctgaaggggagaaggccatgtcaccataggtctcctgctgggggtgggccaggattctcagcaaggaggtagaaatgaccagggcaatgacaacatggggattcacatggacctatgttaatgtatcaagaatagtcggaccaaagcttgttaacacagaataaaacagggaaaccaaaaagtagtggagagggaatagagaaatataattccaaagaaattgcctccaaacactggagtaactgtacacaaaatgtagctctgagctgggcagccaaaacagagaagggagcagatgagtgacattagactctctgactagtagaaggaagcattagtatccatttctcagaaaagaaattgctttcctgactcctgagcaaaggcagcaaaccacagtcccttctcatacttcttaatgaagaattcctgaaccagggattcagcattcatagcaaagggaagtcttaccccagagggaggctagtgagggacaccaaatcaaagaagacaacagtttatttaggttagaaggaagaacaaggctgcaaagctaatgaagcttggcttcaggatcgcacagttacaggtccttccctcacattctctcccctttctccgtccaccagggcaaactagagatttaagttttcgcttttgttgactttacaaactcaattcatgggtacagatggggatttaaaaacaaaaacaaggacctggagcagtggttcatatgcctgtctgcactctgggagctgaggcaggaggatgactggaggccaggagttcgaaaccaggctggacaacatagtgaaatttcatctctacaaaatttaaaataataataataataataaccaggcatggtggcacatggctgtagtccctactcaggaggctgaggcaggaggagggtatgagttcgagcccaggaggttgacgttgcagtgtgctatgattgtgccactgcagtctagtctagggtgacattgtttaaaactgttcaaacacacacaaagtgaaaattgtaagtgctcttctaaaagcattgcatgttggaaaattagactaggaggcactttgacatctttttagaccacagatttctggggaagccagaaaggagctggggtggcaaaactaggagcacaaggaatgcctcattagctgtgctggggggccaagggtgtggagaataagccaggcaccaggaaaaggcagctgccattctctcgcatacccggcacaccttgctgggatgttggtataccatgggtaaaatgccaaacctagcgccatctcttctttaaccccctacagtactttgtttgtacttttcttagggtactcatgttgcccgcctccctttatagatgctcatatttaatccttccaaaaacatgtgccctgatgccaagggcaagatcttccccgcctctgcatccaggagctctgaagtctacacgaatggaaatatatattcaaaatacgtattcaacataccattggggatttgatccaaatggaaatcaaagaaataggagactcagtgtgagctctgagtatgtttccaggcttactgaataagacactataagtagctctaaccctgcagatcagttaaactgcagctgagagctgcagatgatcagaatggtgggtgcaagtttatgtggggtcgaagttcataatattgaaagaacttctttagaaaaaaaaaatatatatatatagttacaaatatataataaggtccaagccttgggggtgtgaggccctgaagttgaaacttcaagaacttcaagggtaaatagcctgtggtctttgcaagtggctggcgaaggtgtcaaagagatgggactcacccttgactgagcctggaagactgggcagaatttggaaagacaaaataaaaagggccgtgtggcaggatgaacaaagacatttaatattgccagaggcctgcttggggagcccgtgagcaaaccagtccaattggacagaaacgttgcaaagtccaggtggaaagaggaaggctggaaagtcagctgaagtcagttgggggtggtgggggtgggccttgagtgtaggctgacatctgaattctatttcactagttataggagccatggatgtttattttttaaatgcagttcattgacttgaagaaaacaatgtcttaggaagattagcctggttttattgttcaaggcaatgaagcaggaggcacttacaaaagtccaggcttgggtgataagggcctaaacttaggctgttgatgaaacccaggttgtagccgtgcgaatgaaaaggaaatacctaactcagtggattttggtgatttttagagaccaagaagagaaggattccaagatgattgaggtttctgctgagtattagagaataactgtatcattaagagatatgagaaggttaagagggccagatttgaaggagaaaatagaagtggaggattttagatatttcagactagagatgatgggagaactatgaattttgagatggtcttagggaactgagggctggagactgatttggtaatcagaagcacccatttattcattcatgccataggaatttggctggtaacctctggaaaaatcagccctgtgttgcatgtcaaaagggatgtaacagatgaagtggtccctcccttcagtgagttaaatttaggatctcaagagagaagagatggaggtgaaatgagtgaagtaaggcagggtctattgtgtacaagaatgagcgacctaaatgtgggggaagagttggctgtggcgtctgtcacctactggtttccaaagagtattagactcagctgactcaccatgtgtatcccccatccactgtatccctctccaaatggcaggcttgtctgaagagaacaatgtccatagaggttacaactgccctctgccccctgagtaaaatgagttgtacagacaataaatatgatgccgttcatgaaattggagggaaactcccggatcctggagaagggagaactagatctgaacctgtgaagacgagcagtttgcataagtggaggggtgtagaggaagctgccttccaaaaatggcagctacaaaaaaatagggaggatgtttcctaggaggtggaggagatgtaaccccatggggaagctcaactgacttttctcatgctgttccctctgttgagaatggctgaagccaagaagccagtgtcagaaactaaagaaagggaaacaagagtcgaggtggaagataagggtacagggttgagagaggaatgggtgacaactccacgattttcaagtgaagctgaacccccaacttccaacttcttgtttacgtagcagtgaactgcctagagctgttttttgcagaatcgtatagagttgacctcatgcatgtttctttaacttctatcactgacgtgtgtttcaatttccttgtttcatgataccctttcttaagcttacgtgaatatgtgtaatacatttttaaatgtgacatatgttaattttaggcatgtcagagtaaaacagccactatcaagggaaatctgaaatctgaaatctgcagggtttgatcttcctctcagtaatttgacatcaaactgtgtgtcccatacttttaagaaaaaactgtttgtggtatacccgcaaatcacgggagatcatacatatctgaaggtgctgtttatgaaactacattactctcaaactccttggctgcctgttttttgtttgttttgcctttaataggagttttctttacttatatgaataaagtgaagacagggaggaccaaaaaaaagaatacagtcacaatgaaattaactttgctacttattcctacttggccaccaagatacaatagatgttgaggctgtgagtaggatgagggtttgtagtcatttccataaatggtcacaccccatattaatggacagatggcccatgtggcaagagagctggttggtcaatggaacaggacttgctgtaaccagtgctgaataagctcaccagcatccagcctgagatgagggggggaagtctgagaggctttgtctgtcactttcaattaaccaggatcaaccaaggtaagcttcttgtcctgactgctgaaaagttctcaccctaaagaatcctaccttccccgatgcaagatggaaaattgctcaaacacttaaagctattctcaatgagaaacaaaaaaaggaccacagatacaaagtaagatccttttgtttattagaagctatttccacaaactgaacaatttggagactgagcatccttacactgtgtatgtagctctagcaaatcctactattttactctcctagctcagattcctttgtaaaaagtcagatgctgctgatgttcatgaggcttctcttctggcaccagggcagacaagacaacctgaagggctttctgcaacaaaatgcctagaaaatgttgggtgcaatttataaaacataattttaatgcatagctgagctcacaggaaggtaatggaaacccccaggagtcagaaggccaaggggacagaactctggagaatgaagcataagtgcctgctgtagctgccttgaaggtggaagggtatggtaggatggggctgttttaggaaatacacagggaaaagtgacagaaacctttggccttgcctatgggttgttggaactaagaaacccctcacacagatacataaatttgggattatctaggagcaacacagcaccttgggagattgaggcgggaggactgcttgaggccaggagcttaagaccagcctgggcaacatagcaaaaccgtatctctgcaaaaaaaaaatttttttaattagccaggcatggtgtgacatgatacttgagtagttccagctactcaagaggctgagctgggaggattaaccaatgtctaggattctcaggggttctgaagttcaaatatacactgtccttttattttgggaactcaaaaaattgtctctaagcctatactatccctcagtgaccttgcataagcaaatcacaaatgtctacaggacccatccacaagccaggcctcacaggagtcccactgatacagccctgctaaagctgagtgcacagtccaagaattaatccatttaaacaatctaccccttggcctacattttctccttgctccttccagctacaagttacgccgctctgtgatacaaactgttcctctcacgcagcagaattagaaccgaaggactgttttcccttcctgtatcctatttcttgcctccttgagagcagtccctaagttccttatagctcccatgcattgtttatacttaaaatacaccacgtgctcccacaaataatacacactggtttgcaacctcaagctcacaggtgatgggaataatgcccacgataaaagcctgtgagccagctcacgtcagaatcaagactagggtacaagtcctcaggctcctggctcctgctctttccacttcactattttgcttctctttttcttgcagcgagtattggcaatagtaaaatgagtcccacttctctgataactcaccaaccatgttggagagaaagtatctgagaagtcagttgaaacaaccaccacaacaaaaactaattcccaagacagatgatccttgagtggataattgccacttgattgtttattagagccatggctcctgtacggggactggtgagggcgggtgttgggattacctttcaaagggccattcagaggggaaaagctacctgtgctcaaaaacaaccaatgagggtctcttggattaccaggaggctgaaaagcccagagatggtgggcacagtgaaaggttggggcagtggggccaaagacataaataaaggactctgtgttttaggactctaggagctcatcactaaacaaagtgcatactccacactccctgcagaggctgtgttgccgtctgctgtgtgagtgaaggtgacagctcatcccgctagcatcagcaccaccagattgctgtcaggatctcgagggcaaggcccatgtctgattcaataacctgtattctgagcactcagaagagagcttggcacactgtcagtgctccctaaagaagttaaatggatgctgcataaccagggcagcccagcagcgtcggtccagagacaagggagtgacacctgctccccgacgcagtatattccgtacaccacagctctgaatgtccatgttcaactcatgcggtggtggggaggagatgagagagacctgagacacgaggcacctctgaatgatccccccacggcccacagggctggcagccccctaggagaccctggaatggactcgcggacagcagccacctatctcatggctcacacgtccccgcccttcagcttatgttgcttccctgctctttcctgctaaagtggcccctgctgaatgccgccagccacggggtcatgcagcttccctcctgagcctgatccactgaggtttccacatgtgtagtcaggggctttgctatgactgagctgaagacgccttcttccctttgaggccagaaagagaaagcccatgggagctgaagtgcagatgggcagcactggctcttccctgtcaatgtgtggatggcagaggcatagtcctggctggtacctgctgcctcggccttggaggtcaccacagacctgtctcttctgtggttatcgcgctttgcctgccgctgagtctctctgaggtgatgctcctcctgtcgttggcttggccctccaacccagactgcatactgtggcctctcaaagcaatgtcgcctgatactcaggccagaaagagaagggaggagagtggggaggagaggggtggaggcgatagcagaacttccttccagagtctctatattcttctgtgttgtttgaacacaacaaccatatactatctctgtgatttaaattcaaatttcaatgagaattaaaagttgaagctcaggccacactgctgtgcgttttttagagagatatgtttgactgaaagcatatcaaggggcaggaagaattttttgctgggcagtataaccagggcagagaaaggtttttatttcttaaaaatattttctatatcataaaaaaaaaaaaaaaaaaaaggccaggagtcaaaactagaccctccttcggccccatggacctagccagtggagcaggggtcccagccctcatgccatgaggtgctggggagaggcaagagagagctggtgctgctgccattctccccagctgagtacaggacccaggaggaaggcccagccccagtcggggtgcagcagctgcagacagaccctactctttgtggtcaggccacactctgagacatagttcaacctctggacaactttccctgtgagcccaactcaacccatcccagtccggcccaagaggtgtcatcatcatcacattgagggccagctgccccatcacagggcaagcagccctgacccaggaggtaaccggaagcagctttgctcctctagaaacagaatccacgtgaggctcactgccctcctagggggtctccatgtgttcccttcccctatcccaagggaaagtctccaagccttgtctttacagaagggaacattgagacccaaagaaccgggctgactctgtccacgtcaccggggcacagccagaagccttttaacaccaactcccttgaataagacattcctggcacccagaagggatttctatgctcagagccataccttcactctccatacaagacagaaatctcagtttactcagtacacgcacccggagtgaggtcagaattccccctgatttcataccagtagtttattaaggaagccaggccaccagctgtcattctgatgctctcaagaaggcagtctccggtagaaatgcaccaatccttttcgctgatgtttctcctgcttttaagtagcctcattaagaaaagtaattaggaccttattaagaagtcctttcagttgtcgtcgttaagaagaaggtgctcatcagctatcctaggtggagtcctcggcctcctcccagaagaacttgtcttcatggacacaaacatatattcccaggagccaatgaagagagcttgaactctgccttctcctgggttcccttcccaggaagcaatcttgccctggagtgggggcagcaggattgcagggcaaaaagagtaggggaaggacctcacatccagggtaaggggctatctacctcgaaagggccagtaaggaacatctggggaaggagaccagaggccctttgtgactccctcagattagttccgtgtgtaggtagagctccaacctgaaaacccagcaaggaattggactggggtcagggaagcagtggcagggacctgtggcccagccaattcatggaccagccttgcccggcccggggtctgcttgcaccaaggaatgtgtgcagtggcaggaaagctgttctccatactgatcagaaatctgcctcctggaatgtctttccttgggcctgcttctgatggccgtccagatatgtagggtccagccctatggggcttagcgggtgttctccccgtgtgcagagacaagagattgtaataaatgaaggcacaagacaaagagataaagagaaagcagctgggcccgggggaccactaccatcaagacatggagaccggtagtggccccgaacagctgggctcgctgatatttattgcacacaagacaagggggcagggtaaggagggtgaatcttctaagtgattgacaaggtgaagcaagtcacgtgattacaggataggcgggcccttcccttttaggtagccaaagcagagagagaaggcagcatatgacagcgttttctgttcacacgtacaagaaagatcaaagactttactttcactatttcttctaccgctatctactacgaacttcaaagaggaaccaggagtacgggaggagcatgaaagtggacaaggagtgtgaccattgaagcacagcaccacagggaggggtttaggcctctggatgactgaaggcaggcctggataatatccagccttccacaagaagctggtggagcagagtgttccctgactcctctaaggaaaggagactccctttcacggtctgctaagtaacggtgccttcccagacactggcgttaccacttgaccaaggagccctcaagcagcccttatgcaggcgtgacagaaggctcacctcttgccttctagatcacttctcacaatgtcccttaagcacctgaccctatacccaccggttattcctaggttatattagtaatgcaacaaagagtaatattaaaagctaatgattaatgttgataataatgattgataattgttcatgatcatctctgtatctaatttgtattatgactattcttattctaactattttctttattatactgaaacagtttgtgccttcagtctcttgcctcagcacctaggtaatcctccgcccacacagatatttgaagccagtgacactgtcctcctaaaatgtctctggatttgccgtcaggatttgctgtaggatgtgttttgtaactcaacctgtgatctgtcctccaaaggacagcctcaggaacgtggggaatctgatcgcctgtatcctacctctgtgtgggcagaggagctgctttttgtgttcagggtgataatgcattttctatttcatttaaattcactctcggccttctttccagattagtagcaggcccagtgtctctcctgggaataccctagtccccttgagttgtcccaagaatcgctagaggtggctcagtcctgtttccccggggaaaggccaaacctctccattctcttggcgagagttaagaaccagccacaattgtaagctgccattgcttctgctgcttccatagggtgttgctgctgacccactgatcccaaacaagaacagacattcttgcccacaaataggatggttttcatgatggttcagatccccactgaggtcatggacgcacactgagctgctctaatctcgccttttaggctcatctacagggccagctagagccctcgccgccatgtcatctccttggataacctttctttgcagtggccctcagctgcaaaagcctaagaacaaatccagaggaagctggcctccgaggaggaatgcacacggaaccaccctgtctccggggagcttggagttttagttttgtccaagctcgcagggcaaggctgcccactcatcttgcggagggacacagctaagaggggcttttgtggaggttctcctccaagcaaagatcctggtttgggctctgatctacacacaaaagtagcaggaccctgcagctttgttgacaaaacatttggaaaatgcacccatgccaccaggccacctgcctatttctagcaatcacttctggttgaattctttaaaaaaaaaaaaatcttgaaaataagcccttaaaaggttgtttaagaagtctaactctctcacagtcaacggtacccactttggaaatgggtcatctccccttcctaactgccctgggggatgagggtaagggatgatagggccccttgtgagatgacatttgaagtatttgtgtcattgtcctaacagaacagatgcctgtctgcaggacactgactgggccatagtcactcatgcatgtgttcacagtgtggtccatgcacaccccctatctggcccttccctaacagctgctgcaaccctgccagactgctggaggtggaattggccaggctggctatctcaggcctctagccatggcattagccagtcagcacagacacaaccccaagggtccacatgcccaggcagacataaggtggctggaaaggcagctgcccctgccctaaggactgttagtccaaactgcaccattctgtaaacaccctccacccatacccctgcatttcacagatcttggttaaagtgaaacattccatgggggtttgggccatgagaaacagcctgaccaaccacctgactttcttacattctgctgtaaaaaagtacaaagaacatcacattcagccagaacaagggccaaaccacctcatcgtgggaacatgttatcaaccttttcccaggcaacatgctccccaagatccctcctgcccagggttataattgccccagcctgtaagcagtggtgagcactggcattaagctggtcccccatctctgcaggtctcatgctgaacatagaacctgcattgctgtagagccgccgactccctttctttaaccctcgccttccctttaaaaaacctaatgaggatgtctcacagctaaaccttagaaaccatgaccttcactgaaactggctgagtttaaggagaggctcttagtcatggtcagtttcccctctcctctggctcccacctcccttggccatgctgtgtcccttgagggatgagcacacctggctgcttctccagacactagtcccctccgattaccagctctgggctgggctgaccaccttctcaaccatcctggtcagcatcctacgttctatctcttacagcaaacaaccagcctatttccttcaatgcctccttcactgtttctttgagactagagtaatataatgcttttaacagtggaaagactataaaaaatgaagttatcaatactcaataagtgagtacattctcccaaataaatactatgtgtgttgccataaaaaagaatgcagcagatccacatggtctgatacaggaaaatttccatggcattgggtagggaaaaaatctagtaggtggattataattatgtttaggaaaaaatatgaaaggggaatacaagactattttttgctcgtatagacattaaactgcaacagtagttactaagtggaatttaagatagagcacaatagactcccctctaaacatgattacaaaaagtacaaacacagactagtctgtttttctgtcatgaaaacccatgtactcaccacttagatctaagactacatttcgccatactgcattataaattttttttaatgagccatttcagaggaaattacttcagatgctgcatctttaaagtgttgagtttaccttgcctcaacatattcccctacaagatgccattaacaccctaacacaataagtgattccccaataccatataattgagtccatatgaaaatctcaattgtttcccaaatgttgttgctgatcaccaggggcttggtctaggtcctgttgctcaccacacagaaagccaatcactgtggcaacaagtattgccagggaagaagattttatttgagtgatgtcagccagagagaagggagaccagcctcaaatacgtcccttcccaccaactaaagttaagggaaaagaagaggggcagggacgaggagttggtcaataggcagcaggcggtagtataaggggttccagcatctcattgtaaccacatgtgggaaaacaggaatgaggcagggataagaagttggtcaacaaggagcaggtgcacctcactgtccagtggcagtgatctggaaagtctcagttcccggtatcattcaggaggcccgatggttggtttcccaagaaaggaactcagataagacaaatgtaagttttccaagcttcaaggtttttgttttttttaaaatatggaatccttcactaatttgagtgtcatccttacaggggccatgctaatcttctctgtatcgttccaattttagaatatgtgctgctgaagtgagcactttgttttttcaagacaacagtttcattctttcacccaggctggagtgaagtggcaccatcttggctcactgcaacctccacctcccagattcaagtgattctcctgcctcagcctcccaagtagctgggattacaggtgtatgccaccacgcctggctaatttttgtattttcagtagaggcggggttttgccatgtgggccaggctggtctcgaactcctgacctcaggtgatccacccaccttggcctcctaaagtgctagaattacaggcttgagccaccgcgcccggcccaagcttcagttttatgagaaaactgggcctgtttcaatgtttattttatttggttattcaagtctcaacattctttcaatctaaaacagtcctcccaccagccctccttccccagccctttttaaatccatagcattgaagagaccaggtcattgtcttatagaatatccttcattttagatttgcctgattgtgtcttcattccctaaacttcctataaaccagcagttggatttaaagccttgataagacccaggtggaggatttttggcaagaacacattccagttgacactgtgtacttacttacttcatgttgtaactcatatctggtggtttcattatgggatctactagaatatacagaccatgggcagatcatatacaaaaacagaactctgacccacagtctgcagtaaccagtccaggaagccaaacaacccctgtagcctttggtcccaaatggcccggacttgatcagtacctgccagcttccctaattcttgcctctgttttgaaaatcctttagtaggaccaaccagagaaggccaaatatgcttccctaaccaatcacataggataccctgcttctagttagctcacccacagcctccagatgccaacagcctttgatcaaggctcacctgaagcctccccttttcccagcataaagctttctcactccgctgactgcctttgagtgtctgcaatggcaagtgactgtggctgactctctgtgtatataccacactgagaataagtagctgctgctcattttcatttgggtggtctataattattactgaagtgaagtgtgatcacagttaaggtggtaatagtcagaccctttacactgtcgatggactcagactttttacttcatgccttgcttatactgcttggatgttttccatgtgcctatattaatatttacaataaaagcatgatttagattttcatttagaatttatcttaaatgcatcaaatatgcaattttaagtcaagttttgcatgtttggctcaaaatatcaaaataatgttgtgtggttttaaaataacaaggtttattgctctttatattagacatgtagttaattacgttgatctccataaaaataagtttaattttaatttgaataaaagaatgccacaatgaaatactgaccattaaaaaaaaaaaaaagaataaaggaccttaaccctgggcaaacatataaaagcataggaaagtcacccagtataatgtctggcacattgcaggtgttttgcaattagagcccattcccacggtggtgcacactgcacaagaccacagaggtccagcccttttatctttctggtcccatccagtcatcacccatagtgaatcccgaaggcagcatctccacccaccgtactggaggaccaccgacaactcctagtcctcaggggaaactcccttccatattcttcttggtggcggccaatatacatttctttcttcacttcccaggacgtttgacatacttggtgttcctccctccaagctcctcccttcccttcaggtctcaaggtctcatccaacacttcaagctcaaaatatcacacaagcatcaagggggtgagcccagacaggcactcttccttgtccagtttcgggagaagatctctgttccctgtgaccccaggatacacaatggctgttctacactcaggaatcactacatgtgattcccaggacaggggctgcaactcttctgctaagagctcccatagccccagggctcccccacccccaccccatatacacacacccctctcccagtcttctgtgtctttctcgaggactggttagcattttggtagcacctttgccagggaagcaggctccccaggatgcactttgaaccctccccctactgacatggacttgcgttctcctgcctctaggctccttgcctggcagttctgcactttcggactcccctcctctaacgagtccatttgccaccacagcagtgactgcagtagggtcacggcacctgttttctgtgttatgtggaaaaaaattaagatactgaacatttatgtatgctaccttctgggtgtgaaggagggaacatgaattcacatttgatttagctggtatctgcagaaagcagcagtagggatttagaaatgcataaaaatagtgttactttttgggatgaagagtggcatgagactgatatctatatatatatctatatagatatagatatatatttggaggcattgaaacctgcttgatttattctgattatttaatacacactgacgcaactgtgatcccaaagagtgcaaagttaaagccttcaactgcagctgaggaagagggcaggaatggtacacctcgggacggtggtgagtcaggaatgacaggcaggtagccatgaccagggcagcttcctccccagggccaggaacaggggagtagcctgaggagcaggacccaagggtagcccagggccggggaagggggcagagacctccccttggcctaggtcaggagctcagaagtgccacatggctgaggggacaggaccctggaagggccagaggcagggccaggacagcaccatttcctgggggtctgggggcaggaagctgccctagagaagaagccaggaggggttgcctgcccctggggtgggggccaggctgaaggaggctgcagcaggctgcagcaagaaagacctgaggcaggtgcagggcctgagagcccagctagctgagcagggggggctcccagggcagcctggcccaggaagcagtcctgactctgcaggggatgccaagcaaggggccgcagacccctcaggacctcccctcttctctccctggaaaggagctggggaacccatagtgcaaatctgtgtaccactcagtgatggagggagactgtgccccaaggtggacactggggtgcaccccctccaccacctcagcctccaccgctgtcctcatcacagctgcttctcatacgagtgcaggccatggacaccacccttgatctgggccgacatggtctgcttctcaaacttgagctcccctgagtacatcatggaccaaaggacagacaggctgcgggccccgatatcctggcagctgtgctggatgcccgctatgaggtagggcacgaacttctgaatggaccctttgtcctggatggagcccgagacaccctgtgcgatcttcaccttatcccccttgctgaagtatcgtttctggctgctgctgctcttctccatggcatccagtgagcccatgccctggtacttcttgagctgcaccctttctaagaagaagtactcaccaggtgcctccgtggtggtggccagcaggagcccatcatcactgtggaggctccaagggccagggccttgaccacgtgccccacagtctggatgccaccatcgactatgatgggcacaccaaagcactgggcatacttggccaccttgtacacagcagtgccctggggccaaccgcaggccatcactttctgggtaatgcagatggagccgtagcccatgcccacatgcagcccgtccacacgagcgtccatcaggttcttggcctgggctgctgtcaccacgttccccccaatcacctggaggtgggggtacttctgtttgatgtaatgcaccatggtgatctgatacaccgagctcccttgggatgagtccaagactacaacattgacacccgcctgggtgagcaggtccaggtggcattcgtcatcctcacgggtgcccacagctgccctgcacagcagctgtttgtgggaatccttggaggccagagggtagtctcgattcttcttcaggtcagtgcgggcaatgatggccaccagctcatcgcgatcactgacgataggcagcttccctttcttgttacgctgcaggatctcatttgcctctttcaacgtcacacctttcaacgtcagccaccaccagttccatccttggcgtcatcacctcactgatgaaggtggcgtgctccttcttagcaagaaagtcgacgtctcgggaggtgatgatgcccaccagcttgctgcccatggtgcccgtctcagtgagggggataccagagaagccatgcagcatcttggcctccaagcacatcacccacggtgtgcaaggggctcagcaccacagggtccgtgatgaagccctgttcaaacttcttgaccttcagcacctcattggcctcgaactctggggtgcagttgtggtgaatgaaaccaatacctcccatcagagccatcccgattgccatgtcagcctctgtcagtgtccacaggggaggagatcagcggcgtcttcagcccttgtgggtcagggctgaggtcaggtccacctcatcatcagctatgaagtctatgaatcctgggagaatcaggaagtcattgtaggtgaggccgttggtgctggtgaagagctgctgcgcggtgagcccgtcctcgggcacgtagctggtgccgctgctgatcaggtagtctgccaggctgccgtgacaccccgcgacccgacataaacacccgagtggccacctgccgcaggcacactgccactgcgggccgggcacaggggctctcagtgtaaatctttttatatcccttctacttttgggaaaaaaaaatgccccaggaaggtctgatcaccaaatccttccagagagcgatcttccaagccaaagaggttttcagtcccacccactgaaatcatccagtcctttattcacctgtgtcaacccggctcggaggtgtggcctgcgagatccttcatgcaatcaagaagtcaggcctccacctggtcctgggggtcatctgaggcccgcagttttggaagaggaatgttttctgccagcagttcccacagacgggctggctccccactgtggggacatgcaccatgccctctgtgggcctctgtttttcatccctgaattcatcccccacagaatggttcagttgtcatatctagctatctaataagcttgagggcactgtgtcccctaggggatgcccacatgcctgaccatgcaggctgatgcagtgacaagcacaaagtatcgtgattatagttcctgctctcctttccagggctttaagcccagcacatgatgttgtgcgtttcttgttccaccaactggctgctgtggaatgactacgaaacatcttggatgacagtttaatcctcgtggggtaccaggtggcatctgggcacaggtcaaactttccgagagcctttttaacctctttcactgcagccaggaatggctggatctctgctgctgcctatagggattacagttgtcccatccatacactggtctgtgttggcttttgtcacctgggcatgtgcggccaccatcttgactgctcagctagttctgtacctgggttctagaatgatgtcataatgatgccattatgacagatcagcccaaggctgcacactgacctaatcaacaggtgcggcagagctgtgattaagagactgagtcagttcccacttgtgaatagacagcatgaaggctttaaacctctctgaacctgatcagcattggcaatgatcttctgcagatccaacaacagcacagaagaatgtatcatcaggaacacatttggatattgacacaacttcatctgcagttggcttgtcatcctgagctccgttcccaggcagcgtagatattgcacaggattttgctgaccagggagttgggttataagtggtaactccaacctcttaatactaacgacattgacagtaccatataatccatctattacaccacacaggaaaatcaagcccagtggtacaggacagaagaactggctccagccaggatcaagcattgctttggcattgttccccaatacctgggcctttcttctccaattgttggggtaactggagtgaggagcctgaggggacccaaaggtgttctcctggtaggattccctctcatggtcttctgcatttgtagacattttgattggttccatttctaagggccaattatctgtgctttaacctgaaataaggaacctgccttctgatcttcaaggatatgtacatggacacacatctttcagattcaactcttgagatttttggttttaaacaaacaattgtgttcatcacaaatgaagattccctcaagcagcagcctcctggaatcaactgctgagtccaaatcttgtagcccttaaaaatatttagtatttttactaagtaataagtatttagggtgttatgaaaaatgcaatttgaaaaagtacattggtttttaagaacaagaggaactatttagaaattatacaatatattaacaaaagtaaatatttaatatatctcaaacacaaaaatgcaaaaactggttaccaagcatcaagaaaaacttaaaacttgtaaaatacaaaggttaaatgtattttatcttcattctattattagcagataaccttaataaaaatgagctgttatttacagcaaaatatcatgtaattttagatttatcactttttatttctatggaaaagcaacaccagcatgtattgttgctgaaggtgaagcaactttttgattctgttctgttccactctgtgttctaagatgtgtgtcagataccggccacacaccctacatgtgctcggggcacagcctggccccacacagcactctagtctgcaggtgggcatctaaggccctgccattcccacttcttattgtcatatttacttagttctcagcacctctgcccatctttaaatgacttaagtgagagtatgttaaagtagcttacatgttcctaagcttcctcacagcacatcccatctgtgacagcaattcagaaaaaaacaaattttcttttattcttaatggtacacagcataagagaacagctcaggcagtttactgtaattgacggtcctgatatccttatctataaactaaaaactccccacagaagcttctgtaagtataatgttaaataagtctataaacacaaataacagtaacaacaagaatgtaatccaaatgctcagttatgggaaactagtgaagaaatttactggtaaacccactgtgatgatgtgtgtgtatgtgtgtgtgtgtgtgcatgtcaagttggctcagtgacagtccctagttatgtaagctaggtgctgctgtgaaggtattttgcagatgtgatgaatattaagagtatcctggaccgggtgtggtggctcacacctgtaatcccagcactttgggaggctgaaatgggtggatcatgaggtcaggagaccgagaccatcctggctaacacggtgaaacccgtctctactgaaaaatacaaaaaattagccgggcgtggtggcaggtgtctgtagtcccagctacttgggaggctgaggcaggagaatggcatgaacctgggaggcagagcttgcagtgagccaaatctctgcactccagcctgagcaacagagcgagactccgtctcaaaaaaaaaaaaaagagtatcctgaaagatctgggtgagcccgattcaatcagttgaaaagctttaaaagcagaagcctaaaaaggccttaaaagttgaagcttccctgaaaaagaaaagaaattccacccacaggcagtggcgtctgctgtacttgtgcctgtggagttccattctgctcattcacttccctcctgactgcccatagacaacagttgtggtctgtgcccatgacctccctgattctggacttgcttagccagcacccacaatcttgcaagccaattcctttaacaaatttgtatatatatgaaatacactggttcttcctctctaattaaagcctggccaacacacccaaaaattagaaggggatgctgctgttagaaggaataaggtatacattttaggccattcaagactccaataaatgacagtaaaataatagcaaagaaaaaccttactttggggttaagaaatcacagattgatacataaacttaattttgctcctctattaaaatcctactacaaaacagtaaatatagtaaaagaatttcttttaaaaggacattaatttagaaatacagggaaagcagaggggcaacaaccacaaaatcattttagaagttgaaaaggagagagaccagtggcaaattccttagcagacctgagaataccacacccaaaaccagcagaagaaaatgctaagaatctttaaatacatagaactgtggcattgttaccccatggaagttggggtggaggggaggcttaagtatggaatgggtaaaagctgggtgagaaacccattcctagtttccaaactacagagctacagccttttcctcaacatggccgaagctaggaggttattctctagagagtataagtgaggtttggaactaggggatgccagcatggatccagagaatgggcgccacactgaaaacaaaaggatgaagtgaccatatgctgtcatgctgaacgctgagtgcaaagagtcctagccttcttcccctactgggctccaagatgcggccaggccgatccttcccatcacataggaagggccccttggggtaatctggcaaatctctgaagacctaaagagagcactgctgtgcttccccagtgaacagcccagccagaccatcctacagtgaaactcaaaagactcaaaagaccgcactctcacccatttgatctggacttttacatttcccaggcttcatcagtcgacacccagtgattacctgacacctgaagttaaaacctctaatgtgcaaaaccaagaccaaggcaaaaacaaacaaacaaacaaacaaacaaacaaaaaaaaacaaccttagaggaaatggaattatgtgggatgaagaaaaaaaatactatcctcagataagatattgtattcatgaaacaagtacaggaagatataaaagagttcttggaaattaagaacttgttagcaaaactgaaaaactcaagagaagggactgaaggatgaaagttgagtgaatcgccacaaaataagagtaaaatgacaaaacgacactggagtaaccaaaaaatgagggagctggccagatccaggggctcacgcctgtaatcccaacactttgggaggccaagatgggagaatcatgaggccaggagtttgagatcagcctggacaacacagtgagacccatttctacaaaaaatttaaaaattggctgggcttggtggcgtgtacctgtagtcctagctacttgggaggctgaggcgggaagatcgcttgagcccaggagttggaggctacagtgagctatgattgcacctctgcactccagcctgggtgacagaataagattctgtctcaaaaaaaaaaaaaaaagaaaagaaaagaaaaagagaagagaagagaaaatgagggaactgtccaggatccccaacacataaataactgaagctccagaaagaacagggaagtggcctgcagcaggtgctcacggcccttgctgttttggctctctgggtctgcgtgtccaccccagcctccagcctcccaacccatacatatcaatccacacacaaggatgaacacagattttgctagtttctttgttttttgtttttgtttctgagatggagtctcgctctgttgcccaggctggagtgcagtgcacgatctcggctcactgcaagctccgcctcccaggttcacgccattctcctgcctcagcctcccgagtagctgggactataggtgcctgccaccacacccgatcaaatttttggatttttagtagagacagggttgcaccgtgttaatcaggatagtctcgatctcctgaccttgtgatctgcccgcctcagcctcccaaagtgctgggattacaggcgtgagccaccgcgcccggccagactttgctagtttttacttcatccagccctgttcaagaagatgatgcataggagaagataaacccagtgaccctcctgtggattaagaattcagatccgaggctaagcctttctcctcaagtgtttcctcacaggaaacagatccatcgaaggagaggaggacaggaaaatcaaaagaagtcaacattcccaggagattctcagcaaaatagaggagaggtgtcaagatgagagctggcaccagaccccgagggcagtgattctggcctggagcaaggattcaggacagacacgtcaggagccctcagcaccaagatccctgcgggcttcccgcagctcagctgaggacaggtcacccgggcgatcccattcacattctttctactcggcttaccttgacatgatggagaagcttcctgccctccagatcagctgaagatcctcactccatcccacagcagcgctcggctttgacgtcctcccgaaatcaaaaggtcagctgtggggactacaaaaacagaactcagcagccggcaccctccatccacattcttgccagatgatcagggtctggtccatggatagtgtggccacgggccctgatggtggcagccctgctacgcccaggactcattcaagccttgctgctccctggcttccccagaagggccccttgtaaattcttggagaagctgaagtccactctgaccttgagatcacattatgttctccagcagacttcattcaacattggaaacactgtgctttccccacacagctaatctgtgcttgatgctcaatgtttttaaaaatgaacagtatgtgaagagcaaggaaattattcactacaggtcaggctagcacttactttggtagagagggtggggcattcaaccgggtgaagacatacgagtgcttctaaggtagttggtagtgttctgttccttaaagatggaaacactatccattttactctttaaactatacatttatggccaggcacagtggctcatgcctgtaatcccagcacttggggaggctagggtgggaggactgtttgagcccaggagttcaaaaccagcctgggcaacatagcaagatcccatctctacttaataacaaaactatacacttatattggatatgctcttctctatggatgacatctttcacagttggggagaaaaagagataaaaacacatagtaatagggagaactaaaggggaaccatcaggaggccagagactatattctacaaagggagagcaaatgaaagagtatggacggacaagagaagggtgagggaacccacaggccagaaaagtagcagaagggggcagtacagaaggcccacccaccctggagcccccatctgctgagaggtccaccgttcccacgccagcacgtgcacccttgtctgcggtttatgttcactctgcatcccttcctgtacttcacgtttctcttcatctttgacatcatgacccttgtggccctgtgtctcatcaaccccacaggaggtggcagctcggcttccccaagcctctggttagcccactgctgttgagcctcaaagctttgtcttggctggaaagaaaggcctgaggcttctggccggtgctcggcttctactccagagctgctcagggtcggcgcctaagcatgaggtctcctcctgccttgaagctggggtttcccacagtctctgctaggccaggagcaaagtcaagctccatttgagtcctgttgcccacccatatcacagaatcatagctgttagcatgggaaggggccgcagaggtcatctcatattcaatttcttggtctcatggctggagttgaagaatctgctctgcctttccagaatgatctgagccagtgtgagacagacaccacctccaggaggaggcccatttggctgtgcccacaaccccgccccccagcacagtctccatgtggggtaaataagcctctaacccaccagggtacaaatcctttcagggctgcttgacagcatgtctcggggctgccctgcaaggcccgtgtgtccagaaagagcgatctcagtgacttaagtgccttccacctgaaaaagacataggattttcccccccttgtaattataaaagaaaaccaaggtacctgtagaaaatctggaaattacagaaaaatctaaagaagaaaataaaatcacgatggcctaagtgcaactgtgaaggtttggcatcacacctgagctctgtgaaagaaaccagccctaaaaccagcagccaccaccccaacccctacacccccatctgcccagtcagtgacttaaaatccatcgtgttaggccgggagtggtggctcatgcctgtaatcccagcactttgggaggccgaggcaggcagatcacctgaggtcgggagtttgagaccggcctgaccaacatggagaaaccccgtctctactaaaaatacaaaattagccaggtgtggtggcgcacgcctgtaatcccagctactcaggaggctaaggcaggagaatcacttgaacccagcaggtagaggctgcagtgagctgagagcatgccactgcactccagactgggcaacgagagcgaaactccgtctcaaaaaaaaaatatatcaacggctctgctgcccattctgaggatggcgcagggtgtgggctgtcaaggagacagaggcaggccctgtccctatggacacaagggcccactccaactaccagagccccgcacagctctgtgacaccccgtggccacaggtgagatcaagactgcagggccacagtggaacttcacccagcaggaaatgatgagggaggcatccacatcagtctgcccccaccagcctggccaccagtggagtgtgagtgaagcttctggagaacattctgcccccaagcccctccaagaaaaaggatcagagaaggagggctctgctctgccccaggcctcaacctggcttcctgcagctaaaggcccagcctcccaacttcctcatcaccttgcaacacggagttcaggcccacgtgggctgttctgggagtccagcaatgctgggtgatctcccagtgtgatgctgtcaggtactacaaagcagcccccaagcaggtggggccattcccagccaagggccccagacagggccctgactgagaatgctacccagagcactcagctcactcccttttgcttttcccaagcctgcagaattgaatgtgagggccagagggcagaatctgggtctcacacagatgggcagcctggctgcagtcaccagttcatgccacactggacagatgggtggcagggaagggcaggaaggagtgagagagaggctgatgcagcgggtagcagggactgcaaattgtcatgtgagacagaaagaacctacacatcagccaactccagctacgtgctgcagaggagaagctgtctcaagtttagaaatacaggaaagctgactgactaggaagagattaaaaactcacatcttcaaacacagccttacagaaattgacctttatttgttgtactaaagcctgtttaacttttgatacaaagtaacattttagtacagaaaatcccagtctgtcagctcagtacctgtctgtgcacactgtaccatctcagtcccactctgcctgtaacttagaaaacagcccctacccccagagggtctgcgagttaataccttgagaatagtctacagtttttcatagtttgtctgagctagaaaacttgtacctgtaaaacaaaggacagcattgaggactgaaacttgtctcttttttgaacaactgtgcaagaaaatatatccctttttaaaaaacatcagttatggctaaactacaatctagtgtctagaattacaaagaataaaatgaaatcaaagatttctcgctagtaaaatgaaatgttaggaacagtattaaaatataggtcctaccccaacgacacttacacagagcccagtacagtacctattattaacaggacgcatagcttaaggaggaaccacatcaaatcttcagccagacatatctagcctcagaagtgcaaaaaaaaaaaaagcccccaaacgaagacacccacactgagtagggtgcatgccgtgagtgctgtaatcaagattaaaaagacctcagtttttctttttagactgttgatagtgacaataaccattatgcttcccctaaaagctctcaattcaatgtctgaaacatgaatgttttcatatcaaaaagaactgatgtacctgccaccctctaaaaagtttaagaattaccctgcaaacattgcactgatgaaggctgtcacgacttacagagcctaaggaggacccaatggcaggcatcagcacagctgaacaccacctggaccccactgcagccctgcccacgcagctctcacggagcagacacagtcctcaagtaataagcacagatggaggagaaacgagaggctgtggaaggcaggagagaaaggccgagagacgagtttgtaagaatgccaaagtcaccttccccattgtgggaggaaaatgccaaaggcactggttctgctgccacaggcagtctgagcacctggagttgtgacgtccttccaggagaggtgccaccaaggagcaggaggtttgtcaaagctctggtcccaccaacaagaacctcccaaagcaaagcagcccccattgaggttccaaggtcgttttgctgaagacgggaacgaaaccaacaccaaagcgacagggggttgacagaggggacaggggctgggcaccggcaacatggagccgttcaagtaaacataaaccaccaaatacttagaaaaggcttgtaaacgagtgatccgaaaggttctctttgcagcatctctgatcagctggctaaagaaaggtgggtgctgaacccgtctttagtgttatctgttttgtgttaaagcacacgtgtgacacgggcagagtgtgtgggcctgggcctggatcgcacgcagccgtggccctctgtctacaaaggaggtgcttctgggtcctggttccggatccttcccccgcatgttcatagacggacagacttctactttcagtcgctagaaaagagctgagtctggtgtcccctcaggcggccagctgcagtcatccacagcacagcattctcctagagcgggcaggctggaatccacaggactttattttgttcttgattgaccattgccaagatctgagtgcaaatgcttgacagggctcctccctggatgacccctgcaaaagagccccccagacacgtcattcagctcagagtaagaccccaggtttgaggcaaggcagtacagcttgcactctttctactgtgtggctgtctgctttgtgctccttggcactctgctccatccccacctgactctccttcaccagcaagaaactgggaaagaaaattgcccctcttgagttgatcactcatatgtaaactgcccaccccactgcagttaacaccctgggttgggtttgcaatggttgggggaatcccagggcatcagaaggaagtttggaggacatgtggcggtggtctaatcattagcaggattctgcaggaaacgacaagtttaaggagccagatagctcatggccaagaggagagtcacagaaagatgatggcgccaacttgggccagccctgtactataggagtttgacaaaggggtctatagacaccaggccaggggtactccagtgtgctccacataacagcacctggacacaaaccaagcccctactgcaacaaggcatgctcagaaattgacagtgagtgtctagaaactgctatggaaacaggacgtcgtaattttatgtctgttgaatctaacaagaaaaaaatagagcttaccttttgcaagacttagagttttaaattttcatctctctaggaattgtcagtgtatttggctaaataccagtctgtgaggaattggaaatgaaagttcacacacacacccacacacacacacacacagaggcatgcacacctgcacatacctacacacacatgggcaccaagcccaggtccctggactagatcataacactctccacaatgcagttagaatccctgtcccatcctctgtgactgcaaatgctaatgccctgcaaatgacagactttcccaaagaggctgaaggccagaaggtaaaatagaaccaaacttcactgagtttgtttcactttgaagaccagagatggtaaggggacagcattgtttttttttgttttgttttttgtttttttttttttggaggggggtttgccaaatcccgctgcaaaacgggactgccctggagggtgctagggacagatgggcccctagcctccgctgcccacactgctggcacactgggggctgctccagtccccgccctgcctggggacactgtggctgcactaaactgcacctgtgctatgagacagacccaccactgcacgtgtgaaaatgagcaggcaagccaggcaggacctgaggccaagatcggtgagcttaacattcaacctgtaagaatcctgacgttggccagggactgcaatctgaacacctgacttgtcaggaacgtgctcatgacagcacttgggagcatgtagaaagtgcgggcttctccacggctaagaaaacagccttaggaagcctctgcttccttccctgctgcctgctccccactccaggcccacgcacacctacctgtgaagtacctgctgtactcctgctcaagcttctgcgccgcctcaaactgctctttggaatgcctctgagtcaccttgtccctcaggtagatggggtctctctgctccctgtggggacagccagacaccaggctgagcactgagcctcctccaggccctctttccttcctctgtccaggctaacaggggccccatcaaggcaggggtaggctgtggagggaggccccatgtgctccccacataaagcacagcaacagcctgtaggctgtcgggggagctctgggcagatgggggaaggagggccccccagcacacacacttggaacagatgcaccagcagcccctagcgcaggtcccagaagctcagcagcacagaaaggcaaaatggagcagggccttggtgagcccttggcccaaccagcacaggagccgaagctcagcgaaggcaacggctcctgagtcatgagccagctcggggctgagtgggactgtgcccaggccactggctcccctgctcctaagcagcacgtagcgaggaaagggggctggggcaggagaggggagctgtgcagaccaagctggccatgcccaaaaaacagtggcagcacccaaatggcggaggggcgcgaggaaggggctgcgcttggctgacaccacctctgagtaggggacagggccgacagggaagggtcattttctacacgtactgcctatttcaagacccataggcccatctctcattcctcaaccccccaccccaacacaccctgctccctacttgggctcccagccccacctgtgacaaggccccagcggagcccagggggccagttacctacttgatgtgcttggcgctcttgtagtggatgaagatgacaatggggtagatgtgcatgtggtggagccgctcaatagcgtgcggagcaatgtccaggaggcagtgtcggttctggggtggggggtgcagagtgagccctggcgggcagtgaggggcagccagccccctgtcctgccaccagcaggacccacctcacctcacagggctctacccacaaacaaggcagtaaagccacacagtacaccgtggggaaaccatacccacgaaactcccaacaaaccccacttgctgtgaggaaggccaaggctgggagccagggcttagggggctaggggtgctggccagcccaactccaaacttcctttcccgcctttgcccagatacagggaccttctgaaagccctgccccaccctggcctctgaagccttatttttgccagactgagcgaatgaagagccagagtctggtgagcctttgtgtggctgagactgaaatatgtctgtcatgtctgtcgtcccaggcatccaggtggagtgcaggcccgtgcactcccgacccccagatgctccactggggcattcccccaagtagagtttgcccactttcagcagtgagaagccaacaccttcatctaacagagaagggaagcaaagcccagcgagcgagctgagcagcctggagaaatggagcccaaggagcggctgtgtccttggactccgagtgtttgccccaccagcactccccacagacgtccccgccctcgtgctgcctaggatgttcgaaggcaccgagagtcatagcccttttaggggcagggaccctgagggaaggcacgttcctgtccccagaaggtgcatgtgaaattgttcggcacatgcatttggggaccccgttccggaatgccctgcgagaggcctttccgcagagctcaatactctcatcagagatgagaccccccgcacctgccagagaggaagatggggcggcacatacacaggggaactcctccatccccaccaagggatgtgcttgcagaaacacacagcagccatgagggcaagcccaggcacaggtgaactcagactaacacaacacggtgggctcactgaaggtctgagccgctggggcagaggatcacggaccaggggcctagacctgtgcacaggaggtctaatactggatgcctaatcctcagactgaagccctgggtaccttttctgtgatctcctttattgacgccacagtggtcacatcgaaatggccgcttctccgcttatagtcgacaaacaggcaatctttgacaccccgctcaatggcctgctgggaggccttcatcacctctgcaatgcacagacacaggaatcagggagccccaggccctgctgagccccagcagagggagcaggggaagaacactgctcagcagctgtcagtaacccagtcctgccatgcatgaatctgacccatgtcagcaggcttctggaacactgtgaaatctgccccccggtactgccacccactgtgcacagctgggcaggcaggtggacagggacatagagacaaagagcccagtaggcacagagggtgccccgtgccccttaccaaggggacatctgcagaacttgccaggagcctcattcaccagcatctccttcaccacgtccagcaaaggccccagaatcaggacaggcctcagagcggtgcagtccaccttctggacccgctgataggccaggctcaccgaatctgagggagagagagcagcagcgtcacggacccagcttggagtggaggacctgagtggggctggggaaccccgctccctgacctcgcccactctggtttgcctgggactcccccagcttcagcactgaaaatctcgtgtcccaggcacaaccgggcatcgtcacccctggagtccagcatgagcaccccccatgccctctgtgaacaccagaggcagctggtctcaaccactcatcccagagcttccttctgctctgatttttcctcgtgggtcgacgcctgcttcccctgccccatctccattctcctctgctctctggcaaggcagcctctggggtttggcaggtaaagctcccactccccaggaaggtgtggtcagtgtaacccagacctgcccagtgacaggtgaggcctccccaatctgcacggctagaacaggtgagtgctgtgagccagctctggccatgcagttgaggataacccttaagaaatggcagaggcacaagatggaagggacctgggtcctggatgatcctcagaacgcaatgcctctcccacatcaaccacagctcagacttgtacatgacagagaaataaactgcccattatgcttaagccactgttatttggtttcagttaaagcagtcaaaccaatatcctagttgatacatgcagtaaacctccccttgcaccaaatgaataaagtccttgcagggagacacagtctaaaacccagcaagatcttcctggcgtctccctggtataagtcactgtgctggaatctcagaaacataataaagaatagaacacagagttcctgccattaaaaagcacacactttaactagagtcacaacagagcaacacatgaacagcaagagagcacgcaagagctgcctggcaattccaggagcggcgggcttcagtagacactgtggctggatgacagggtgaaaagaccacttgggcaggcccaggagggaagtgggatgagagtctccagaaagagcagggcaagaggatgagtatggagatgatggggagggcagagcacaagatgactgcaggcttgggaggaagggtccatgagaggcttggcctggagggatctgtacgcatatgcagaacaaggagtgactgcagagcaggcacagggaccaggaggcagaaggctcaggagaacacaagcacagtgccagctgcagcagcaggctccatgaagagcaacctgtgggcaaactcagggagtaagtaaagtctctcctctcctcttgccctgtccctgtgtgtgtgttttttagaagtgatcactgctgggcatggtggctcacgtctgtaatcccagcactttgggaggctgaggcaggtggatcgcttgaggtcaagagtttgagaccagcctggccaataaggcaagaccccttctctactaaaaatacaaaaattagccgggtgtgctggcgcacacctgtaatcccagctactcaggaagctgaagcacaacaatcacttgaacccaggaggcggaggttgcagtgagccgagactgcaccactgtactccagcctgggcaacagagcaagactagatctcaataaaaataaataaaataataaaactgatcattatccacatacatccacacagtcttttacacagcacttcctaacctggtgaccagcagctctgttgtttaaaactggaggagggtttggtggtcacattcaccaccttggaaccccatgtggtcccgagtgaaggctctgaggaggagtcacggggcaaagaacttcctccgagaggagtttacataaacaaatcctctctgtaacaaatctgaacctcacggataaggccagcactcctctctgataccccttccccaacctcagtccccactgggctccttgaaggtaaccactattatgagctggaagtgtatcctagttcttcttataaactgatttttatatgctaaagaaaacctagaatatatattgtttaagtgtgtctgtggatactttataactcgctccttgtccggggctgtgtttctgggaggcatccctggtgattcgtcgtgggccgctctgctccttttgggcatcccattaacacttattctggatcgacttatccacttccctgctgatggacactacgtcaccattccctccatttactagtataagaatcatattctcaaattatggcacagttgctatagggtggaattcaatatagtgcttaaaagaatggtttggaagaatattactgagatgggaagatgctaacaatatgatagtggaaatacctggatgaaaacagtgtaatgcagtgtaatcccagctttgttgtattaagtaaaaaactggtaagaaatacattaaaatgttaatggttaaaaaaaaccatattctcccttaatgattactaacattccacactatggggtaccaatttaggagattctttttcctccctgacaatcttctttgtcagatgtcctcacaattacagaattgtaagactagacagcatcttatgagtcactgactccaactggagaagaaaaacagcctatccaaggtcacagctaatcagggcagagcaaaggcatggtcctgggggttccaaccttagaccatacggcaatggctttctttaaaaggtgctgtggactgaactatgtcccctcgacatttatatgttgaagccctaagccccagtgtgactacctttggagacggagtcttcaggaggtaagttaaatgaggtcagaagagcaaggccctaatctgatagaactgcggctttttaagaggaagagacaccagagatctctctgtctccaacatgtgaggacacagcaaggaggcagctgcgtacaaggcaggatgacagccctcaccagaaccaaccacactggcacccagatctcggatttccaacctcaagaactgtgagaaaatgaattcttgttatttaagtcacctagtctgtggtattggttttttggtttgtttttgtttttgagatatgctcttgctttgttgccaggctgaagtggagtggcacaatcatagctcatcgcagcactgtactcctgggcttaggtgatcctccagcctcagcctcctgagtagccgggactacaggcacacgccaccacacttgattagttttttaaagtttttgtagagatgggagtcttgccatgttgcccaggctggtctcaaactcctggcctcaagcgatcctcttgcctcagcttcccaaagtgctgggattacaggtgtgagctaccgtgcctggcctgtggtatttggttacagcagccctagcagactaacataagaggaaaaccagtcctccatatattcctgagacactcccgcacaagcccctaaaagagcaagcataaagacatgcagtgtcctctgggtggtggagagttgagtccacttagaccattgcaggtgggtgcacaatcagcagggtggggggtaccagggatgctatgcagcagttggaagcaataaactaaagcaggaattcaaaacccactgtgcattagaattagctggggtaacttttaaactactacacagggattaccactcccaggtataatggaacagcttgcagcatcccttggagaacacctagaaaatctgggtaaaaaatgagaaatatctttttgaaggcatcgtagagtggcagagacaagacagaatttgagatgccaagatcctggagagaaggaaactggagtattagaagctgacattctgcaggcctttcccccttcagagcaactggagacttctaaagtgagagtgaggggcagagaacccaggcagagggccgccgctgaggggctgagaacccaggcacggggccgccgctgaggggctgagaacccaggcacggggccgccgctgaggggctgagaacccaggcacggggccgccgctgagggctgagaacccacgaaaagtttctgaaaatctccaaagcaggtgagatcaaaacggagttcagggctgccaggacctggtgggtcattattccagaggaagggaagggcaaagaactaagtctggtatcacaggttttcccttaaagccatttgccaaattcttaagctgtgaaaagcaagaagctaagcatctaagacagtcactaagacactgagcagtgttccatggcctcccagtgctgaagagtgagaaactggaagtcaaggctccctagggaagagcggccctagggaacaccccaggctgggaccactggtgggccaccccctagggtcaggtgaaccaccagctgcacaaaagctgcaacccagcctgaggtcagctgagtctgtggctggatcaaagtgatctgcgagcagcggctatctccagagcagagggcagaccctctctggaagctggcaacatcactcggagccctgaaaatcccctaaacataacttctgacatctcaataaacaataactaggcatatcatggggcaggaccaagaaaaacaaagaccacagaaagagactcagggatgaccacacatgacagttaccaaacgcagtctttacaaacatatgattcaagtatttaagaggacagatgacaagagggaaagtctcagcagagaattaaagcctggtaaaaaagaaccaagtggaaactctagagtgataaataaaatacaacttctgaaagtaagaacataatggatgcaacagaagagtggaataatgaacaggaaaaaagagtagaaaacaaccaggctggctgaatcatggagagaaagaaagaagtggaaaatgcaggagaaaaagagcccagaagacaggagacagacagggtattgtcgaagaacaaaaaccccgaggagaggcaaggtcagcacagaagcaatatgaaagaaactgcggccaggaatctccaaaaccgaccacaccaccaaactacagatgtaaaaagtgctaagcaccttctgagcaggataaacacaaagaaaaccacacgggggaagcacggtgtggtaagaaattaagaagtttctttctgagaaaggaaggcagagaaaaccctacccactcatggtggtggacgggtggtggcactgccttcagcactgagcctggaaagatgacttctcaccagcaatgagtgtggcaggctgacaagtgtcccccaaagactgactcatgtcctaagccccagatcccatgagcattacaccttatgcaacaaaagaagcgatgattcagttaaaggccttgggaggaagggcttttcctggagtatctgggtgggtcctaaataaaaccccacgggtcctctgagaggcagagggagttgagagagagacccacgtggaggacgaggtgacgtgaagatggagcagatgagatttgaagatgacagtgatgtggccacagcaaaggcttggcagcagccaccagaagctgggaggggcaaggaacaggctctctcctcaagcccggagggagcgaaggttggccaacaatttgactgacccagtggtcctgagtgtggacttctggcctccagaactgtgggaggataaacctgtgtgtttgaagccacacagtctgtggtaattgggtacagcggccacaggaaactactacacaaagagagccagggaccaggaatgatatctttaaagcacccaagtaaaacatccaccaatctaaaattctatatccagtgagaatctccaaaaacgatattaaaatggacattttcagacacaaacactgacaggatgtgtcaccaaaaaacctgcactacaagaaaaacatttctgcaagttgttcagcagaaagaaaacaaaatcagaagcacaaaactgcaggaaggaataaagagcaatggaaatgtaaaaggcaaaaaccgatgaataattgatgtgcaaatggacagactgagtcagagttaaagtatctgtagaattaaaatgagaaaagtatggccggggacagtgccttgcgcctgtaatcccgggtgcagtgccttgcactttgtgaggctaagacaggcggctcacttgaggtcaggagtttcaagaccagcctggccaacatggtgaaaccccgtctttactaaaaatacaaaaattagccagatgtggtgacaggcacctgtaatcccagctactcggcaggctgaggcaggaaaatcgcttgaacctgggaggcagaggttgcagcgagccgagatcgtaccattgcactccggcctgggcgacagagcgagattctgcctcaaaaaataaaataataaaaaaataaaatgcgaatagtatcaaagttagaaaagagataaatggagttagtggtttgatgtcttagaattatcagggaagtggccaaagcaatgatttctcttagcagtaagtcaaaggtgcacactgtgaggtctattttaacccccaaaagaataaaatagaaacaactaaacactagtggatgtgagaggataacagtagatgatataggggcagaataaaacaaaacacatgattcatttttaaaaagcaagaaagaagggacaaacataaacgaggtagaatgaatagaaaacaaacagtaagatgggaaatgtctactttatgtaatgaggtaaatactcttgatgaaacaatcaagactgccacaggggtgttcagattgtggaaattcctcacactgctcacttttctgtaaatgaatgtgtgcattgctgtatgtatgttacacttggataaaatttttaaaaagacagattgccacagtggatttaaaaagtcccacatgctgcttataagggatatttaaatataaagtgacagaaaagtttgaagtaaaagaaaaagataaactgtgccaaagataaccaaaagaaaactggtaatgtcaataaaaatatcacgtaaaatagactttcagaaagaaacattcctggagatcaagaagggcattttataacgataaaaaggttaatttaccaggaaggtgtaacaatgcaaaaggtgtatgtatctaacgacaacttcaagatatatattgaaaaacacctgaagagctaaaaggaagaatagacaaagggctattttttaaagacactagcaccaccggacaaatgccaaacataatggagatggcacctacggagaaaggagcagagggcacaagagtggaggccaaagagagtgaaggaaaaaaaacaaaaagcaaaataagagagaaaccttgccttgagtaacaggttggcatttttttttttttttttttttgagacaggttctcactctgttgcctgggctagagtgcagtggcgtgatcacagttcactgcagctcttgacctcccaggctgaagctatcttcctgcctcagcctcttcggtagctggaactacaggcatgagccaccacaccaggctaatttttgtattttttagtagagatggggtttcaccatgttggccaggctggtcttgaactccctgcctcaagtgatccacccacctcggcttcccaaagtgctgggattacaggcatgcgccaccatgcctggcctaaactttttctataaggggcaagatagtaaatattttaggctttgaaggcaaaacggcaaaattaagcaattgttatcagcaaagggctaatagacttttttacatcttacattttaagaagtgtaaaaacccatgctcagctcacagaccatttaaaaataggcagtagtccagactcggtccatggccaatagtttgccaacccttgtcccagctgatagtgacagtgggccatgaactacagtgtgatccactgaactccctaggcctaaggtcttcattgtaaaaagcgaagagagggagggaggcagccagctgccctacactctgctgctcactgccacccccacacctgattgccagggagggcacattctaggacagtagacagtagacacacaccagggccctgggagccacgttcctaagggcctcttgctttaaaggacaaatgcatcctttccacaagggctgtctaccaggggatgtctgacatctcctatcactcaactccagccctggactagcatcttgctccataaggattatacaagacttgttcatgaacacaggactgaggccagaaatgccgaagttctgcagaaaccgacagctcttggtcactaccaagcagcctgtaagaacctaaaaacaaatggcaagcaaggcactcagcagagattgcttcttgcctacccaatagctatccctccattcttcctcagtaactgaacctcttactgaggccagcaatgcacccagctaaaacatgccttttctttttaattattttttgagacaggatcttgctctgtcacccaggctggagtacggtggcgtgatcttggctcactgcacctccgcctcctgggttcaagggattctcctgcctcagcctcccaagtagctgggattacaggtgcatgccaccacacctggctaatttttgtatttttaatagagacagggtttcaccatgttggccaggctggtcttgaactcctgacctcaggtgatccacccacctcagcctcccaaagtgctgggattaaacgtgtgagccactgtgcctggccaaaacatgcctttttgacctctcttgcacatgcaagtggacaatgagatgcaagttgaagtcacaggttagggcttccagatagctgctgaaagaggcacgctcagctgaggcacacttctgccttaccactccttccttcctcctgctgcctgaaacagggacatgatggctgcagctgcattgacaggcggtgactgggaggatggaagccacaccccatagatgtggctctgaagatggcagcaccccccgaccaagccgaacacacaccttcagacttgcgcacaaaagcaaagtaagactctcttttgtttaagtccctgttgtggagctcctggatccacagcaagccccatctggagagcccactggaaaatgagctcagccacttgccttcaaagagtggaatggagtcactggaaaaggcatccaaggcgagcaggtctttcccgtccttggacccgctgcgtttgtgcttgtgtttcctccgaaaaaaggaccggcgtgcagccgctgacagcgtctttgtggcgctattgtcatctttgacttcagacatgctgagcctcctggagaattcttggtccatcctgtggcacaggggacaatgctgggcagggccatcgagaccctgctgccctgcccttcctgcccttcctggtgagaaaagcaaaggtgggccagacactgggctccccccacactccttggcaggtctcaaggctacatctcctcccacgcccctgggaaccctcggtacatgctgcgggggtgacacaaacaccagcaccagggcaagctctcagagcaggcgattttttctactacagcatattcagctcggtgtcaaaaggaactgctaggacagccttcaattggtgacatgacgagttacgcttcctgccatagaagggaaatgatgcagggatgcaggctgcctcgaaaacatgctcagtgacaggagccagatgaaaggccacactatgcaatcccaaccacacagaagtccagacagggagacccatgggtatcaaaagtaaagtagtggctgcctagggctgagggctgggtgggaggacagtgggataaggggctgacagctaatgggtctggggtttgtttgaggtgatggaaatgctctaaaattaactgtagtggcggctgcacacacctatcaatatgttgaaaaccactgaatggtacactttgagggagcggcaaggcacgagtatctccataaatccatttttctaaaacacgttatgccttctgacccatcactgtgctctatacagcactgactcacactaggagcagctttttagaccagcacttttggcaaaatgtagagagcagaagctaagataagaagcagaatccctcctccagcagccctggccccagccccctcccatgggacagctccatggctggtggccctcggcgacccctgccccaccccaccccaggcccggagaacacttacacatatttgctgggaatctgcccgcgctggatcttctgggcattctcgtccagctgccaagccatccaggacccgaacgtgccctggggtaaggtgtcatccacgtagaggatgtcgtccttcttaaagctcaactcttgctccacatctgccagccggtcgtacagggccctggaccacagcacagaaggaacacgatcaggcggctctggccaccaaggacgaaccaggtgccttctgtggccaggcccctaaggctgccattctgctttgggctgtctccaaacttgatcaggaatcgccgagggtggtgattctcaaagtggggagccctgtgttttacataaaggggcaaagactgcctttgctcccctaacactgagggcgcatccccatcaaagaactcaccaagatctgaggccataacttccctttccaggtggcctttcccagttgcctccctcctcgaagcccaggcccggcccctggttcctacagactggaatctctctaggatggaaatatgtcatcttctaccctagagacagggagttgtaccgcatcagtgttctcatgctttctgtgatcttggatcttaggaaatgtgaagaaagctctgagctcctcctagaaagcctgctgccatccctaaatgcccacagcatttcatacagtagtaagggcactgaagatgcctggaagtccacacacactgcagagggatctgcaaacctggcttgggggacaccagaaaaagaggagcacagcacacaggaaaacggggcttgactgcctccaaattctctaggtcttaagccctaaagagggggcccagctggttctttaagccctaaagggttgttctaagtcacaatcatctcaacataaataagcgtgcagattgagtgtcaaggaatgatgatcatggccccagccttggggggcaagaaacagagagccattcaccaggaaaagagtctccagtgaaagcctctcctctggttccaaatctcccaccgattccccagccactggtacctgatgtagaagctgtcaccaggcaggcccttggccttcgtgaactcctcagggcggtactgcaccttcaggcggacgccatccctgggcttcagcatctccacatagacttcctccactgtcttgttccgcacgtccaggctgccatactgccagggatgggggtggatgcatcagaaggcagaagccagggggcagcttgggcacccgagaggggccagtgctgaccatacggcagaaattcaacatccctccttaactgagactctggctacctcccctctgcaggaaggactgagtcttcatggtctccccagtctccaggtcctgtgcatgctccctggacaccaggtcctctgccaagtggctgccctgcccttgacagcttatccaggaaaaaccctgttctggtgactggcaagtctgggcttttcagaatagggaccttcctcttgctgatgttgcctgtgcttttatttatttattttctgaaacagggtctccctctgtcacacagactgagtgcagtggtgcaatcacagctcacagtagcctatacctcttaggctcaagtgatcctcccacctcagcctccagaatagctgggacaacaggcacactccaccacacctggctaatttttttgttttgttttctgtaaagacagggtctcactatgttgcccaggccggtcttgaactcttgggctcaactaattctcccaccttggcctcctaaaattcacaggtgtgagccaccaaacccagcccaacttgtgcctttatattctcacaaaccatctcccccatgaggcaggagaccacagagaaagaccatcctctctcatcagaacagagtcctgcagctacatcacctgagggcgagcaccccctgatgcccagggcctgagccaaggctctgccctcaggttccctcaatggcctgcctggcttcacagggacctcctcagaagggcttggcaggattctgggtttacagggattaaaaatcaaccctggccaggcacagtggctcacgcctgtaatccctgtactttgggaggccgaggcgggtggatcacctgaggtcaggagtttgagaccagcctggccaacatgatgaaaccccgtctctacaaaaaatacaaaaataaattagctgggcgtgttggcgcatgcctgtaatctcagctactcaggaggctgaggcaggagaatcgcttgaacctgggaggcggaggttgtggtgagttgagattgcaccactgcactccagcctgggcaacaagggcaaaactctgtctcaaaaaaaaaaaaaaatcaatcctgaggctggacacggtagctcatgcctataatcacagcagtttggaaggccgaggcgggcagatcacttgaggtcaggagtttgagaccagcctgggcaacatggtgaaactggtctctactgaaaatataaaaattagccgggtatcgtggcacatgcctgtagtcccagctactcggaaggctgaggcaggagaatcgcttgaacctgggaagtgaaggttgcagtgagctgagattgtgccagtgcactccagcctgggcgacagagcaagactctgcctcaacaacaacaacaaaagtcagccctgactggctcaccagatgagaggctgtactcctccgtctttggtgccacctgagatggcagcaagcccactgtgcaggtagatggaggcctggcctgctcagcagctcagaactcacctccaggatgaggtcccctggcacgaggccgtcaggacccttggcaggactgtcatcctccacctcggccacaaacaccccatgcaggttcccaccacacaagtgcaccccaagctccagctgggactttttgatgaagacaacgcgtggctccagggtcttcttgttggcatctcccgcaatcctttcaggaaaaaaacaaagttcctcaactgtgcacaaagaggaggcacaaaaagacaaagcagtggccaatgccctaaccgctttctgcctgcttcttggggtctcagaaccacagggagctgagaggtggcctctagttctactggctcggcgttcgggacaggatgctaaggtgcactggagatgaaggcaagaccccaggtccaaagccagttagcgggggcagtcaaaaccgtaaatcagtgcccctgctcccaggcccggctatcaatctcatgccttaaagatcaggatggcctccctcccatgtggatcacactcattttcctaacttagtacttcctaaggaaaggtaaagttggcctcactgtccagagcacagcaatgtattcagcaaatgtctacgaagaagcttctatagaccagcaactgctaacttgtgaagaggggccccttgccatcaaggcacttacaatcaaggaagggaagctgaaagtaagctgctgaacacatggagggagtgagatgggacagcgatggaaacagatacagggggcttcaggggagatgccagcccgggaggaaaaccttgcagcaggtaagttccaatgtgacagactctggtatagagaatgcagagctggcctcattctgtgagatgctgcccagggcttggtgaaggcctctcagtgctggagacacagctcctccaggacggcagagtgatcatgtcacaccatggcctggatggccctccctgcagccccaggccaggctggacgctgtgcagctcccatggagctccttcctcctcctgaactctgctgctccctcggcctggacttctctttatgcccactcttggctcttgcctgtcctgaacattttaatccagctgccacctcccctgccacactccagtgatcttcctgcctgctctgcggcggccggcagtgccctcccagcaccctgactctgctgcacgtgcccggcactggtctgccacctcattgggggaagcactgctgtgggtggccagagcccagggcctggccgggtgatgactgtgggaatgtgtccaaagacagactcagaaagcgagtgaacaagaaaaggagaagagaaagagaagatgcaggggaaaaaacaagtcaatagaaaacaggagaaaaagagaaaggaaaagagagagtagggaaggaaaaaaggaatgccgtgctcccggcccaactcctgaagacctggtgtgcggcctgcagcacatgaggccagctgcccagtgcccacgccacttggagaatgtgctcagccccacccagccgaagcggacacagggaaggctcacagcaacgtctgctgacctggagctgctctgcttggctgggggggtgctaggcccctcgtcctgctccatcagtgggtcgatgacagatggatgctccggggtggtggtgccactgccctggagagtggagtgggtaccggcagggtccaggtgtgagctggaggcggaggacaggagggataaggagcagtacgaagccacccagagccacccccactcctgtggcaactagatctgagctataaatggggaccaggtcacatagccctgcaccctgtgccctgagcagagcagacacattagaagcctggacccatgacatccacctgtcctctcccctccacctgtcctcagctcaggggccctctccaaaggcatctgacctcaggaagctgtgagcatcctgtctcttttcctctgcctgtgcatcccatctctcctgctgagcttgtggcgcagcactgcagggcatgcctccccttcttttctgcccttcaacccacagctcaggggcagatacagacaggtgtacagcatctgctcctggacagggagccaaacactttgagtgagaatccacccccggggccacaactcctggctaccatgggcccctgctggtcagggggaccacagccatctgtttccacaccccatttcaggaggagacagcctctctatatatgccccttttccaaaatccagggctggtcaactctctctttagcagcagtaggatccccagaacttacggctggcaccctgggtctccctaaaatgagcagagtgctgctgcacccacctctccacccccagcccagacggccctgggaggcccgcactcacctggaccgggagtggctgctgagctggtgcacgtgggggttgtactgggccaggatggtgatggtatcacactgctgcccgatgatgagccgcgcctgctgctccgtggcgctccgcaggtttatgccgttgaactggggaaacaccaggatgggctcagtgggggggtcggggctgtggacagggaggaggccctggggacttgggagcactgctgttccctaggaggaggagagggggaagaagtgcaggtttccatgggcgccatgcaggagggcagctccctctcacctccagtaactgatccccatactcgaggccagcctggtgagcgatgctccccacggtcaccttggagacgtagatgccgcccttctctccactcacgatggagatgcccagcggctctgagcccttctgcaccttcacgtggcgtggctcctccacataaggcctaaggaaaagtcaaaagtttcggggactcagggtcaaacaaaagggttggggagagcctgagctctctgatcaggcatatgatctgacagtgcagaaagggccccgagcctggatgctcccattgtgacacagctacatggggacatggtgggcccacccctgtgtgacaaacgatcacattcccacagcctcacgcaacacgagcacagcacacgcagacacgcaaccacccaggccaaagacacagagaacggtccgtgtgaactataaacactgatacatgtggattttcattacaggagaggagctgccccacaatatgcaattacaaactctggggggtcttgagatgccctccgaggaaaagagatggctcctgggatgacattccatcctaagggggcaacagaaaataatccagttttatgtttactggctacacagagtgatgcaaactggtcacggaaattaagctgctgcagacccaagcctttgtaaagggagaaggctgggagcaaggctgcagccatgcacttgctgccctggggctgtacagtgcacccaagggcgccggggcaggggctcggcagggagcctctgggcaggccaactgcatggtggaagacctgggcctggtggccacgggcagcctcagaagagatctgtggtggcagagacatctggaaggtgacaaaggttagaaagaagataagggacgctcagaggagaaagacaatcagagacacctggaacataacagaaaagacagtcaagtgatgcggagcctcccgttgggacttcacgccactcagggcttcattcctccaaggtatggacacctgagattttcctcgcaggataaaaccatatagccaaaggctgagggggccagtccaggtcccctctacagcacatggtcaggatagattctagcggggaggcacctaaaccaccccaccccggccacctggaggcagagcagcttcccacttggcagtctcagcctgtggccctatgccccagccctcttgggaaggggaaattaaaattcttcttgagttgtccctgctctctcccaccctccaaagtgttcccacttcccaaacttgcccactctggaaatcctcccttgaccctccagctcagacagatccaccccagactacacccacggtcccttccaattcaacacggattacagccccgtgctgttgagagctgcagagccctcagcacacagccacccctacatcaccctcctgccccagccttagatgatgaaacagaggcccagagcagaaagaggtccacctccgtacaacacgtgtatcacaataaaggagcaagcaactaagtcacagcaatagccacccaatagaacaatgatctgaaccaggttcccaggttccagtgacatgcaaagacgtaagggacacaccacggggtggggaggcccgatcggcatcatttcacttatatttatctgcatctgcaaacaaaagtatgtgtggatttatgcacaaggaggcttcttatgtaggacattaccaagtgttaacaatggtgtctccagttgaggggatctgagctaatcttttttttctttctttttttttggaggcagattcttgctctgtcacccagggtggagtgcagtggcatgatctcagcttgctgcaattccacctcctgggttccaatgattctcctgcctcagcctctcaagtagctgggattacaggtgtacaccatcacgcccagctaatttttgtatttttagtagagacagggtttcaccatgttggccaggctggtctcgaacccctgacctcaggtgatatgcccgtctcagccacccaaagtgctgggattacaggcataggctaccgcgcccagccagagataatctttactttatagtcttctgaatgatttgaattgtttgtaatatgcatagaagttttctctaaacaacagctgcttctcaaaagaggtttataaagtatacttaaactattaaaaatagctaaaaacataatattaagggagatttgattatgtacataaataataaagcatgtttatatatatatatatatatatatatatatatatatatatatatatccaaagggtaatggcaattgaatctcttgttgaagaaataatctgtgacttttttcttctttctacttttctgttttttattttttgagacagagtctcgctctgtcacccaggctggagtgcagtggcgcaatctcagctcactgcaacctccgcctcccgggttcaagcaattctcctgcctcagcctcctgagtagcagggactacaggtgcctgccaccgtgcctggctaatttttgtatttttagtagagacggggtttcaccatgttggccaggttggtcttgaactcctgacctccagtgatccacctgcctcggcctccttacaggtgtgaaccacagcactcggccttctttctacttttctatgtctctgattttccataacaagtataaaatactgtacttcagaatctgggaaacggggccatttttaaaaagaaagctgttgctcagtcaggtcacacatgtcaaatttcatctccaatcggatcctaaccaccgtgagggcaggagtcactcacatttttctccctcctggagcaggtcctggctctccgtgccctgtggggagctaagggaatgcttggcagtgggtggcaaggccttttccacaactgaagaacccacttcacttggggaaggtcccgtcctctctgtggccagggccggggctgagtaaaacaggccagcatgctcctgcgcgtgccacatggtaagagctccgtcagcatttcttccgagttacacccgattcccctactggggccaggcctctgtgttttgctgtccttccgttacccctcaggttctctggttggttgccttttaagttcagattttcaagtcaaatataagattttctctggctgggcacggtggctcacgtctgtaatcccaacactgtgggaggccgaggcgggtggatcacctgaggtcaggagttcaagataagcttgaccaacatggtgaaaccctatctctactaaaaatacaaaaattagccaggcgtggtggtgggcgcctgtaatctcagctactcaggaggctgaggcacaagaatcgccttgaacttgggaggcagagattgcagtgagccaagattgcaccactgtactccagcctgggcgaaaagagcaaaactctgtctcaaaaaaaaatatgttttcttaacatagggcccacccctgctgaggctcacagctacagaggcctcagctttctggactcaaatgaaagagagtatctgtgtttcttttggtgattaaataaaagtaagtttatcagagctctttaagatctacaatctagacagaagctgttaaatataaacacaatctagtaagttccatctaggggaacaacagagagggatgtgtgtgcacagtgcgcgggggtgacggattccatggaggaggtgcctctggacagacagcaagcctacagtcaacctgaaacctaagatggacctacattctaaaatgaaccagtaccagtaaaaagctaggctgcacatttatgctttcttcctgtgtatattttatttcacaacagaaagcttcgaatgagagggaaaaagcaaagggtaagaatgagtcccggtgccagccactaaccacgtggccacaggtctgtcactccaacgtctggatccagtttcctcaactgtgaaacagggataacaataataacgacactggcagggtccctgtaaggatctcgtgacttagccacacgtaaagtgcttgaacaagggcccaggaaggtgtaaatggtgccatgatggcacgatcaccgtcaggtcatttccagcatcatctactgtgagccctcttggctccctgccttgccatccacacacgccccacctccctgcatccagtgccccatggcacttactggtgacaccagcaaatgctgggacactcaagctactcctgctgcttctactaagccccttccctgcagagcccaggcccgctgccgggatgcacactgtccactggtttacccactccaccgatgaccggccatgctcacctgtcctttctccgctccccgagggacgcggggttgacagcgattctgggcaatgtggaggctgaggtctgggactggctacaagaggacagggtgtcgatgttcaggggtgactgtggaggagtgctgcattcagaatgtgacactgaacctgcagagaggagcgggtaatgccggtgtgaactcccatctcacttccccaacagccaagaccaagaggcaggtgcgatccagacacacagctctatccccactgcatcgcatagtctggagctcagatgctaggctctgcattgccccctaccccccacaccaccaggcctactgctgggctcagtgaatttttactgactgactgagatgactatgaagttctcagctaagcccagagactccaccatgaggagtcagaccgcaggaaaagcaggagagatgggaatgtcgagaagtccttacctctctcggagcccacgacactccgcggatatcttggtgttgatgggattttaatgcgttccgccttgaactgcaagttactcgaagaacctattgttccataagggaacaaaacttcaggcctcatggttaaacaccaccctgtccttcctctccaccaggctaccagtcaggataataaatgcaaagctgggccctgctgtttattcccaagggagccttgatatggaacagtcaagaaaagcagacgtttaacatttatctcaatgaactgtgcaggcccagactgctccagaacaggagcgcacaagtctcacttccagccacggaacagcagcctaagagacacggcagctgctccatcttttctccccagcgccagagttccccaagatctccatgggctacctttgtccgactctcctctggggttcactttccatacaaaaatgtatgaagagccatacaaaacagtccagaatgaggccaacaacctcagggacacagagcaaggctcctagctgaggggtcacctgaatgaccataaggcccccacagaaagcggaaggcgaaagcaatggctctgacagcagcatgggcatggctggcccatgaaggaagcagcccttcccagtagagaaatgagctcagtcccaggaggtgacaggagctcgtgtggggagcccacccgcagatctggacattaggatgcaggcagagatgaaaagcttggcaccctctgcagcacaaagtccaagtggtgcagttacccaggcgggcgctggagggcagtgagttggacccatgggtggctctcatctcggagtagtcgctgcaggtcctgtggctcaggtccaggctcaggcgtccctggtgctggacactgcgtaaaaacaagaggtgaggagttcgggaggagaaccaggaacagatgtggccactggggagaaacacacagaccaggcaagggttcccaagcgggcagaagggaggcccaggagccactgattatcagccgaggatagcaggctgccctcagccactcccggaggtggcatccactaagagccttcaggaagtagaaagggccacacacatggggcggtcagtatcatacccactccagccatagggtcaggattaggctcactaggaagaagtgataaaaaacagaggttttgcaacctgggtgggcctggggagggggaacctgtcctcccaggaagtgggtaaggagagacaaggcacagaggactttggggaggggacctatgtgcctcactcgggacagcgtgcctaagaaaatgaagggcagagcagggatcgcccacatcaggctgccctgagaccaggcctcaacagcatctttttccagctatgtaatgaggtgacatctcttccctgcttaaactctacagtggtctccactgtccttagaataaaatccaaactcttcatcaccgctgcaggtcccacagggtttgtgccctgtgacctcaaacctcttcttgactcgctgcccctttgacaagctcccacgactgtgcctgggtgccctggccttggcaccgatggcccttctccctggaggctccagcccaggtcttgtgcagctggcctctttcatccttctggtcacagcagcatcccctctgccacagggcccttcctgaccacccactctaacttgccaccctcttccaagttacagcccagcctgtcaccctgtttgactgccttcatagcctcttggcaccatctgatatcacttcgttcattttttttttttgtctgcctcccacatttgaaaaaccacacgacatgagctagaagctaatttgtttagttcagcaatgtatcctcttataattaggatagaccaaggcatgtagtaggtgctcaaaaaatatctgtcaaatgaatgaataagagtggcttggagccagcccaccctcttatgaagtaccagtttcctcatcttcaagacagaaacagtaataggacttagcccatgaggttgctgttgattcggtgaaatgatattcataaaggtctgagcacagtggctgggacataagcactcaaacatcagctgctatcactatcgtgtccttccagtaccttttgaaaccttgtgctgatgaattcagaaagcagccctaaggctccctttccctgtgctgctctagccagtcccctcccaggcaggcaaggaagcttctccaccaatgagcctctttatgcactcatggttccatgtccaggcaggcttgggcagctggagtacagagaagcgtagggtgccttcacatacctgggatgcaaaccctgggggccagcatctcgggccgcaggtggagagctgcaggggccgaccctgtgactgcgcacagtgtagatggggttccgcaggatggagctcacagtggtgctgggggtcaaactccggggaacagtgcctagaaatgggcttggtgagaaaagacgccccaaaggacccagccagcccaggacttacacaagcctttcccctgtatcccaggacgcagccgcagtcttttgggaaaaggacttgggagatgagttttaaccaccaattcacaatgtggctgtggctcctggcctgtctccatttgtaaaaaggggggaagtctctttcatgcttcctatttcccaggttgctatggggagaaagcatgttgacaagctaagacatgtcatggctataagacaaaccatcccagacaggacagcatttcccagttctctggacctcagggctgaaaacacatggcagctctctgaaatgctgcctcccctctccctggagactaggcatcccgagtttacaccgaccctcagccccagcccctggctggctgactcacccacagacggcctgctagggtatagcggggggttgctgtgccggctggaatgcccaggcgagtaaggtgcccactcctggagctccggggagagttctccactggccgggacacacttctgttcctgcagatgcaagggcaagagtgtctgctagaaagagtggagtgtggccaggcgcagtggctcacacctataatcccagcactctgggaggccgaggcgggcagatcacctaaggtcaggagttcaagaccaccctggccaacatggcgaaatcccgtctctaccaaaaatacaaaaattagctgggcatggtagtgggtgcctgtaatcccagctacttgggaggctgaggcaggagaatcgcttgaactcgggaggcagaagttgcagtgagccaagactgcaccactgtactccagcctgggtgacagagtgagactccatcttaggggaaaaaaaaaaaaaaaaccaaacagtggaacgcttgagcagctctgcaagccagtttctgccccccaggaaccagctcctcccactggggcacaggaagggacatgaatgggaacgctgcccattcatgttgccttacacatcttcaaggaagcagctttacttcagaagaaaaccacagagaatgaatctttcacagagatcacgtaaaaggtgagaatgcacaagtgcatcaggcacgtacaactctgcccgatgtggagggctgtgcgaagctctttgtccccagtgagcagtgtggactggtgcctgagatgctttccacagtccccagcaatctcacccttctggaaactatgacagcacacgcaatcaggccgtcccgctgcccactcagcctcacacgtgccacctcatctccctagcccttcaaggcaagtctatgccctaggttttattgtgtaagttcaaaagcttcttattaaaaaagcaaaccaaatgctatgcccaataaagtgttcccctcttgtgtcacactcccactaccatgcacttccacgccacttacctacctcctagctgggccacttcccacttgagtccaacagcaaaggcaaaggcaccaggctaaacaggggcctgggacactggtgcagggccacttagcagccctccttcggccaactgcccctctctaggcctcccctccccacaccctggggctcagctatacctccaggaactgagcaggaatcactactggagcaagcttcggccgaaaactgggagcagattttggccggcgacgcttctgccccagctcatccaccttctgggaggtgaggtcctcatcacaggatttcttggccggcaggtgggaggagtccccatctccttcagggtagtagctggaagcaatgcggaccctggccttgcgagggggtgatgcgtgcatgggctccccggggtccacgtcagggggcagggcgctcgggggactagtggatggggagctgcccaccagagtggcttctgactcggagctagtctccagcctgtgctggaacttaatggagtcgctccttctgggaggttttgggggtgtcagaggccccgccctcttggagggctggggagagtgagcaggcccaggacctggaagcaggtagtctattttggggggtgtctgggggcgtttgaaagtgttagggtcaaagatggactttctttgctttggctttttataaacagagagcttctcaggcactgccgtggagctgagcatggccttgggccaggtcccgccgctgttggagccttcagagtctgccttgtccagggaggcctccccaaccccacaggggcccacctcggtctcaaagggcagcagtggccgccggccacgcacgtccaccagcccaaagccacggtccccagaggcatctgagcggaaggagctcaggctacgctcagaggcactgggacaggcctgggggcagacctgcaagggtcccccagggaatggcttatgcagaaaggagctgctgcctcctggggggcctggctccttcctgtcttccagcctgtccgtgtagaagatgtctgtctgcgtggagttattgtgctgtatcaagttccgtttgttatgagcctggacctccgggccatgggctcgaaaactcagcatcttatcagagtctttgatattttcaaaaatgttctggccactccacgaggagctctgagggaatacctaggcagggattgcagaggagtgagagagagagtgagatggcaggacttggagctgccactgaaaaccatccccagaggtaaagcaatggtcaggaatgggccacctgccccttaaaaaagagacagatagacagagatgcacacacacatgaacacatatgcttctccctaatggataagttttctcatggctctggtcactctgaactcaaagaagagtcaaagttttcttaactttgaacactttctgaaattatctgggccgggcacagtggctcatgcctgtaatcccagcgctttggtaggctgaggcaggcgggtcacgaggtcaggagttcgagaccagcctgaccgatatggtgaaaccccatctatacaaaaattacaaaaataagccaggcacggtggcatgcacctgtagtcccagctacttgggaggctgaggcaggagaatcgcttgaacccggaggtggaggttgcagtgaactaagatcacgccactgcactccagtctgggcgacacaatgagactctgtctcaaaaagaaggaaattacctgcataatgtcttgaatattttttttaaatattaaacataaaagtaaaaattcattgttaaaaatatatctcttgtggtacacccagacaacggaatataaattagcactaaaaagaactgaaacaacgtgcaggaaccttaagtgtatattagcaaatgaagaagccattctatacactctgtgattccaactctatggcattctggaaaacacaaaagcatggaggcagtaaaaggatcagttgttgccaggggcttgcataaatatggggagcatagggaatttttagagcagtgaaactactctgtatgatattacaatggtagtacatgtcatcacctgcatcaaaactcacagaaaatacaccaagactgaaccttaatgtaaactatgcattatagttaatactaatgcatccacattggctcactaattataacgcatgtactaactacactaacgcaaaatgccaaaattggggaaacttggggacaggagtggggatggtggtgatggggtggttgagagagtgctaagaattctgtatcagcccaacttttctgtaaacataaaactgcttccaaaaaagtcaaataatttgaaaatagttaatttagaaaacatctcttaatagaaagttagaaaaaataggcccagccatttcattaagagatgttttctaaattcggcctattttttctaacttcctattattaaacttttcaaatatgtagaaaagtataataaatgtccataaatgtaccatctagattcaaaaatatttcactaaattgtctttttgtctataatgatactacagaacactggaaagcaagttacaaatatcatgacatgtcacttcccttcctttttttttttttttttgagacagaggttcgctcttattgcccaggctggagtgcaaaggcgtgatctcagctcactgcaacctccgcctcctgggttcaagcgattctcctgcctcagtctcctgagtagctgggattacaggaatgcaccatcacatccggctatttttgtatttttagtagagacggggtttctccatgttggtcaaggctggtctcgaactcccgacctcaggtgatccacccgcctcccaaagtgctgggattacaggcatgagccattgcacccagcttcttcctttcatttttgagatagggtctcactttgtcacccaggctggagtgcagtggcacaatcacaactcactgccacctcgacctcccaggctttttgtattttctgtagaggcaaggtctcgctgtgttgctgggctcaagtgattcgactgccttggcctcccaaagtgttggggttacaggcatgagcaaccatgcccggccatgacacatcacttctaacaactttagcttgtacctcccccaaataaagccattctcctgtataacaaccccaatgccatcatcatacctaggaaaactggcaacaattccctaagatcatctaattatcgggtccagattcaaatgtacccaactgtgcccaacatggccttgactgctgttttttgatttcagaccagcgtccagtcagggttcctgccccctctgcactcagtaaatgcccaccctgttctcaaggatcctgtgaccccaaggagtagcatggctatgtggagccggggctctgcccatactcctgaccgtgagagcagagccaggtccagcccttaccttcaggagggacagggtcagggagtcctggcagctgcgcagcagagattcacattcattcagagacttgttgtccagtgcaatgccattgatctagagcaggacagagagcatgtcaggccacaggcagagcggcctcaggcctaccagtcaggatctctgcctacctaacctcctgtgctagacagtcaccaaatgcaaggtgccaaagtcaggagttggcaaaggatagaggtctttctggtgaggcccaaggagtccaactaaggggattctgaggtagaggaacacataagccttcacagcaggctaggggaggagcatgtccttctgggatcagaacaccgaggacccggagggaacatcttggcactgctgtgcccggccatgtggcgtgggaccttggctcagaacttcccagctccttgcctccacagaggaaatggaagataaatacatgcatgtggctcgggagagcgggggactaaaaacaagaccatggataggaaaggccttgtagagaaagtaccacgcgaagtggggccctgtgagtgttcacaaagaacctctcaaccctgctcccggaatctctgctcacagctatgtgcagaccttcttaagaagtatatgtgcaaccggtgaatgaccaaactgtgatacacccacattgcagaacactgctcagcaacgataagtaacaagcagccagcacacgcagcctcttgggtggatcttgcaggcatggtgcggaatcaaaacagcccagctccaaaggtcacatactatatgattccatgtctgtaacattctcaaaaggacaacatcacagagatggagaaaaaatcagctgccagggggcagggatgggagggagcagggggtgttactacaaatgggcagtgggagggagacctcagtgctgatagaacagctacgtatcttcattacggtggtggttacacagaacaacatgtgtttaaccacacacaaccacacacacacacacacacacacacacacacacacacacacagtaccaatgtcaatatgctagctttgatattatactcatgcaaggtgcaaccatgaggggaagcagggagaagagtacataggacccccctgtactatctctgcagcttcctatgaatctataatcatttcaaagtcaagttttcttttttttttttgagatggagtctcgctctgtccctcaggctgaagtgcagaggcatgatctcggctcgctgcaacctccgcctcccaggttcaagcaattctcctatctcagtctcccgagtagctgggattacagatgtatgcctccatgcccggctaatatttttgtattttagtagagatggggtttcattgtgttgcccaggctggtctcgaacccctgaactaaggcaatccacccgcctcggcctcccaaagtgctaggattacaggcgtgagccaccatgcccggccagtcaagttttctttttaaaatatctgcagagtgattatctggaagtagtaaattaatttgtggttttttccttataacatatccacatttaaaaaattttcatagtggccatatagcttttacactctggctccccaaaaaatctgaaaaacattggcaaagatgtgaggcaatgagttcccccacacactgcagggaggactgcaaaagccatgacctttttggagcaaagggggaagatctcgctggatgttaaacattcatgtcctctgacccagcaaaccccacccccaggaatgtaccccagggcacactcctgggtccctatgaagtagcatgtcagtggccatgcagcacgacacagatgtaagtaagggcagagatgcccagactatccctcgggagggactggtcaacaacttaggctgctgccactaaggaatgacacgcagttatatgccttggggcagatctaaagacgtgaatgtgggctgggcatggtggctcacacctgtaatcctagcacttcgggaggctgagggcagatcgtttgaggtcaggagttcaagaccagcctgggcaacatggtgaaacccccatctctactaaaaatacaaaaaaactagcagggcgtgatggcacatgtctgtaatcccagctgctcaggtggctgaggcaggagaatcacttagacctgggaggcagaggctgcagtgagccaagatcacgccactgcactccagcctgggcaacagagtgaggctatctcaaacaaaaataaaaacaaaaagacatgctgctaaaatctggctgggcgtggtggctcacatctgtaatcccagcactttgagaggccaaggcaggtggatcacctgacgtcaggagctcgagaccaggctggccaaaatggcgaaaccccgtctctactaaaagtacaaaaattagctgggtgtggtggcgcatgcctgtaatctcagctacttgggaggctgaagcaggatagttacttgaacctgggaggcggaggctacagtgagcccagatcacaccattgtactccagcctgggcaacagagtgatactccatcttaaaaaataataataaaaacaaaaacaaaaagcaagatgagcaactgagtatattataatcccatccaggttacctcaaccccccaaaaatgtgtgagatgtacatgttttgaaagtgtctgggacataatataataaattgttaacagtgattgccatcggggtgggaagcagtacacaagaggtctagccagaggaagatttgttgtcacgatttgccttttgtactactggaattttgtatgtatgccatgaaaaagtgtatggcattttcagtttttgttttttatttattagagacaggagtcttgctctgtcacccaggctagagtgcagtggcgcgatctcggctcactgcaacctctgcctcccaggttcaagtgattctcctgcctcagcctcccgagtagctgggattacaggcacccaccaccaagcccggctaatttttgtatttttagtaaagacagggtttcaccacgttccccaggctggtctcgaactccctacctcaggtgatccacccacctcggcctcccaaagtgccatgattacgggcgtgagccaccgtgccccgctggcattttcaattttaaaaggtcagaagtattaaatttgcatgtcctatgactcagcaatctcacggcatttgtagcttagtctcagagataccattacatgtctccagaggctctgtgcacacaggtaaagttcaatgcaggactgtttgcaattgcagaccctgaaaacaacttctatgtccatcaataggtggataatttaaactacatataatcaaacaacagaataccataaggtgggtaacattagccaggctacacttggaaagatatccaaggtaggatgcgaattgcagatcccattactgtacataaataagcaaaacaacaccaagaaatctatctaggtatatatagatttgtaggggcacatatggtttgggctgagtgcttatcttctaaatgggggcagggacaatctctaggagcaggattaaagggggaagaaagggactgccacttttcactttacatatttttatattgcttggctgttttacaacaaacaggacttactttggtaacaaaaaaatttaaaaataagtattacatttagttaaaaaaaaaggggtggcatttaaaagtcacaacacaatgatgtcaatttttttaattgtccttgataaacattcatgagaatgttaaatgtagagaactacatttaaaatgttaataaagctgggtgctgtggatcatgcctgtaatcccagaactttgggaagccaaggcgggcagatcacctgaggtcaggagttcaagaccagcctggccaacatggtgaaaccccatctctactaaaagtacaaaaattagccaggcatggtggtgcacaccctgtaatcccaactactcaggaggctgaggcagcagaatcacttgaacacgaaagtcagaggttgcagtgagccgggattgcgccactgcgttctaacctgggtgacagagcaagactccatatcaaaaaaaaaaaaaaaaaaaaaaaagttaatagaggttatctacaggtggtaccaaagcaagtggttcttatttcccgcttaggcctttggaggttgcagtgagctgggattgcgtcactgcactccagcctgagggacagagagagatagagaaaggttatctacaggtggtagcaatgcaattgattcttatttccctcccagaccttttatttcctaattttctacagtaaatagaaacataccatcaagaaacctatttttaaatgttcacatagtacaatgcccacaacaaggaaaatataaaaactttgctcattacttcttgctcaaacctcccaaatgtaatctgcctatgcacggcagatgaccctggctccagccttgagacttaccgcaacgatcctgtctcccacagcaagggacccttctttagcggcagggcttccaggcagcacagcggcagcatacactccattctccagactgatgccactgtctgcaagccacaggaggtcactgggtagcccctggcctcgctgcccagccctgggtcaccctacctcatctttgttaccatcttcttacaaaagaggatgtcagcaggctgcgccctgtctacgcctgcaccctgccccagtcccaccaatcgggggctcagttacatctaccctggtgaatcaaacactcagaaagcaagactcagggcccagaccacctcttgccagaaaagcacatgggctacatttaaatggcattggcccctcatccctgtgaatgaggtgctctaaggggcacccccggcccctgtccacaaaaaagggccccagccacctgaggcactctgccatgttcacaggcccgctacctttctgtccactgaggttgatgtgcagcggcgtgaccaccttcccacccagggacttcctccgccgcacgaccatgttgatggccccctccccattgaggagcgccttgatggcctgcttcttgtccttgttgatgaggtccacatcgttgattctcagcagccagtcattgaccctgagaaagggcacagccagttcagcacccacacaggctgtgggaccagcggctaccgcccacaactctcactcagggggctgactgccaaggagtgggtgcctcacatacacgctcagaaaatctcctcttgcaggagtgcacagtggtgaaatttgcaaatgctgaggttagacagcctgggttcaaatcctggccctaccacttactagttgtatgacctagcccctccaggcctcagcgtcttcatatgtaaaatgggggcaataatcacgcctaccttgtaggattgtaaagattaatcaattaatttctataaagtgcttaaaccagtactcagcaaatagcactgtaatagtgttagctattttatcatcatgactatttccctgaatgagcatgccatgtacatcctgggctctcacgcataccccttgagcactttcccacccaaaggagcaaaagacagtacctggtaactaaagaataatcagattcagaggcaactgagaagcactgtttctttcggagcattattagctgctgagactgcaggccttggacagactgtgtgtgagtctaaggctgggaaacgttcacctaagtgctacctggctctcttcgggtcctctgcactgggaagaagggccccaccttgcctccagagcctgggcctcaactcttaccttaagcggccatcagcaatgcttcctttgtccactttagtgacaaatatgccacagtcccccgggaaacaaggctcattcacaccttctgccatatcaaaccccagtgccttcaagtcaatatcctcctgcaaaaacagcagcaacagcaacgcatttcacaaagcagtgacagagacatttggctcttaagccccgaagctgcccactccaatgtgggggactgtcccttcacctcatctgataagacactccatccccaggatggaaacctatgagtatctgcaacctgccccttctggccactgcagacagacatccctgtcagcgtcctccgaggaccctgcccttccccagctgcaacccagcctggacagctgctgggaaaggatgcctcacactcctgggaggaaaaggagaacctccaaacttggagtggtgaaactgggagatactgcaagcgggtcaccgtctcctccttcatccatcagagaaggagagaagaaccatcagaggcagcttaccgtctccctctcgaactctacaacttccgtttcccactccatggaatccgtgtcaatggccgagtcgtgggagctgtgggccatcagctgtcggaaccgggcctccttttccaactgggattccatctgttccctgtgaacagagagagccacggtgacagccccttgggaggtgaaacatcccaccgcgtaacggctctgaacctcacgaggcaggccatttgaaacagctaaaatgggttcctttcccccttgtttcccaataactcagagtcaggtcaaggctgctgggatatctgtgagttttcacagtggttttttaaaaaagacaaattctccccaaatttatctagaggtttaacacaattaaaatcaaaatgccagctgggcacagtggttcatgcctgtaatcccagcactttgggaggccgagacaggcagatcaccagaagtcaggagtttgagaccagcctgaccgacatggtgaaacctcgtctctactaaaaatacaaaaattagccgggcgtggtggcatgtgcctgtaacctcggctactcaggaggcaggagaattacttgaatcagggaggcagaggttgcagggagtggaggtcacaccgctgcactccagcctggcgacagagtgaaactccatctcaaaaaaaaaataaaatttaatttaaaaaataaaatcaaaatgccaacaagatttttgtagatatagacggctattctaaaatgtatacaaaaaggcatcagaatcactaaaactattttgaaaatgactaaagtgggaggaaactctctacccaatttaagacttagtatacagctacagcaatcaagactgtgtgctgctgtcagggagacagacacacaggtctgtagaacagaataaggaacctaggaatgccccaagtcaccaaaggtgcataagttaacagaggaaggacagcctccaactaatgatgctggagcgactgcacatccatggccaaagaaatgtatctcaacctaaaccacttaacctcggataaaagttaacgccaactatatcacaaattgaaatgcaaactgacagaagcagcaacagaaataccacttaaatagttatattaggatgaagatgtagttcttaacatttcctttaatgccattgttacaattttaaaaaatgttcactgatggccggatgcggaggctcacgcctgtaatcccagcacttcaggaggcagaggtaagtggatcacttgaggtcaggggttcaagaccagcctggccaacatggtaaaaccccgtctctaccaaaaatacaaaaattagccaggtgtggtaacatgcacctgtaatcccagctactcaggaggctgaggtacaagaatcacctgaacccaggaagcagaggttgcagtaagcaaagactataccactgcactctagcctgggcatctcaaaaaaaaaaatttgatagatttgacttcatcaaaattataaatattagctcagagaaagacctagtaatgaagatgtgaaagagagactcagaagcctcgttatatcctcaggtgacttgcctgtgacacccttcctgaaatctgggcccaggctgccttgccagctcatgaacactgcccactgggctcctgacctacttgtgtttcctgctccagcagacaggccccagggccgcacctttgcctaggctgtgctctcaccagccagctctagaatgccactcagcctccagggcagagctccaatgccttccaacactgccccagcccctccccaggccagtgcagctgagctcagcattcattgctcactatacctgtctcatctggcattaccagggagtgcctgaggcttcccaggcagcaacacagaccccctcaccagcatcctgccagttagagaacttagcagacaggaggcacaaatgcaaacatgctgaatgaacacacaagctgaatgcacaagcttcaggcaactctggcccaaacaagaggcaaaatgtcccatgttcacggccagagattctaggctttcccttcgaagagaaccccttgattccatcacattgctagacccaagatggttcctgtgaagagtcttgccttgcctcttaacccctataatattcctgagagcacccaagctccagagagtctgggtttttatagaataaatggagctctttgtctcattaggaattttactgaatgggaaagaagagaagctgtcactcccttctgacgggcagcacttgagtgtgcaaggcttgcacacttgcactcacacacgagcttctcactgccccctcaccacactaacagctagggaaatgtcgcacaatggatggagagccactgctttcctactagatttgggttttagaccacggcctattgggctctgccaatttctatgcttaaaccctgatctttgtatttcaatgcactactaaaggccactgagtgtttaaatgacaccctgggaggctgctgtaatcgaggggaggatgtctgacaccccaaatggtcttccaaatggacgtccaaataacacaagcagaacagactgctggatgggggttgcaattgcctttaaaactctaatcacaatctgtcgtcatcttactcatttacgtacttgtctcttagatggacctgaccttggtctgtgtctcttcctgcgcactgtgagcccatgaggaaagggacttggtatgcttgtcagtgccatttctccagtgcctctaatggaggctggcccatacagagcaggtacttaaaaaatctctgcgagtgagtgagtgagtgagtgagtgagtgagtaggggaatgaatgaatggataacacatgcatgcctgccccagatggactgcttgggaacagggtcctcccttcctagtgccttggcacatggtgcctgccctgtgtctaagaatttttggcctaagaatttctaattaaccctacatggagatgacattcgaacccattctacacactgacagagtaaggcagagtgaagtgaagggacaaacagccagctcgacgcagaaggatgaggccctggccaatgcactcagcattgccttgcccagaagggagaggggccccaggctcccagatgcatgcccactccagcgggtgcccacccgagcctacttgagctccttcagctcgcggctgacatcattcttctgcttgcgggtgtcatccaggctgcgcagggcctcagccagctcgctcaccgcacggtcccgctcccgcctcaggttgtcacacagtgtcctggtggaaggagcagaggacaaggtcatctcaagaggcatggggaagggggttcctggtctgcagcggatggtctggccacctcactccaaatacctgccggcacctatcccatccccagatgcacaggaacacttgggaatctaggggtaagaccacctaggccagccccagtgcatgacagagggaatgtggaggacctgggcagggaagagacacccccacagtcacccggcaacaagtgtcaggttcccaatgccctgtttcaccctcaatgtgcctggggttaaggaccaccctctgcacacactcactgttctaatgccaacttggggagccagggggtggctctcctctgcatgaagcaccccccacctgcctggcaggcctgtgctccagcactaccacatgtctcatatctacccacaggcagagctttctagagctgtccctgtaccctgcaactaggaagggagccccttcggataccagccagtcctcatgcatctctgtctctattagctctgtgcaggtgcaaagtacaagcttggcaagactctatgaaagaggaccccaaggaggtggaaacagattacctggctgtggaggggcctgggctctgtgccacctccagaaatggacatacccagaggactggttcctacctctccacagcctcgaatctcccccagcctcagtcagagcctggctgaggactgccccctggagacacccgtggaaggggtctgagcagaagcagacaggaagcagcccctgggcctccctccccttgcactgggcacctaactgtgctctccattagcagggcctcaccacctagccatcctcatctcctgaccagcccctagagacattggtctctcccctgacaaaccacaagaaatcttttggacacctcccaaatagcaagacattatctctccccaccccaaacatcaccaccaccatagcctctcctggttcctccccagccaaggatcaagcccacactgcttggcttccctttcaaggcctctacacctgcccctgggaatctcgccagcctgccctccccacgacttgcccacgtccctgccctgagcacactccacaggtgccctccatctgcaatgcccttcccccttttccacctggaaaaaccccactcatgcttccagttctagtgcgaatgccacactctctggggagacctccccacaccccagggagccctgcatgccccccacagccctagagctcagttacacatcttcctccctcactgccgtgcctgaccaagcctctcccaaggtctccttgctccagagatctaagaccctggcacacagtaggcgcccggtgaatactgctgaaaggacacacttcggatgtgctcttctcatcagaaaccctcaaataaaagaggtcggcctcgtgccccttcacagcggtctcacgtggacatagtacacacttgggacacctagggctgagtgagatgggagggagaaacaatggaaaattctaaaactaagaggcaaggctagggcatcaactaggggtgagaaaggaggagcccaggtccctcccactttacctggacatacagtaaatgattccgaccctcccaacagaccctagcaggtcccctcatcctggggagacgcaagcccacgccagcttgaggtcaccccataccggatgctgtcacgctctgctacaatcttgtctcgctcctggaaggcccagtcccgccggcacttggccacatccgcctcctggagggcttccttcagctcctggcacagagccttgcactgctttcgaaggatttcaacctccttgttggctctcccagcatccattgtcaccgtgtctttgatctggtgggagcaaggggcaggaagagggagaggttgctgagcctcatggaccaggagcgcctcccaccagtgcgggggccaaggctgaggctctagggagctggatggagggaaacacggagcccatcgcagcacaccccatacccccagtgactgcaccccacagccacggtcctattaaccagcaccccctagcccccgccatgtctgtgatcctataatctggcatactgagttatttttaaagacaaaaatacaccagtattcctgctggtgaagtgctgtgtatctcagttcatttaaaaagctgaaatccaaagcatttgcatcttgacacatccctagagagttatatgctccactaaaatttcaagtcaaactcttagtagcactcatatgaaaaccccctccacacctctataatccttagacaacacagggaaatgacggatgacaaagcaagtgtttactgcaagaataactcctcctcccgcttgaggctttccaaacatgcaaaagagaagcacgacagcagaggcgctgatgacactggtgtccccgccccgagactctccacccccaagtgctaggacacaggaagacacacacgcacaggaagaaagcttccgttccctctaaagatcattctccagacagcaggagacagcagcctctacaaaaatgtgttcagaaagatctcagacgtagaaaacaagagaagagaatgaagttgacaagaaaacacctggagtcagttgataattcccctcatctctgaaaacagaggcagaggagctgaaaaataatttgcacaaaaaggaccatcaaaactcgagggtgacagtgcagtggcaggctttcctcagacctcacggtttctgggggtcattcaaatcatttcagttttgatttttttttcagctttacatggtatgctgtgtttgtttagtttgctattttcaaaaaaaaaaatccttcttaaattttcattttaaaaagaattatttgggggcagggtacagtggctcacacctgtaatcccagcactttgggaggccaaggcaggcagatcacatgagatcaggagtttgagaccagcctgaccaacatggtaaaaccccatctctactaaaactacaaaaattagccagacatggtggcatgtgcctgtggtcccagctacatgggagactgaggcaggagaattgcttgaacttgggagactgaggtctcagtgagcccagatggcgccactgcactccagcctggacaacagagggagactcggtctcaaaaaaaaaaaaaaaaaaaaaaaaaaagtgtattaatttagtcaagaatttatgataaacaatactttgaaaaatttacattatatttgctgttttacaatatatttatggatagttttagagctgacacgttaccacgtggattccctgaaaggtttctccatggtgctctagatgagcatctaggagggaggccccaggtgcagacaggacgacaggcagcgcaggaggtgggcagctcccccagcccacagctcccttcctttccctgggccccacaccattgctggtatccaaaatgaattcatccccaaaatactgcttccttataaggaatacaagaagtactatacttagttttagtgagaggggagagggaaatgaggtaccttaaacaaatggtaaaatttggaagcccagaggacccaagtgacggactgactgattctgattacactggtgaggaaccgcaggatctagaagtgactcgccagggctcccccatcctgcagagctgatcagtactggctcctctaccccaggctgcctcggcatcagatgtcagtctgagtctgctctaaaagcgccacctgcagtctctttcttcctgtgctgggtgaacaaaggcgtgggaagagatgggctagtcttcacaagacacttgccagacccaggcatgaggccagtgagaaaggcctatgggctgcaacccagccccagagggccagagcccactcgagagtcccaggggaggatggggcccgagtgtggagtggtgcccctgagcagatggctctcgggtgagggcacctccctctgcttcctgggaagcttctcttgctacaacagccctctgcctctaagttctggaaaggccactgctgccttgccttgtcccctggcactgtccagtctatccaccacagctgagctcagctcctcaagcaggacctgtagctgcatgtgtaactgcattcagggcagcagacggcaggagcatggggggctgcccttctacagacggaactcggtgagcagggcccgtctaggaaagtgcgttggaacctgggagatttctgcaacagacagcagtggcctacagcttccagtggtgccgacctcaactccccaggcagttcctccctcctcctgggagcaatgagacttccccggacaaggtcagctactggcctgaggcaggagggcggccttaggggagctcccgaggatatctctcccctgggagctgggaagaagaaggcgagggaggcaagggcacagccaacctggcaaagatcctgacaggcccccggcctccccatgctacctctttgctccctctttgcctcagcccactcagaacacagaagggagagagggcatagagaaggaaaggggaaaatggagcaagacgtgcagatagaagacagaagcgtgcaagcacgatgccagaaactgaagcccagccctcgggctgagcaagatgaagatggctctgcggtgagggagctagacctgccagaaggccccccacagctgacccctgacaggcagcagccagtggggtggcggggccaatccccagggtgcctcactgcccacccctcctggtctgctcttgccggtggagagtgctctcttatccatgaagccagaccaacttgagaaggagctgaggatttcagctctcagagctgatggggcagccgcgggggctctctcctgcctgctgactcggaacagggcctggaaaagatccctgcctcagctgacaggtgcacttgatgcccagtcaacaccccctgtggaggatggaggcgggctccaggctgaatggctcgcctgagtgctgggaatgcggtggttgccgcaaggacgtcaggcctggaggtctcattgctggacgccagcaccacagggaactcaggtgttctttgtgcatctctgtgctttctatatttctacaaacagtcttcacgattaacttcaaagatctcaaaacttggccaggcgcagtggttcaggcctgtaatcctagcactttgggaggccaaggtgggtggatcacctgaggtcaggaattcgagactagcctggccaacagagcgaaaccccgtctctactaaaaatacaaaaattagctgggcgtactggcaagtgtctataatcccagctactcaggaggctgaggcaagaggatcgctggaacccggcaggtggaggttgtagtgagccgagatcgtgccacttcactccagcctgggcaaaagagggaaaccacatctcaaaaaaagaaagaaagaaaaaagaaaatctcaaaactccatccacacgggctcgctgttattccccaggcgtgtgtctgacattctgtgacatttcagagcagttactgactcggtcattttccaagtttccttcttcatcattttgttttccttatttgatattgacattttccccaaaaaattatgtgctcagataccaggatgtgaacatgagttcacggtttttctaggatgattaccaaattctaatgcattatctttacttattaaaaatttattctaataagcttttcaaaaatttcattgcagtaaatatttctcttcacactggcttttgcctcaagggtctggagaagtcttggtggttccttgtatgaaattcccattacttggctggcccatttttacccacagaaacagtttaatgaggttcaccctaatcctaacagaggagtaagattcagacgggcataataatgaatgcccatctcaactcactgttgctttgtgcaggcacaatgatgtattttctatattgaatcatttgttcatcatgaccaccattccattgtgcaaatgaagaaactaaggctggctgggtgcaggggctcacgcctgtaatcctagcactttgggaggctgaggcaggaggatcgcttgagcccaggagtttaagaccagcctgggcaacatagtgagaccgcatcactacaaaaaaattaagaattagctgggtgagctggtgctcgcctatagtcccagctacttggggggtctgaggtgggagcatcacttgagcccaagaggtcgagattacagtgagctatgattgtgccactgcactccagcctggggaacagagaggctgtctcaataaaaaaataaaaaataaattaaaaatagaaactgaggcccagaggccaggcacagtggctcaccaggcggtgaattatacttgtaatcccagtactttgggaggccgaggcggaaggatcgcttgagtccaggagttcgagaccagcctggccaacatggcaaagccacgtctctagtaaaaatacaaaaaattagccgggcgtggtggcacatgcctgtaatcccagctacttgggaggctgaggcacgagaattgcttgaacccaggaggtagaggttgcagtgagccgagattgcgccactgcacttcaggctgggcaacacgagactcagtctcataaaaaaaaagaaagaaagaaacggaggcctagagaggttcgagaccacatgactgaggagggccatctcccagcaaggggcctgtgtctcatgcattccccacatcccctaccactgcccaggcctgacgaggagttgctgtcggttgaaagacatgctggtcaccccctgggcatcacctgcctcacacttggtacagcaggacctggtagtaatgatccaatgcataccagccctgccaatctgcctgacctttaaacgccttgctttttgcttctcataaaccacctttgaaagctgcattctaactgacctgcacagaaaggcagaatagagggatgtgaatatctgagaactattctgataggaaaaaaatctgctgtgatcaagtctagaagctctaatcagagccacacacaacacagactgaagggaatctccatgggcccatccaagcccccgcagggctcagctagacctagggcaaggagctccgcgatgaggagaggttgacaggtaggaaggagacagaaaatccacattggccacccaggagttgagctaggtggcccaatctagtgctaccaaacatcccagccccccaaccctggaggtgtggcccccagagagcaaggctttaggagaagaatgttgggctcagcctactagcacatcttcccagcaggagcctgaaatactttttcaagagcagactcgtgagatgcacactgctggtgaaaaagggcccctgagggtgctcttccagacacaagaggcctaacgtatctatggctttgggaacttggccttggtatcttgcttcataataagcaagtccttgagatatcactgacttcagcatgggactgatctgcaattacgtagcaatgggtttgggtgtgagtgttggtgtgtaagctccgggcagccatgactgtgtctgggtctccctcccgccttgtcccctgtaatccagactagagctgggcattaagcatgagctcaggcagtgtctgataacccagcttgcacttaggcctccagtgagaagccatttactccaactcaggaggcttctaatccggacaccacgcactctgcagcccctcttcccgggatgctgtaggagaggctgaaagccagccaccggcccacccacctacctgccgcagcgcctccatctcctcattggccgccttcttctcagatgtgctgctcttgagcttggactcggccagctccacttcggtctgcagcttgtccagctcagagatgacctggtcacgctcactcatgatgagcttgtactcgctgtacacagcgtcccgctcctccctgtatttctccgactcctttgctgtcttcacctgcgtggttctcagctcggtcagctctgactgcagcagctccatctcccactgcaggtccttgttctgcgccgtggccttgttcagctcatggtggatcgcctcaaacctggcaagagaggtggcgagatgtgggaagggcgggggccctgcccggtcagtggccggctgcgctgctgcctcccgccagctctactgtgctggacagtcaagcgtgaagtttcaagtgaagtcactctctccacccccaggagagaaaagtcatggagtaccagtgcccccggacctggaatttttctcagccctttacaaatgccaggagttgaactgaggacttcatgccctccactccactagaaacaacagcatatttctcccacagtcaagccacattaattttttaaaataataaaaacaaaacaatgccaggataacagcataaagaggccttaacgatcatttagtcaaaccgcctcatttcacagatacgaacagtacagccctgtgacaaggtcatcaagttcgctcgaagagcacagctctgtccttccaggccgggggacatcttccacacaggcagcctgcaaatcagagcccatggctccagaccagcaattctcagtgtgctccatagacaccggttctgcatggagctccattacccccaaaaaagtatattatctgatgacttatgtttgggaaactctgcatcttggccccctcttggagagtctgtctactgcacaacaccacgctgaaggctctgagaagtcctgcagcagagacatctgtctgggttcaacctggcaatgctcaaacctatttatccccaaagagcacttttcatgtgaaactgctacatgccccagagaactggtgattcacaggcacatcctctacaaaacactgtttgagggcatatatcacatctctaaagatgacagaagacacatgccccagataattaactttcctatttgctaggtgggtgactgccacagaggggagaggcacatgacagtgaccaaagaaacaggatgctcagaacacaccagtatttattaagtattgtgcagagcagttaacacagcagacccgagatttctacacgctcagaaaggcccgcttgcaaggctaaccactgaatggtgtccgtgaacccgaaggtaaacagggatgttcagatgggaagagggagccacgattcccaagacacattcagtgtcaaaaaaaaatgtttcctggtcagaagcattttttgattgaaaaagcacaataactcatgctgttctcatcccctggtggtggctgggaaccttataggacccatttgcccccggcccccgatggccctagccctacctcctcagggagagggcgcactggtgctgcagctggatggccgtgtccctctgctgggtcagcatctctgtctgcttcagcaaccgctggttctcctcccccagctgctccaggcggctcaggtctgcattgtggatggcgactttctcactgtacctcttccgaagggcgtcatagtccttcttgaccacctccaacttgtccatggccgtgtcatacagtttgttgagaatctcggatgacccgttgtgcttcaacacctggagaccagacagtttcacttaccaagggtctgtgggaggtggcggaggagacctcccactctcacttttgtctatctgagggtgagactgatgacaaggcggttggggggagggggttaccctaaagcttttgagagtcttgaggtccaattctccaggccctgcagtcacactgggctgattcatttagattcactcagtcacaactatttactaagtattgtgcagaacagttaacacagctgacctgagacttctatatccttagaaaggcctgcttgcaaggttgaccctaccgaatggcgtctaggaacccgaacagtaaacagttctctaggctgatgtaaaacttttcttctggtgatataagcagctctggtactgagcctgtacaaataaagtggcttatgctgaacacctgctttctactgggagtccagaatctgggtacatggcaggcagaagttcctacatgaccagcccccaataagacacttgagcactgagtctctaatgggcctccgtggaggccagcacttcttgtgtgttgttgtgattccatgctggaggaattaagtgcctccggtgaaactccaccaggagaggattcttggaaactcaggcccagtttcccctggactttgcctcacgcgcctttccccctttgccgactttgctctgtgtacttttgttgtaataaatgtcagccattgagtataattacatactgaatcttttgagtcctcccagaaagtgacatagcccagaatcaggttatgtaaatcggacctaaagactctcaaaagccctagggtgaccctccatggtgtagggtccccccgcatcccatgcaagtacctaatatgtctagcactggtctaggggctggtgatgccagacaggacagaaagacgctgtgccctgtgggccttttatcctaatttggagggtgtggacacacagataggccaaataaagtaacttcagagcaaggtaagaactatcaagaaaataaaaaataaaacagaataatgggctggagagagccatctgagcagcagagtggaggtctgtgagggaggctaaggctgaagaggcttcttgaagaaggcgacttcagaggcaaatgaagaagagcagcgagagcacactgggcagagaggggggcagggtcaaaggcccagaggcagggcctgcaggcgtgttctagagacagagaggggcaaggcggagtagcaagagcccaatgcacagggggaggtgggttcaaaggggacctggagaagtgggtgtgggcatgggggtggccatggccgcaggcctcacagtgaagactgtctcctgagtgagacaggaagctgtggagggttttaagctagacagcattctactctaaatgacaggcactaaagttcatttggggtgctgttatagagaaaaaaacaaaccaagaagatgagttaagaggttgccaggggggctgctggctttggctaagcacctcatgggatctgagccctggggtgagtcactccacctctctgggtttcagcttccggattcctcaaatgcccaggctagaccaggaaagcttgtctggcccttccagctccaacagccgaggaatcacctggctcattcagtggcagcctggtttatcaagcgtttgcagcctagagaaccagaagctgggacgatggaacactccctttggaattagggtcagctctcaataaacacgaaaaacacaaaaagcaaaagagggcttaatttaaaagtcagaatcatagcaacaagaaagtaaggtcttcctctaagacctaagcattagattctaggactgtagactcttaaagaggaagtcaaggaagagggagaaatggagggaaggagggaagaagggaaggaaggaaggaaggggaggagaaagagaaagagagagaaagaaagggaaaggagggagggagagagggagggaggattggttcatttcaggctcattctttttcctttatttatttttaaagcagaacattttctttcaagggaaatcttactagtacaccaaaaatacagaacttattttaaaaagcagtacacaggtatctcaggcagtcaaaatcttcactgttttgtaaaatggcatcactgttgcaaaacaggaatgcacactgagaaacagaacctcactgacagtgcccactctacatctaaaatctttctttaaaaaaaaaaaaaaaaaaaaaaagccctggccaggcacagtggcacatgcctgtaatcccagcactttgggaagccgaggtaggcggatcacctgaggtcaggagtttgagaccagcctgaccaacatggtgaaaccttgtctctactaaacatacaaaaattagctgggcgtggtggcgggcacctgtaatcccagctactcgggaggctgaggcaggagaattgcttgaacccaggatgcggaggtggcagtgagccgagatcacgccatggcactccagcctgggtgacaagcgcgagacttcgtctcaaaaaaaagacgaagaatgggctcaccatgactatactgggtcagtgaaggacagtcctgacatctggtcaaccaacgccttctacccacatctggaaaggtccagcatctaaactggattgccctgattggtgagcaatacctcaaaaatgccaattaaaaattacttcaggccgggcgcagtggctcacgcctgtaatcccagcactttgggaggccgaggtgagcagatcacaagattggaagttccagaccagcctggctaacatggtgaaaccctgtctctactaaaaatacaaaaattagccgggtgtggtggcaggcacctggaatccctgctactccggaggctgaggcaggagaattacttgaacccaggaggcgtaggttgcagtgagccaagactgtgccactgcaccccagccttggcgacagagaaatattctgtctcaaaaaaaaaaattacctcaaatgttttactgtctaaacatcccctaagccaagtgagaaccccattggctccaaatgagtctgctttgctggggaacaaaggaggctgtcattgcctgagttccccacaaggtggcagccgcggggagacgagccaacgctctcctgcagcggcttcccgccttcccagctcagaaacaaactcattccaaaggcagccttgaaatgacacaaagcccggttctgggtggtagcccgcagagcccacctccacaagtgctcggcagaatcaggagtctataccatggtttggcctctttgcagtcccctgaatggctaaccttgaggggcctggatccgggcctgtgtgacaatccagggatgattcagggccgtgtgaatcaggctgccagcaagggccgtgagagtgggccacgaattcccagtgcgacagggtgggtcacagacctcgaggtcctttcagctgctccccccagccttcataacatggtaggatcctcgggtcagaagaccgagagagagagatcaggccccgtactgcttgcttccaccacgatgacggccaccctcggcctgctccacaagtgaaagctccttgggatagggtcgtgctcaccgggagctactccgcctccctgcaactcctaacctctggttctcactctagccttggagtcaaacagaataacctgttcccacagggcagcatccagatactcaaagaggctcgcaggccccaaacacttctcaccctttctctacaaacaggactcagtgccaggcctgtactatgtaaccaacagcctctgaacaaagctggggaaccaggtcatggttaactccggagaatccaaaaaactaaatctattggtctagaatttttccctctcgccatcagaggattatgttcttggtaggtatttccacatgcacatgcacacacgagtgcgcacacacacacacacacctaactacagtcaaatgtttagcttcccagcaaaagctaatgaagagagaatatttaaatttggcccagaattctaaaattaaagtgatcacagttcactgcaacctcaacctcccaggctcaagtgatcctcctgcctccgcctcccaagtagctgggaccacagacacgccccaccacacctggctgattttttattttttgtagagatgggggtctcactatgttgcccaggctggtcttgaactcctagactcaagtgatacacccactttggcttcccaaagtgctaagattacaggcgtgagccctgagcctggcctgagagtcaacttttccactcaggcaggcagcagtctttagagatgatgtccctccagcctgagcacgggacagttggcctgtgagttcaaggggcttaggagaaatgggtggaagttgcacaggggaggcacaaagacagccacagtctaagctgttccctgcagggaggccaggaagagaccaaccctcctacctgtaccctacattggtcagaacactcctctgtgggcttctctgtaagggatgcccttcagcaaccaggaaacccctctcctctcttccttcctccaggcccatcaaagggcattcattcaggatacctgggacaagaaaatcaactttcatgaattacaagagaaagtatattttaaagacaggggaaagggcaaggaggaggagagagaagactctcggggcctgagaggtttcccaaatagattagcaggacctaggagaacatgtgcactgccctggtcccaggaattctacctgtaaggctcaaacttcaaaacatgtgtgcaaaagaacacaaagacatgtgtgtccactgaaacatggtttgtaacatgggaagatgttgaccaccaagacgctccacacagaattcgattaacacctgacagacaacaaaacaagcaaggacctttttgtatgtgcaaattcacagaaaatgtaaggaaacccatgatatattgtaggatttttttttaaagcaggtttcagggaataaaaattaaactatatgggtattaaatgtgacattaaaaaaaaaatctacaaggatacacatccatcccaatggtttacacagaggatggtcatttccacaaagctaggctggatctgagtaggtgggtggctgcccacattggttgaagattttttttctattttaactaaagaatacacactattttagtaaagaaaaaagatgcaaaaacaccctctacttagattccccaaccaagccttgtcagggtcttctgggcattcttgacacagcctagaagaatccaagaaggtgcactcggactgcccaaacccagagatggggatgccaggcagaggccctccccagcaaaacacacatatggacaaaacacctgtgtgctgctctcaaccatggcgccccctcccctagggctgcctcatttcctctgagataaatcatgcagagggccgggaagccccacaaatccctcaagcaaacactcaagtcaaacagcaccatttaccctgcaagggcctcttcaagtttacaaggcgtgggaggaacccggcaacaaaactgcccttgtccagagaggttgacctttgcccttgggcccagcggggagcaagcctgtggccatccccttatccccgcttcctctgctgctggcctactgccacctgagcatcccacagccaggcatccactccacgcctgatgaaggcaagggggcccaggatgccaggacgcggggctggtcgcccagcagctctgagatgctcccagccctgctccctgtggcagccaggcctcttctcctggtggggtctggaggtggtgtttgctgagaggcactggtccagctgaactgacctgggggaccccaatgaccaggatgcatccccacccccgcccctgctgccaaggaccacaacggtaggaaaaggagagcagggaatgggctgcaaggtgggggaagaagaccctcccctgtgaggcagacaggaaagggagagggggacaggggtgggagggagacctcagtctgaatgtctgtaaagctgagcaggtgctcaagaaagtcagagaacgggagacaaggaaactttacgcttcttgagggcagagtgctccttctaaaaaaataatattttcaattaaacaatttcttgtagagatagtctatgttgcccaggctgatcttggactcctggaatcaagggatcctcctgctccttccaaagtgctgggattacaggtgtgagccactgtacccagactggatttctctatttatgacaaggtgaaattctgagtctttttttttcctctctgagttataatttacataccacacaaagtatgcaattcagtgtttaatatattcacaaggttatgaatccacaaagttgtgcagccactaccactatctaattccagaacatttttatcaccccaaaaagaaaccaatacccatcagcagtcacttcccaaaccccaagcccaagacagccacaaatctgctttgtgtctacatagatttccctgttgtggacatttcatgtacctggaatcatagtttgtggtctttttgctggtttctttcattggctgtcatgtttttgaagttcatccacactatagcatggatcagtactgcattccttgttatgctgaataatattccattgtatggatagatcacattttatttatccattcatcggtcagtagacctttgggttgttaccggttttgggctgctatgaatattcacacctcaagtttctgtgtggacgtatattttcagttctcctggacacctaggagtgtcgctgggaggtcacctgttagctctgtttagttttttgaggaatcactaggctgcctttcacagtggctgtatcatttattcccaccaacaacatatgcaggtcccaatttctacacatcctggatgaggcagatttaaacccagacttgacaggattagaataatatcattaacgaccacaacactgactgagcgcctcatacacacgggcacgcggcgccagtgccttctacgcagtgtcttcatgacagccatacagaccaattctcctacactgagatgtgccaacctcgtgctttctagcaaggctgtggggcttcccttggaccgaggtggagccacatacacctctgaaatgatgattctctcaaggaagtatagaatccaaactaaaccccaaggcaaaaggttacctgagccaagcgtagaccaagaagaacaaactgccggcaggcaaaacagcaagaaaacaaagcacacagcagggtgtaggtaaaggccgggagaggccgcctgccctcaggtgggggaagttaccacgcaccccagggcagagaaggggctcaaacccttagagggccatcccctcgggcagcttcctgggagctttgttttgacacagcaccgccatccttacctgcttcacacgcaagattcctccacaggatttcttttgaggttaaaaatatttttgcctctttagaaactgaaaacctacagtctttaaatctgtttgctccaggaagctccactgacatgcacaaggaagggtccctgcagggggaatgggttgtgggcagtactgaccagagctagcacggcactttctactctctcatttcatccttagagaaatgctccaagagcaccacccccacctcctgaatctataaagggtgggaagcatgttgtcacagcttctctgtgccatgcagcaggtgcgagaagggacagtcttcctgctgccggctttccattaccaaggctcagtcaagacctatgggctaaataccaacttttgccccagccactgggcctgacctcacacgaccaattcccctaatcagagggcacataaaaaatacttctaatagctccaagtatatccatcttagggtctcttgctgagcctgccctggttactccacataaaacctcaatcaatatcggagaaaggaaaataaacagcaactttttcaacagaagcaagtttttcaatggaatacagtttcattggaatatggaatactccttttatctaaacaattaaaccttaaagccattaggcaaagcagagcaagacaaggacctacactagggcaggtcgccccagaggggatatcacagctggcatggaaagaggagtgggtcctggcatggcatgaggagaccaggcctgacagagagaaggcatggggtggaagagcccacaaagggtcaggaggagatgggaacaggatgggggactgcagagggcatgggaggcagctacacatgggggattgaccaagtaaacaaattaagaataacaggaattggctgggtgtgatgactcacacctgtaatcccagcactttgggaggccaaggtgggtggatcatgaggtcaggagatcgagaccatcctggacaacatggtgaaaccctctctctactaaaaatacaaaaatcagccgggtatggtggcatgtgcctgtagtcccagctactaaggaggctgaggcaggagaatcacttgaacccaggacgcagaggttgcagtgagccaaaatcacactactgcactccagcctgggcgacagagcgaactctgtctcaaaaaaaataaataaataaaataacaggaatcacatttgtcactgtttgtttgtttgtttgtttgaggcagaatcttgctctgtcacccaggctggagtgcagtggcgcaatcttggctcaccgcatgctctgcctgccgggttcacgccattctcctgcctcagcctcccaagtagctgggactacaggtgcccaccaccacgcccggctaattttttgtatttttagtagagatggggtttcgccatgttaggatggtctcgatctcctgacctcgtgatctgcctgcctcggcctcccaaagtgctgggattacaggcgtgagccaccgcacccagccttgtcactgatgtttttaaaggaagttacaaaaataaaagaggtggaaaccaaaatgaacctgtggtcttggattagaattgaaaatgtcaatgcgaactcatggctttcaatctacctgtctgatatagaaatacagatatacatatgtgtatgtatgtatgtatatgtgcctgtgtgtatgtgtacacttagctactccctacttctttccactaagagggccgggaaacagtgccaacccaagctacaagcacatccagcaattggttggctgtgttttttttatcagagacagcgtctcactccttcgcccaagctggggtgcagtggcatgatcatagctcactataacctcagattcctgggctccaatgatcctcctgcctcaacctcctgagtagctaggactacaggtgtgccaccatgtccagctaattttttttttttttttgtagagatgggatcttgccatgttgcccaggctcatctcaagcaatctctcaccttggtcttccaaagcgctgggatcacagatgtgagccaacgtgcccggcccagcatttacttctcaatactattctccattaaaaggaatgaggactacttgggagaaatggccagtctccaggggctgggcctacctgctgctgctgggcacggaggtcaccgatctccttctggtcctcctcgtggagccgcttcatgtcctcccatgactgctgcagcaggtttcgctcccgcagcagctgcccattctcccgcctcagcatgtccacgtcatccttcagccgagtctggtcactcaggagccggctgtggagtgtgctgaaacacccggtacatgctcagtgagccccagccagcccctcacaccccgccccaccccagggcatcaccagcctcaggtcccaacacttcccgtagatacagcggacaggagccaatggcaggtaggtctgtagcactcagaggcaagccaaaacctgctaacagcccaattccagaaacatccaaatcaccacttacaaacctgacaccaaaaagggcacatgtatctccagggaagggagacaggcccctctggtacagacctagtgcctccaaatactggggcctggacagatatcagcaggtgggcaggcaaagaccctcagagggatgctgggagaccaaagggaaacaccccttgggcctaccctacaggaagaagctgcagtagggcccctggacagagacccagaggcctgcctgagccctgctgcatgttctgaatcactttcatgcctgccaggtctctgaagctggcaataagatgtgaaggattaatagccttgttttacacttaggaaaactgaggcccaaaggcacaaatccacctgctgtaggcagactgcttgctcttgcacagggacaggactagaaccagaacccctggctactaagtccagagaaaagaagggcaaaggcagctgtctgtgggtgttggaggccctggccaagcaggcctcactcactggtagaagtcagtctccttggccacctcctcacacctcttcaaggcgttggtgtgctggttctgcaggctctgcaggtccgacatggctcgcacgcactggatcttcagcctctcatagtcaggattcagcctgtggtagggcctggcccagagagcgaatggccccatgaacacaggccccaggattcacacggatagaggaaccaggtcctggattaggccagcccagtggttccccagtactggtcttctatgcaccacacacacctgggtgtttgttaaactcagatatcctggcctcactcagacccacagaatcagaatccctaggatggagggagccgtggttgcctgagctccctgcatgggcctggagagctaagaaggtgccaacttgttctgcaggagcttccaggagtctgtacaacaggtctgagtccaccagaaacctgtgatgaaatgtctcttctctgtaggctcggcgtgacagctcgtgcctgtaatcccagcactttgggaggctgaggcaggtggatcacttgaagccaggggtttgagaccagcctgagcaacatggtgaaaccccgcctccacaaaaaaaaatacaaaaattagcctggtgtggtggcatgtgcctgtagtcccagctactcaggaggctaacgtgggaggatcacttgagcccaggaggtcgaggatgcagtgagccgagatcacaccactgcactccagcctgggcaacagagaggatcctgtctcaaaaataattactaaataaataaataaataaataaaagtaaaatattaaagaaaagaaatttctcctctctttagaacaatgactctcaatcttgggtacacattaaaataccaatgcccaggtcaattacattagcatatctgaggataaaacccaaacgtgaggattttttaaaaactccccagggtattccaatgtgcaaccaaggttaagaacactggccatgagcagtgatctcagagtggggttcccagacctgcagcacagtatcacctgggaacttgtcacaaatagacattctcaggcctagccccagccccagccctcctgagtcaggtgttctgaagggagggaaagagaggcaatgatctgtgcattaacaagctctgtggatgattctggtgcatgctcaagtttgaggaccctttttctagagcagaggtcagcaaactttttttgcaaaaggccacacagtaaatactttaggctttgcacactacatagtttctgttgcaaccactcgactccacctttgtagcaggaaagcagtcatagacactttgtaaccaatgagcatggctgtgttccaataaaacttcatttataaaacaggcagtgggcccgtgggccatagtgtgccaactctcatgtgctagcacatccacgtcttcactcatcctgccttcgggccaactgactgaggggcatatcctcatgaatacaagctcagggatcaggctctgcagctctggcataatcccagaggcacaaagtgcagaggcatagacccttactcctgaaggaaagaggtgaaactgaagtgtttacaccaagcccccctcccctccagacctctaccagcatgggagctaaaggataaaccactctctggccctcctccttcccagaaagtcctcttagatcatgcaggtagataaagactctctctgccccaccctatgggccacccttccctggtatctacctctaaatcacaacaaaagcagcaaacattttcttcaaagcaacaaagacaccaggtacaatgtgctctgtttaaaacacatcatgtggggccagacactgtggctcacgcctgtaattccagcactctgggaggccaaggcaggaggatcactggagcctagaagcccaagaccagcctgggcaaaaaagaaagaccctgctgctacaaaaaaattaaaaaaaaaaaattagttgggcatggtggcacacacctatagtcccagctacttggaaggctgaggtgggaggttcacttgagccggggaggtcaaaactgcattgaaccatgattgtgccactgcattctagcccaggcaacagagcaagaccccgtctcaaaaaacaaataaaacacatgtgtgacagggaacaattaatatgtttaccaaccacataaagcttcactcaacttaggcaggtctaggagacagtggtagggacacacacacacacacacacacacacgagctgactttgcacacaagcacaccactatcaggggccttgccacatgtgggatggggacctgccccacaagaagcctgtgggtcctgcccctgggaagcatttctggacatgaggtgggggaaaggggacactcaggcagcgcagcctggacccccaggagccaggggtgtttgggggtgacagcaccagcatcggggtagtaatcccaaccatggggcctgggcaggggagacggcgcaattactacctcttgtcaaaggccgtgccatgcgtagcaaaggccaggcgcttgcggagctcgtttctctcccgggtcatcagccgcagctgaatggagaggttctccaccttctcattcacttgctggtcagtgaggaggggtggtggggacggcgccttcccggtagtgcctgtggaaggggaataataaagtgaacttgtgttcatctggcattcacgaggcgcccggtgctgtcctgagctgttggcttgtgttagctattcgtgacccaacaagtgggtcctcttagcattcccctttcacagatgagaacactgagccacagacggtagcaggtagaactgaaagtgagtgcagggcatctggctccagcatccaagcactcaacaacccccagtaaccaccccagcaaggaccctgaagacgcgcactctctccccaacctggctttcacacctccaggatgcgactgttttggccgtgatccttgcatcctcccctggtttggaaatatcagctgttacccaccactaagcctggcacatggagcaggacagaccaacctgtgccctgaggagagtggaaggcatggctcgaggagaaaggcacacctgaaatccaatgacgctactaaggaccagggcagctggggcccaagggccgtgtccccgccctcctcgaccagggctggacagtgcacggctccctttttgcaagccgtccacccgcctgaaagacctgcccaaccagcccaggcgtgcaggctaagaggagggctgctggctcccagctgaggtcagtgtgacgcaattcaagttggtcctgatgcctccaggctacttaaccctcaccagccctcatcaaccaccctaggactgagtgtcctacagggagccccacaccttatgctcctagcaggcaacagccaccgctgccaccaccacctctgataagatccaaatccatctctaggaagaaagcacctcatcccaggagaagagactaatccatggtgcttttatattgaaccctgtcaatatgtctacctgatatctcaatcaacccttagagacccttgttggggtcagaggagctcacagcaaccatccaatttgtggatgggatctggcaggctgactcgtgtcaggggacacagtgtctgttccgcactggacccacaacgcacaaagggcataggacatgataggtcttctgattctctgtgctgtcctgaccacccctgtcccactgatccttgttggtcaaatgttcatgcaaaccaagagtcccccaacccaagacaaaagcagtggcttggggccttccagaagggccagggaggatagggagctcagggccaggcatgacaagccagaccacagtgggaggaggatcctcaactcccagtgctgtgcttttcagtcttttcaggttgtggaaccccaaccacttgactccagcaccccctgaaatgcacgacagtcatgtgccacataacaacgtttcagtcaatgatggtggaccacatgtaggatgtggtcccataagattataatagagttagaaacaaaagaaatatgtattaaaaaaaaaagattaaatcacatctctacaaaaaatacaaaaattagccaagagtggtggctcatgcctgtaatccaagcactctgggaggccaaggcagacggatcccttgagctcaggagtttgagaccagcctgggcaacatggcgaaaccccgtctctagcaaaaaataccaaaaaattagctgggtgtggtggcacgtgcctagagtcacagctacttgggaggctgaggtgggaggatcgcctgagcccaggacgtcaaggctgcagtgagccgagatcacaccactgtattccagcctgggtgacaaagcaagaacttctctctaaaaaaaataaattaaaagattaccatggagatgaaaaattcctgtcacctaatgacgtcttgttgatcctgaccctctgtagccctaggctaatatatgaatatatttgtgtcttagtttttaacaaaaaaagtacaaaaaaattaaacatttttaaaatagaaaaagcctatagaataaggatataaagaaagaaaatattcagctgtacaatgtgtttgtgtgtattctttttgtgtgtgtgtgtttttttgagacagggtcttgttgtcacccaggctggagtacagtggcgcagtctcagctcactataacctctgcctcctgggctcaagcgatcctctcacctcggcctcctaagtagctgggactacaggcatgtgccaccacacccagctaatttttttgtattttttgttagagacggggtatcgctatgttgcccaggctggtctcaaacttctgagctcaagggatctgcctgccttggcctcccaaagtggtcggattacaggcgtgagccaccacacccggcccaatgtgtttgtgttttaagctaagtgttattacaaaacagtcaaaaagttaaaaaaatataaagtttataaagtaaaaaagttacagtaagcaacagtttactattgaagaaggaaaaatattttctgtaagtcgaatatagcctaagtgtacagtgtttacaaagcctacagcggtgtacagtcatgttttaggccctcacattctctctccactcactcactgacttacccagagtaacttcaggtcctgcaagctccattcatgtaagtgccctgtacaggtggaccattttttatcttttattctgtactgttgctgcagcttttcttttctatgtatagacacacaaatacttaccattgtgttacaactggctaccgtagccagtacagtaccatgctgtacaggtttgcagctcaggagcaacaggccatatcgtgtagcctaggtatggggtagataccatctaagtttgtgtaagcacactcatgtttacacaacaactaaattaccaaatgacaacgcatttctcagaatgtgtccctgtcattaagcaacacagactgtgtttaaaagccaccagcatcatgacagccaggatttctctgctccaggccgcacctttggggtcaaaatattctttggcggtgaggccaggggtcagcatttcctctccccaaaggggtctcctctgcagcttcgaagtcttcccacacctttccaccaaaagaccctgagcttcactgctgcccccagcagttttgtgggtcaggtgggtgatggtgctgagtcatctgactgaccataacctacctgactctccaacaagtggagcttcctttgaacgtgcctgctactcaacctctaaccaagcccagggggaggttatgttccaggcattgatttcaccttcacaacaacctcacaagtgtgtactgataacatcgtccccatttcacaggtgataaactgaggcccagcaaggttaggtaattgactcaagtgcccaggcagtctggattctaaacacatgcacttcaccctcatgcctcggtgcctcccaaataacaaccaccagtagcacacaatgcaagcctggcaggttttgggtttttttggttggttttgtttttttgagacagagtttcactcttgttgcccaggctggagtgcagtggcgcgatctcggctcaccgcaacctccacctcctgggttcaagcgattctcctgcctctgcctaccaagtagctgggattacaggcatgcgccaccatgcccggctaattttttgtatttagtagagatggagtttcaccatgttggccaggctggtctcaaactcctgacttcaggtgatccacccactcaccttggcctcccaaagtgctgggattacaggcgtgaggcactgcacccggccatgcctggcagtttttgaaatgcttttcatacattatcccatttcgatcctcataaggtaaatatcactgttatcctcattttgcacatcaggaaacacaatcttaccaaggttaaatagtgtgtccaggtcacagagctatggaatatggaatatggacctctaaatgatcctagaacccaaggtattaacctcaaaacttgcacatttttggatcttaggacctctgtacttatctggcactccaaagagctcttgttcacagatgttatgtctaataaaatttacaagattagaaattaaaaccaagaagaatttttaaatatttacttattttttaaaaaatcaaaactccattatatattgacataagattttttatgagacattaaccaccctttccattacaaaacaaagcaatgcggcaggaacagcatcattgctttgcattttgttacacaggctgtttaacatccagcttcacagagacagctggagtctcatctctgtaatgtcacacacccaggatggaatctttagaaaactagactctacacccatgtgaggatggaagcagaaaagaccagtgacatcctagtatcattatgaaaacagtctcacctcacgagccctctgaaaggacctcagggacatcaggccacactttcagaatggctattctatgctatagtcaagttcaagaaatagcagagaaacatcaaatgtccagtttcacaacagaaaagcaccaccaggcccagtaacctgcctttggggagacaagaaattttgaattttcatccccattgtataaacgaggcaacataaagatgcagccctggctttcaaagaagctggagagaggagaggaggcggcaggacagaaggaggggctcagagccatcccaacacaccccatctctgtctccagacgtctcagtctacagccatgaggacctgggcgtggctggccacacagataaagtagcaacgacatgtgccaagcactgcccaagcactgggttctgtgctaaagacactctaccttcaactcattaatctccacagctccctactggggttgtgctaggattgctccttgagaaacacgtcagaaagactacatggctaggaaaatgggattcccatgcacactcagctctgacgccaaagccaacacctcaaccactccacaacaatgcctcctaatagggaaggattctcgttccacttctcttggcccaaaggcttgagcatacaggacacatacagaaagtaaggtcaaccagacccaagatccatcacacatcaggctctcagacccagcagaaagtgcagccgatgcctccggccttttgtaattgggggatggggagggccaaggagggccacaggggacctcatgaccaatctcaagatgtgctacgcccagaagttccaaaagaacagcaagggttgcagaaaatcctctcaatccccattcaactgaagtttttgtctttttacttgcatctagaggttgacagatattctgaaaatgatgcagtcctaccatccaaatggttgtcaggatccctcaaatggccaccaagaccaaattctacagcaaaggagctcactacttcccagcagagcccatcttatctctctccctaaaattatgccctctactgagttaatctgtccctggacattccctccactgacccttgatctaacccctaagggccacagggaacaactggatttcttgtatgcaatagacctgcaagcatttgaagacaaccatgaagttcctttaccaccatatgcccatcagaatggctaaaataaaaagcaatgccaccaaatgctggcaaggatacagctggattctcaaaactggaattctcaaacactgctgatgagaatacaaagtcatgcagccacttcagaaaacagtttgacagtttcttataaagctaaacatgcaattgccataccacccagcaatcccattcttaggtattttacccaggagaaatgagaatttatgttcaaacaaaaaccagcacacagctgtttagagcagctagggaatgaataaacaactgtgttatgtccttatgatggagtattactcagcaatgaaaagggatgaatgactaatacaactgcggacacacacagggtgtgggggaagctggaatgccctgcgttaatcaaaagaagcctgactctaaaagctacatactacacaaccattcatatgacattctgggaagggcaacactacagggacagaaaagagatgagtggctgccaaggactgaaggtggggaaagggcagattgcaaaagtgcagagggaatttttaagatacagagggcagtgttttgcatcttaaaagtagcaatggttgcatgactatttgtcaaaacttgaactgtatacttacaaaaaatacattttactgtatgtaaattatatctcaatgaacataaccttaacaaaaaaaaatttcttttttgagacagggtcttgctctgtcacccaggctagagtgcagtgacacaatcaaggctcactacaacctccacctcctgggctcaagcaatcctcccacctcagcctcccaagcagctgggactacaggggtgtgctaccatgcctggctaattattattatttttatttattgtagcgacagggccccactatgttgcccaggctagtctcaaactcctgggctcaagcaatccttctgccttggcctcccaaagtgctgggattataggtttgagcaaccacacctagcctatttttttaagaaaaccaaactgtgatgccctgaatgaagccatcatcctaagagtgatgttgacaggtaaagagatgaggaccaacctcctctgctgtcactgtggttatttacagtaaactttttaaaaacaggcaaaacagaaactaacataaagctgggttgtcaacaaaagcctccaaagtagctgccaacaaaagcttccaatgcagttctaaccttgtgcagttgttcttctggactcaaatgcaaagctgtcaactctcccgtgacctcaggctttccttacccaagtctggcaaccactggagaaggaggcagattgtccttttccttttggtgttcaggatcagatttcagaggtaagggatttggtttggactaaaatggcccaaaacaggaagacaccagatcaggagcaggctctggatggagacaaagagcagccagccctgcgctgctcttttcacccccattttgtaaaggaggcaacaggaagacacagccctgccttacgaggaagctggaagaggagagaaggaagcaggacagaaggaaggggctcagagccgtcccaacacaacccatctcagtctccagccatgaggaccttggggcggccagcctccctctgacctgggtgtaagaaggagggcagaagggagtgtccccatcacaggaatcctcagctccttcagttgccctggctgctatggtcaccaccaccgaggctcagcaaatgaactggcagctgggtggatttctcagccaccgccctttgtcctgggctccctcactgtcatgctcccactgaccctggaggcgcatccttggtcttacagctgggcaggtctcacctttgcttccaggccctgtatgcctgtgcttccaggagccagagagatgtccaggtaaacttcctggccacctccaggccctggctgcccgggagaggcaaagcagtggcagagcacagtcatcagagcaccacgtcatcctcacctacaactcaggacacccagagccacagtcatcagagcaccacgtcatcctcacctacaactcaggacacccagagccgtccaggaaagacccaggccctgcctggggtgaacgagtgcttcttaaagcacctaagcttcactagagaacctgctaggcaaaatttcaggtcccacccagacccactgaatcagaaaccctgggagtaagtccctgcagcactccgtgtggtaaaagccctccgggtgattccgatgcctgctagagtttgagaacctctgttccagaccaaagttgcatttgcatatttctcctttgttttactggctatccagcagccactgcctttaaagaaatcccccactgatgtccttgacaatgaaggcctaagggggacacccctcttagtcaatgagtacatgactccagttcagcgtttccccagcttggagtgaaaggaggttagattccaatgctggaagcccaggccccagatctccagccagatcaaagacttgctttcgaacccttgactcagggtctggttttcagaacccaaaccaccataagcagccatggccaactacttcccagctgcatctagtccagagcacttttcctggaaggcccagtccaagggccacttcctccaggaagctttctgtgattcccctcatcagaactaactgcttcttcccttgagttacttctttctttctgctctacacagaacagaatagccagtcgtgccagacagtgcctgtctccctggcagtgtgataacatttggggccgtgttcaccgtgatccctatgagtaccaaacacctgccccacaaggaggaggcattcccatctctgataaattggctttgcaaaggattacccctgacccaaaagtctgggccaggaatgaaggatcagaggtcacagggcgtcagtggcagcccccacttccctgatggctcaccccaccttcccctgtcaaccagaagaagcactttcaaggaatcttccctgggatatgagagaagccctccagcaatttctcctgccgataagcctggagacctctccatttaataagaaatcttctgctatttcaatcttcatggaatttaaggctggctttataagtgctgcccaagaatgtctcttctcctccttaaaacctccccagttttccaagatgagaaataaaaggctactgagaaattaggtcaggatgaatggggaggaaaaaagtactgattgcctgaaacgagtgtgcagtccccaggcagatccaccaggtagggtcgggggcaggtcacaacaacaggcgcaggaagcgggggagggcctcggggaagctgtgtgtgcttagctgatgaaaactgcccgaggaggccttggcacaaagacctgctgcctttaaggctgttggcaaaggtgtggcgagttgtgagtagggccaggctggagatccgagacccgacagaccgcctgagagaacgctgtctacacgccccaggcttcagcctccaatttcttctcatgctgaatacaacctgccattgttttcccagccgtttccatttagggagatgtaaatggaaaagtggaagtgatgtttttattataaggatcttgctcttgccttttctcaggttcctaagatcaccatgtgaccttaccagcggcccctcctgccagggcggtgtgtgcttgcaaagacttctgcctctcatcaggtgtggctgagccagcaggaactccctggcaggtgctagagtgctcccagccagggccagccccaccaggcactccaccccgagggactggtacaagcctggtacagacattctggttcccttctcagggatgaggttgggccagcccatctcaaactggagggctattaagctgtagaaaccctcagcgtttctgatgcagcaggggtgggaggaggctcaaacctgcatctctaataagtgccccagtggtccagcgaccaggctttgtgagccactggtttcggcacaaacaagcagccaactgtggtcaatgaaaggaggccatactgatggactctggaacaggttcctttgctcataagaaccccgccttcttcttctgccactcaccgcagatggctacagagcacttgaaatgtggtggatttgcctgagaaactagaaatttaaatttcattttaattcatttaaatttaagtagccacctgtgtttagtggcgcccatactggacactgcagacctggacactgtcaggtctggatgtgatggctggagctgctgctacagacaccccgccatgagactgtgtgaagacaccacacagaggagggcagagctgcatccccatgtactggctgacctcagcacagcctcatatgggagctcatacatttcctgattggttaaggtggtatgagtgggtgttccctgctgcctgcacccaaaggacaatggcaatctcaagcagaagagcaagagaagcaaaactcggttccctgtgaactcaagaggctttgcccagaagggatgcaaccagttatttcagcattaaatatccagacacagacagtacagacccatcctgctccaagaaacacatcagagcactgcactctgcctgcctgtgatgcccaggaagagcacagagatactgttgacggctccatcgcaaggactgagtcagcttcaggtgagtgcagaaccaactggtgggtcacggccatgacgcttcttccagaatatgctggggtccagctgcccaagaaatatcttcctactcaggctgggaattccaccatcagcagtaattgctatgggttaggcaaatacccctctctggaatccccttttagaatgcacatgtgcctaggaaaggtaacgatttaacccttgaaatgccgatgggaatgagtttactgattgctatctgttagacagatattggtgaagggtgaaaaactagacaggtcagaggagtatgctcagggcttacccagtccaccttaaaaagcctcaccttccccatctactgatcctgactgccccactccatgcacttcctgaagggtgagtcccacattccaaattccaacaatcccatcattccattgatatgtctccgggcaccaaaagcaggcagaacaaagtaataggataccgttgggagctttgaattgcagtcccagaagggcctgccctgagccctaaacaggatgagggttatgggaggaactgtgtttttatgggtggagttgtggccccccaaaagatgctaaagtcccaatccagtaaatgtgaatgtgaaccttatttggaaaggtcaaagcgttatctttccgaggcgcatttgcattctaaaaggggagtcccgagagggacactgctcagcccacagcagttattgctgatggtgaaatagtctttacagatgatcaatttaagatgaggtcttgctgccgtaaggcaggctcctaggccaatctgaccagtgtccttattaaaaggggaaatttggagacagacacacatggacggagaacatcatgtgaacacaaaggcagagatcagtgtgatgtcggcaaaccaaggagcaccaaggattaccagcaagccaccagaagcgaggagagaggcccgggacagatctctccctagcgccttcagcctgcgtggcctcactgacactttgatcttgggcttctgtcctccagaactgtgagacaatcaatttctgctgtgtaagccacctggtctgcggcactttgttatagcagccctagaaaactaagatggaactcgccggctggtcactgtcttccctcttatcacactaccttcccttactgcagctacttatttaactgtttcccaccaaaagaccctaacatccaggagtgtggggcccacatctgcctaattcgccactacggcccaagcccacctctggcacactggaggtgttcaagatgtgagctgacatatgaaagagctgtcctgactagttctagaatctcaggcatgtgactccccctcccagaatgtcaatttccccatctctctgcagagggaaaagaaaataattggagtagatgacctctgtgagtccttcgggctcaaaagatggccgggactcaccactgaaggtgtctgcatccatcatggtcagatcaggccatgagaaaccccactagaggtgctaaacagagggaatgggtcacagaggtgtgggaagcctgagaaaccactgcggccttcctgctggacttcagagaagggctggcctcattttatgggctttctgaaacccatattcagagaaacacacccaattcagcatggactggcaatgcctatccccaaggaaactccaaaaggggtgagtctcctgggcagtggtcactgagttactacaaggcctttggggttggggtggggatggtgggtcaacaggctcccctagaagccctgtgccctgacaaagtaaacaatggcaaaacatgtgcttcccagcactcacctccccacctccttctaacatcagaactgggtttctgatgatgggagaaaatgtaaatgaaatcaacggaaggatgatcctgtgagtaatctgacaagggagaaccagcttcctctcccatgaaccccagctgccttggctttcacccagacccctggcccacccggtgtcctccccagacagtggtactcacccacactgctgagggagctgctgctttctgagtctgagggcatggtggacaggacgctgtaggtagaacctggggaaagaggggagaccatgttactaaccccaaggggtcactcgtcttcaccccaagccagctgatcatcagtcaatgccaggccatgagagctacatgcaccaggcactagaaatccacatccacgggccaagcagaggaggcgcgctcagcagatctggacttcggtgtttctgccaggcctcccacctcactttatcggcccctcctgctctgggcaggcgggcagaggggaacttggagtcagtcagctggcttcttgttgggacatctggggaaaggcttagcaagggagtgacatgccccaggtaaacatggggtgtgggggtttcctccacatctctagcaatatgattctggcttccatgcagagggtaacagagcagaaattaaagaacaactgaactatctgttctttctctgactgttctgctctttaggttctaactgtattcaagctcagttcttaataatttacttagtatctgcccccttattaaaagttactcctaaaatgatgagcaattgtaccatcaccaaagccagagggtagcacttttttttgtccacacttaatgttaattcctggttgtggacacacaaccactgtggtttggtttgaattcaaatatcttcaaaaccagatgttaccctcccagcaccgggaagcccagtttctgaacctagctctatgtaggtgcccatagctgggtcgtgctgagcaagtagcttttgttttctggaactctgtttcctggtctgcaaaatgaaggagttcaaccagatggcttataaggtccctaccccatcccccatcccccatcccccatcccatttcagcaatttccatgattaatggaaacagaaggtacactttgctcatcaagactatggatgacataaaattaaaagggagggcaaactgactcagagactaaattgggagtggacaaagcataacacacagagatggcaggtcagataaaacaaggacaaatccagtgttttgttcttggagccaaaagaactatacaatgaagagcggtatgtaccaggccaagtgggtgagctggagatggaatttttgcaataagggctttgaacaagccttagggctctggcatcagaaagctgccaagaactaatgagatcctgggctccacaacaagaaatgtggaggaccacatttaaggagctcccagcagggcacggtggctcacacctataatcccagtgctttgggaggccaaggtgggcagattgcttcagctcaggagtttgagaccagcctgggcaacatagtgaaactccatctctataaaaaatacaaaaaattagctgggcgtggtggcacgcacctgtaatcccagctacctgggagtctgaggtgggaggatcacctaagcccagggaagtcaaggctgcagtgagccatgatcatgccactgcacttcagcctgggcaacaaagtgagatcctgtctcagaaaaaaaaaacaaaaaacactcttccactgcaattcttgactagccaccctacacgcatctttggacgggaaagaggagaaatgaagaaatgggggtaaatgggggagcggggcaggggagggagatgcactgtaggtgggaggcccctgggggacaggagagaccttgaggggaaagcagggagactttgctggggaggtgaggaccatgcaggagggcagagagatagactgcaggcaggcgagctagcaggcgtgtccatcagaaaaagagatgaagggggagagaaaaaagagaaagcaagcaaaaagcaactttggtaatggcaagcactaggacaggcgtgaccggcaatgaccagtagcctcattatcacattttcagagactctgaagaatctgaaggcgttgagcatgggctgaagagaatgactggggaatgggtaggtgtcttgtctctcaatacgactgtcagaagggattagatttgttcttgatggcctccagcagccaaaccaggagcagcgggtggatgctggagaaagctgcatctctaaacaggtctggatggccacggtcagcactgccaggtatgaaaagcctgagggtgagggggtgagacagtgagggaggcccagcactcagtggcatggatgtcatggggaagtctgtgcatctgaagggagatgaaaccagaaaacccagttcagccttaaaattctatgatcctgctaataatgaataacccatgctccacctcccatatctgaagtccaacccacactattagttttgctgtacattcaatatctctgcatttttgtctcaacaaaaacaataagcatcacacttttttttttttttttttttttttgagacagagtcttgcactgtcgcctgggctggagtgcaatggcgcgatctcggctcactgcaacctccacctcctgggttcaagcgattctcctgccccagcctcctgagtagctgggattacaggtgcccaccaccatgcctgcctaattttttctatttttagtagagacagggttttgctatgttggccaggctggtcttgaactcctgacctcgggatccaccaggcctcagcctcccaaagtgctaggattacaggcatgagccaccatgtctggcctgcatcacatgtttttttaacccatctctctttctatatcatacacattacatgttgcttcaatatctgtgaaataaagtcaaatgcaattcgggcaatccattgatatcttcaaagaacaagaacccaacacaatgcctattttctaaactcaactaccattttttaaatagtattttttctttatgggggcaaggaaggctagccactgacatgttggtggattgtttttggaagacgtctactcaggaaagcaggcacaaataaatttccccactctcacctccagaaatctctatgctcaacccatcccagcttacgacactggcagcctgcgctccagatgcctctgctggaacgctcccctctttcttactcttggcatcagcagtgccccttcttccagtaaactgcccctcctcttcaaatcgtctctctcctcccctgtggcaagtttccactgttaattaagcttggcagatgcccttccctctctccgcccacctacctccctggctgggggagtccacaggccaagcgacacgttctgttcctcttccctgtccctgcagtcctgactggcctctggggcctaaccagggcagcgtgacatctttgtgtgcatctctgggcatcactcccacccccaacccagggagctggcagggctcctaggagctggtggggggagtggttaaaattggacaggacccagtttttacaatgttcccagagccttggacgtcattaagggggaaaaaaggcccaaagacgacattgtctcggtcatgctttgtctctgcggttattgttgtcctaaaggcctgtgtggtcaggacagtcaggaaaaggcaaaagaagccactgtcccccaaagtcacacggtgtcctttcaaggccggttgcttccatggggcggaggggcaggtgtcggcgtcatctacctctggggtttcgccatcaaatttggagtcaaatttggtgctcctcatcttctgccatggcccaatccaggaggagacaatttccccaggttctcctgaaggcacctccacccaacctgccctgaaacctaggatgggctgctgtggaaggagaaacagtgtggagggacattctctacctcacagagtgcccagggctaagggggactgtaggatcagcctcctgatgtgtgtgtgtgtgtgtgcacacacacacacacacacacgagaggagggcaccaaccacaaacttgtgcaagctaccaagtaccatgcagaggtgctgatgagatccagagaaagttggatgatgtggaaacatttccagaaaaggggagcttgaggccaagtttagacgtggacatgtgggccagagcgtgatataaggagattctttactatcaaaggaactacctgggcaacgtaaactcttattcagcagatgagggtggggtttcagaatgcatttctcacaagcccccagggcacatgctctacacactggcccagagctggagtccacaggtgggatgcacatggaagctgcagccaaaaccctgggagaggtggaaggaagccactgggaggaagccagcctggtgaccctctgggactggcccacgggcactgtctgtgtcctttccaagagcccagcccctgataattctgtttaccccgtgactcagtgccactgggtcacgaagaccacttcaaaagaaattccaggaaaaaccacccgaacaataatggaatgccccagccctcccaggccccctcccatagaccatgaggcccaagagagatggaagcacgcccccaacacaccccttccattcacctggagcttgtaaaggccctggtgactcacgcttcctcttcgtgaagctcacagtggctgaaggaacttgttccagccttgaaccagcacacagagttctccctgtcctccagaagggcccaggcagaaaggcagagagctgacggctcacggtcacagggaggccagcaccccctacctcaatccccagggaaaggagagggagacaccaagctgctactctctggagctctggggtccctgaagacagagcaggaagtgctgcctgggccccaggaggacagtcactttcagggcacctgccacatcctgccgccctcctccagctcacactgaggaaccacagcctgacgaaccacagcagaatgaccgaaggtgcccaatcgctcccggactcacacgtgtcagccaggtttccaacacgtgccccccgcctagcatggcactgggccaggttcgggagaaagaatggcaagccaggggctcaagagcctggaggttactcatctgctgtgagtagccttcagaagaaggcccttctctctgagccaaacaataatgattgcagcacagctggggccaaactgcttggagttaactcccagcccagccccttatgagctgtgtgctgttaggtaagtcactctgcctctctgtgcttccacatacttatcagtaaaatgggatgatagaagtgcttatctcttagagctgtttgaggataaactgatttaatgcaggttgagtatccctaatccaaaaatctccaaaatctgaaactttttgagcaccaacatgacaccacagcagaaaattccacacctgacctcatgtgatgggccagtcaaaatgcaggcgcaggatacagtttattctgcttcctcaaaggaaaaacaaaattatcttcaggctatgtgtatataaggtgtatatgaaatgagaatacgtttcacatctagacttgggtcctatccccaagatatctcattatgtatatgcaaatattccagaatctagagaaatccaaaccccaaaaacacttctggttccaaggatttcagataagggatattctgcctgtttgtgaaaagtgactgaaacagtacctcgcatagccggtactctaagtgttagctggtgttattatggtcagtccagacctgcagagggcccttccaactctgctgttcaattcctcaattacctacatggaaagctgtactagagtgacaagtcacacaatctacaagcaaactgctgcactgtatatggcactctcaagaaaaataatagcagctaataggtactaagcactactaagtactgggactgtgctaagcactttgcatgtattgcctccattaatttccataacaacccaaaggttgtcattattagtcccatttcacagaggaagaaactaagagttagaaaaattaatttgctgaaggtcgtgctagggctactaagagcacaaacaggatacaaacccaggcagtctaccccagcgcctgtgctctcaaatcctacacacaatactgctgcccggctccacagggaagagcagtcagagaggacttcatggaggcaggggcctggagctggccctgaaaggtggtggccttggataagcacatgagaagcccgatcagcttgcaggagacaacaggcggaacccatttctctggaagggtaagaagtctcagagcagggctggcttgggccaaggccccccagcctctattccctgggaatgggctcacctcctccctgcccacctccccacaccgagacaacactcaataggcattctgagctgagccacttccacccaagtgggaagaaagagaaggagctgtggcttcatggcccccattccatacccatgcctgtgctgcctgcagaggggagtcgcagtgtgtgggcaagcctgcactcaagagccactcaattctgtgaactgcagagatgaggaaggaggtgaccgtgaaagttgcggagtgctatcacctttggcagagcccaccttctctgttttaaagacctcctgggatgctggggggacagagggctcatatcctactattaggctactaggaagcctgcttgcagaaccatgctcagttctcaggagggaagaaaggtggcagggaaaaaaaaaagaaaagaaaaaactacactcagggcagccccagcccctccctaggggctcggcctcctaccctttaaaagcacggcccaaggctacagacactgaaacccaaactgggaagcggacaaggcccagtatttcagggaggtataggttgaccatggccctggaatggagcaaccacagacactggcatgtcatcaaggaagtcctgctgatgcgccttatatgccacccgagggtgggaaaatcctactcttggtttgtaagttaagatttaatatttgttttcctcaactgagataatgctatagtattttccaccaagttttggaacaagcagcatcactgcgctaaaaaaaaaaaaaatcataatgatgtggattccccctatttctggtcgttataagaactgctcacctatctttaaaaggtaaaggtggccaggtgaggtggctcatgcctgtaatcccagcactttgggaggctgaagcaggaggatcacttaggtcaggagttcaagaccagcctgggcaatatagcaagaccccatctctctttttttttttttttttttgaaagagagtctcactctgttgcccaggctggagtgcagtggcacaatcttagctcactgtaacctccacctcccaggttcaagctattctcgagcctcagcctcctgagtagctgggactacaggcatgcaccaccatgcctggctattttgtattttttagtaaagacggggtttcaccacgttggccaggccggtctcgaactcctgacttcaggtgatccaccccaaaatgctggaattacaggcatgagccaccacacccagccaatcccatcttttttttctaagaggaaggaaggaaggaaggaaggaagggagggagggagggagggaaggaagggaaggaaggaaggaaaaaaaaaaagtaaaggggaaggggcattgcccagataattggagatttaacctcaggtatgcagtgagatctgtgtggggtggcaggaaggaagatgatggctgccgagctctctgtccattcttttttttttttttaaactttatattttaaaataaatagagacagggtctctctttgttgcccaggctggtctcaaacttctaggctcaagcaatctgctcgcctcagcctcccaaagtgctgggattacaggtgtgcgccaccacacctggcttttgtgtccattccttaacacattccctaaccccttcccactggacttttgaggccatttataaaataatgaactaaattgcctgaacctgagaaaactctcgtatcaattttgccatctgtgactcccctcccttccccacccaaaatgccccaaggcaaaaatatgtaaagagagggaaaacaaaacatgtgcaccccagaattaaatcattcagtaccatgcaagacccttcactcgctaactacaggactggttttggtctttttctttacttttttttttttcctcttttaagtggcaagtgacagggactaaaaaaaaataaaataaaactagcacataaaggaaagatggaagtttgttgaatttcgagggatgaaaagagtccacagttggatagcctgcttgtcttcatcagcgaagcaaaggctcctggaggctttgggatgagcacaaagcctgtgtctgatgaaagccaccctctttgttctgcctcccttcagagctgccgggctgcaggttggggatgggagcagggagggagggaaggcagtgggaggacctaagaccatcaaacctgacaccaggtgggaccacctctcggttcctgctttccatcaccaaaaccaagccctgctccctgctgtcacttctggccagactaagacagttctgcacctaaaaggcacaggaggaggcccaaagagggtctgattaaggaggaggatggggccatcgtgctatgccctggaaggtgggggtggaggggggacaacgaacatagccaagcctgacagcacccacaaggcgaggtgtgaaggagtggagcagcgcctctgccccgccaccctgacagcacatgtcacaccaaacccagacaggaaatctgagcagcaggggcacccaagaggcagccaagcctccattatgctccagccggacatcccccgggggccatgtctgccctagaataaacttctgataagccccagaagtcacaacaggcaggaagcagctctctgaaaggcaccgggcacccccggctccctcctgctctggcccggtgctcaatttccactagtcagtaaatggagaagaggctgcctccctcccacacaggatggagcgcataccttgcagagtacactgccctccaccctcccagggcaactgtagcaaggcaggctctgcgtcagaccggctggctcaggcctgccactcaccagctgtgtgacctcaaataagttgcttctactttctgtgcatttcctcatttataaaataggaagaatagtaggtgatgagaacagaatgagcaacgagagggaaagcccttagaacagagccaggcgcacagcaagcgatccacaaacaccagctctcgttactgttaccgtctcacaggctcctaaggaaggcagggcatggggtggcctctgcagtgtacacagacagcagatgctatggaagggacctggaggacagtcacgcagccttcccttgacttctggagtgttttgctggttagaagctctgcattgagtactctgtatacttcccatcaccatctccctcaggagctaatgcttccccctcaacccagccatgagtgtcgcctctcaatacctgaatacagctctatctatgcctgtggataaggaggcttcctctcccctcccaccattccacgtggccatggcaattccaagccatccccagcatcccttatgatttctggttctctggttcacaaagaaaaaaccagagcgctcacagtgtgcctggaatcataccaggcttgcacctccactcatccagtcctggctcccaccacctacatacagacatcagtcagtgccctgtaaaagatgctacgcattggtgggcatgtctgtccccggaaacacaaggcccactcattcgccaaacgctgggttaatgctgggtgaagtactgggatgcagcaggaagcaagatggacaaatccctgccctcatggagctcacatgaacagggtgacaggggcgggggagaaataaacaaacataaactgtattgggtagtaagtgctatgaagaaaaatgttgcagagttaaatggtaggtggtgggggtggagaggagatgtggctattgtacagcggtggcaggggtctctctgggcaggtcatctttccccagagacctagaggaagcgtggagtgccagaggagggaatagcaagtgcaaaggccctggggccaccccatgcggggagacctgtctgctgtgggtggagggacctggaggaggatgcagatgaggtcacaggggcaataggacagctccaggcagaaccttatgggccacacagaggatgcagggctttattcagagtgagacgggaaaactctggaaggttctgagtagaggaaagccatgatctgacttacatctacttaggctcattagatgatttgttgaatgttgtccacaagcagggaagcatagaaacaagtcagacagcaaactcgcaagtccaggggagcaatgctgggggtctggaccagagtgacaagaatggtgttggtgagaagtagctggatttgagggatattttggagcttttctttctttcctattccacatttggcttggagcagagctgaaaggatctgctcataggcccaatgtggaataggaaagaaagaaaagtcaaggatgactccagggttcttggcctggaaactggaaggatgatgttggtccttgctgaaagggggaagcctgcaggaaaaacagatgggggagggagttggggaatcatgagttcccgcggggcctggtcatgcgtgaggtgcctacagacacacaagggaggtgtcaggcaggcagatggatgtacaggcctcaagttcactgacaaggtcatggctagagatgtaatctgagaattgtcagcatatgcttagtatttaaagtgatgagccttgataaaatcacccaaggaaggagtacagacagcaagggcagtggagaggtccaaggaatgaacctgagcatgcaggggctaagggaagagaagagaaatcaaccaagaagacagaggagaagtgggtagtgagatgggagagtcgaccacacaagtaaagaaactgaacacagccgggtgcagtggctcacacctgtaatcctagcactttgggaggccaagacgggtggatcacctgaggtcagggtttcaggaccagcctggccaacacagtgaaaccccgcctctactaaaaatacaaaaattagccggccatggtggcgcatgcctgtaatcccagctactcaggaggctggggcaagagaattgcttgaacccaggaggcggaggttgcagtgagctgagattgcaccactgcactccaacctgggcaacagagtgagactccatctcaaaaaataaataaaaacaaacaaacaaacaaactgaacacaactgcatgtggtcaggtcttaagagaggtgctcagatatgcccatgttgcttaatggtgaaggtaagacagacacacaatcctcccgactcctgatcaagctgaatctgcactccacctaccccctgaacttccccagttatcaaggaggctgatggaaatgaggcagagcattagggagacccttcagtgtatactaggcatcctacatggcacagctcatgtttttgttgttacactctactcatatcaggtaacatttattgagtacttgttgcaagaaaggcactatttgtatggattatttcatttaattctcccaacaatcctacaaggtgggccactatcaactcaccttctagatgaagaaatgtaggctcagagaagccaagtaacttgcccaaggccacaaagctagtaagcagagggtcccaactcaagcaggactctcatccactaaccctagaccttttttttttttttttttttttttttttgagacaaagtctcactctgtcacccaggctggagtgcagtggtgtgatctcagctcactgcaaccttcatctcccgggtccaagtgattctcctgcctcagcctcctgagtagctggggttacaggcatgtgcctctgtgcctggctaatttttgtatttttagtggagatgggatttcaccatgttggccaggctagtcttgaactcctgaccagacctcctcctttctgacaagatcagaaaaagtgatactcactagttccttctcccactggatagaaaaagatgcaagcaggcatccctcgcccagtgtcaacactcagggaacaggagatacctagtaatcactactggcaggtcaggagctcttctccaagcaggcatgctatctcgtggccagcatgcagcactgtggccaaggccatctttccaacagaaggaaaaaagggaagcatgagaaagaagggttccagtcacctctgtcacagctcagctgccagccttgtcctctagtcctggcttcaacctctctggccttgtcactcctctggccgtggatttctctggtccccctcagaagagactagtactgtctctggaacaagctagataaatatctccatcctgggtctttagaaggcagcaagaaatggagtgggccaatggagtttcaggaagctgtttatgattctgatgcttagaccaaatgcaaaagaactgtaaaggtgtccctcccccactgtcccttcgtgccacaccatcccataatggcatgttccattaatctcagctcaaggtaagctgagtcatcagccagagaaaatgatggctctgggaactgcccaagtcacatggcatgagctgggcattaggcaaggacatggcatcccaggcttcacaggtcggggacattctgtccacaaaggccaaagagggcaactacaaaggaaaagtcttatctaagacatcagcaaacgggtgctgtttctgccccctctttcttcaatgtcatctacactgccctcctcatctacttcgtgggctgcattgagaatcactgaccaccaaggcaactcagcctgggtctgtagtagcagcaactagggctcctgaggtcatggagaaccccttgcccaccacaatattcctgctgagtttgaactcgtcaggacccctgccatagggcgggaggcacaaagtgaccccatactgtggaaagggcccaggatcaggagctggatggacatgggctccctctgctttggccacctcctaatcagtgaccaggagcaaatactttttctgagcctcggtgtcatttgcacactgaggctaaaagtctttatacagtcagtatttcacaggctgtcgtgcagagcaaatgaaatactggatgctgaaagtgcttcgtaactgctaataaatgatccatttttcacctcctcaggaggctcaggtctatctctgtccccgactccactgcaaatctttcccagtcttccttcatgcttctctctactttccactgtcagcctcttctcttccacaaactccttcttccttctactcttattcaaaacacaaacaacaaaaacaacaaacatgcatacaaaaggaaaaggaattaaaacgcaagaaggccaggtgcagtggctcacgcctgtaatcccagcactctgggaggctgaggcaggtggatcacttgaggccaggagttggagaccagcctggccaacatggtgaaacctcgtctctactaaaaaaatacaaaaaaaaaaaaagtcagcctggtgtggtggtgcacgtctgtaatgccagctactcgggagggtgaggcacgagaacctgggaaacagaggttgcagtgggccgagatcactccactgcactccagcctgggtgcactccagcgaaacaatgtctcaaagaaaaaaaaaaaaaacacccaagagcttcacctccatttctctccattagaggtgtccaaaatctctgggccctcagggtggaccacacctcacctagtttcacgcaattctacgctgactttcattactatgggtgaaagctccagcttctgggccttggagttcaagaatgcccagggtttttgaacacaggaataagcaagcaggtatgagcttcaggaacctgtctccagcaactgtgaactggaaggatggaagcagggagagcctggaagctgagagaacagttaggatgttcccacaagagctgcccttaactactggtcatggggtacgggtagggagagggcccaagaccacaggtagggaagaatggaggatggtgctgaggtttgtggttggggcatcccagaaggtgacacagttaacagaggcagaggattaaaggaggaggaatgagatcgttgaaatccatcaggtagaatgcactaaagaaaatccctgtgaagacagcctgctgacactcagaaactggaatgtggcaccacagagaaagtttcaggctaacacagtccactccagagtcacaccattgagcctgcaggatgtgagtgacaagcccagagtcactaattggtaatgtgaagcccctgggttagaaaaaaacataagactcaatttgaacaatgtcattgggaaagaaaaagaaaaaacagaggagagggctggatctatggaccccctaaacagtgactatgaagtaacattgttctttttttttttttttttttttttgagacggagtctccctctgttgcccaggctggagtgcagtggtgtgatctcagctcactgcaacctcccccttctgggttcaagcaattctcctgactcagcctcccaagtaactgggattacaggtacctgccaccagaagttggctaattttttgtatttttaggagagacagtgttttgccatgtaggccaggctggtctcaaactcctgacctcaggggattcacccacctcagcctcccaaagttctgggattacaggcgtgagccatcacgcctggcctgaagtaacattgttctaagtgtatataaagttcagaatctggggaaatacttcctgtgaagacaggaggaaaaaatgagtttctggaaaagacatagaaagatcacttggagcaggggtaggaggagcaagagaatgatgcatcctagaaggcaatggggtggagggagcctggaggggttggtctgccacaccaaatgctagggaggactcggaagcaaagaaacttctgatctggtcatttggaggtcaaagatgctatgcatggagtcaattaagcaggcaattgattggccctgtttctccatctgagaattgaagggcttggataagaccagaaaaggcacaaggtgcatcttgaaagagcagccatgcatcacaccgcctgcctgagtactgtgcctaaagccatacctcagctcactgggaaaggaccccacagtggatcagcaacgtctgccttgggcaagtcgggcaagagtatctcatccccggagcacattgtttctacagacctgtccacctccagagacatggttcatggtggtcggcacttagcaggcttcccgtaattaattactgattggaattaaactctgcaatctaatctgtgtctctgacatcctttaaatgactgtgactcaaggagcgctcagggaaaaataaaaggacaattatcttttttccatcgacttcttttgaggccccgagaaacagaaagtctgagagtttggctatcagaggcgctctgggcagccctgcccaaagcagatgatcctccaatccaagacgggccctcagatgttccaaacatgcttcctctccgataaagtaacaccgtccaggagggttcaccctcattttcacagtactcggtgtgcattttggaaatggcggacttcagaagtccattcctgaaactgctgggactctttccaatgttttacagaaaggacgctgcacacacttacctgcagacatccactgaggtatccaacgctcacctttgtcacacccagagcaggagtgagcttttaaatgagactttgggtactatacactcaggctgtcacctcctatccccccacaaataaagataaaacagcacaagcattcttcgccctaaaaccctatagcaagctttcatcatgacccattccacacctgtcatctcagtacattcaagtgctcacatgggccctcagctagagcatgagcccattcttagatgcctacgctcagaaaacaggcccatgctactctttgtttaaatgcagaaagaggagctccccctaaaacactccaagcaaaatctggacacacaatgccttcaaattgccccaagtcaaccacagaaaatggaagaggagatcacagaaggatttcaaatgcataaagggatgtagattatctttcacacgtgggcaatgctcagaaaagttgatcttgagtaacgagggaaaatatttcattcactatcttgtgcaaagagaaaaaaaccaaaatccacatccacgaccctggagtacagcaaatggaatcaaagtgtgccagcccccaaagattccagcctcctgcagctcctgaccctctggccatttgcagggagctctgcaggcagtctcatctcaatggactgggaccctccagcctgcaccactatggctgctctactctccctgccccctgagcaaggcaaatgcttagtgaaagtgtgaagagtaagagttgaatctgcattttctagtcagacttcagccctctcatagtttaaggggcatcccctctaccgtccagccctgacatcctacaggtgttcagagggggcgtgactgagccaggtcacacagcaagctggtgccagtgccaggagtgaaacaagcccacaactctgatgagcaggatgagaggaggaaggggatgaaggaagtgccctccagcgaaggcaagagtgcaggaatccctaggtagagaaaggtccccccagataagcacctggacaccctgtgcaggctgtgagagccaacagagaggggcagtcggtcaacagagcttctggccaatggctcccagcctggctgttcatcagaatcatccaagctgctctttaaaaatgctggaaaaaaataaaaataaaaaccaaaaatgtctcaggaccccttcctatccccaggaatcagcacctccagcattccaggcttttaagatgctgctcagagtctctggtgagtggctcagttggggaataccaccagggtctgcacacgcaccctgggcttcctgccctctgagcttcctgaacactgccactgaccctcagccagaaatgcttgcccccttagggtaccgttgtcactagagaaccgtgtgagagtagtaatgttgctttttttttttttggagacagagtctcgctctgtcacccaggctagatctcagctcactgcaacctccacctcccaggttcgcctcaacctcccgagtagctgggattacaggcacacaccaccaggcctggctaattttttgtatttttagtagagatggggtgtcactatgttggtcagtctggtcttgaactcctgacctcaagtgatctgcctgctttggcctcccaaagtgctgggattataggcgtgagccaacgcgccctgccagtaatgctgctcttatgggctgaagtgtattcccccaaaatccatatgttaaagccctaaccccttctgcagttcctcaaaatatgactgtattggaagataaggtctttaaagatgtaataaagttaatatgaggccatgagggtgggccctaatccaaaatgactggcatccttataacaagagatcaggacacagacatgcacagaaggagaactgcatgaagaactgcacggagaacatggccatctgcaagctaaggaaagaagcttcagaagaaacctgcccatctgacgccctgaccttggacttccagcctccagaactgtgagataatccatgtctgttgtttaagcttcctggtctgtgatactctgtatggcagccttagcaaactaatacagttgcaaccatttacccatgctctgtgcaggcccttccaatacagacatcacccacatacactatctcacttaaaacttcagcccccaggacaaacgtattgctgttagccccattttacagacaagaaccccaaggctctccaagatcaaggaactaacccaagatcattcagctagaaagtcaatgaccagatgcacccacctcccagccctttgcctgtaactgctcctgagctgcctgagtcctcagtcctctctgccatccgtcctgggcccactcagcagctgcagtcctaccccacctggatgaacactgtctgagcccactgtgccttctttcccagcctcaggcccccagcagacacttcaggggaacactgacttgctatcatctgtagtttttgaaactttttctttcttttattttttaaataagcactgttgctttggtagtcagaaaaaaaaattaatattaaagagaaaaaagctaacacggttaagagtttctattgaatctgtagcctgtgtggaaagaaagaagtgatcaaaaggaatatatttggaaaggctactaagaataaaaacaaacaaaaaaaatacaagctgcccttgccaatgtcccatcagctgagatgagataagagattcatggggcagaagtaaggctgctgaggccagagatcccagccaggccatctccagaaaatatctatttttaaagtcacgttccatttcatcacatttcagaaaaacaaagaagagaccttgagggacagacaaacaggctccagagccacacgcctttgtgtgtgctcacagcagcagcagccgtgcctacagccagccggcgattttcatctgaaaaactcagatctctcatggcagagagagttccacaccgagctgccatcatcatgcagcccaacaaagcagcaattttcatatttcctagggcctgctgggctcccaacttcttagtttaaatggaaactgtcagacaggattttgtgcaaacatgcgttttcctcgggggcaaacattctgagcctacaacttgttctttcattttgagagctttttgtccatggtgactacatcaaagatgagaggtgggcggggagggctgttggggagcaccagagaacagagcaaatgcaaagtgcagggagagcagaatgaattactaggaggcaaagtgcggcaggaacttatgtgcctggcctcctcctgggcagcagcctcagaggaaagaccttggctggctctgctccccacctctcctgcagcccctgcgtggacagcccagtctgtgtcagcacctcttccctcgggtgacctacaaggtcctggagaggaaaatggtagcaaagaatgtgcaaaaaaccatgatgacagaagacagcagaattcccatatgaataggattaggtaagaaggggttaaatgtgttaatattcatcaggcggagctttgcgacatagttttaggcaatggtactgactcttctggaatcattttaaagggccactcgctttttcattataagtccattcactggagcctcttaagatagtctcaaaagacagataggaatgcgcccaaatccacctgcgcaccaacaccgtgtgccaagcaaatggaatcctcgggaaaggacacccattaaggaccatcccaaaccccgttaatatgtacatgttcctctcaagctttatgcattaaaccaagtcaactaatattttccaagctcttttaagatgtgtggtcttttatatgtgggttgtgtgtgtgtttgaggggtagtgacgaagacacccccatcaagataactgaagaagaactgcccaaactgaaacattcaaatctccaaacgtctccattccccctaggtgtttgcatttcagtggataagatgaacacctggctgtgaagcccacaggtaacctcccaggcctcacaagcccacaggtaacctcccaggcctcacaagcccacaggtaacctcccaggcctcacaagcccacaggtaacctcccaggcctcacaagcccacaggtaacctcccaggcctcacaagcccacaggtaacctcccaggcttcacaagcccacaggtaacctcccaggcctcacaagcccacaggtaaactcccaggcctcacaagcccacaggtaacctcccaggcctctgccaagcagaaccaatgaagtctgttgacacaagtcactagggaaaaaaaaaaaaaaaagtctctgcaactctgtgctccccattatcagagaaaatgaggtctgttctgggcctcccagctctgagctggctgccctgggtgcagccttccccaaaaactctgggtatccagccctcacccgtgctgacagcgcactctgtccaccagctcatgacaaaggccacttgtttcccatgagtgtccagaacagtggctgaaccagtcaacccagtcggggactgtggtcctgctggatgggcggtgacaagagctcactgtgacctcagcagacaattagcaaggcggtgtcgagttactgagctccagcaggtcacctgctaggctgggagaatggacagaatgcaggttccagacccaagaaggggttaggcagggtcacaggctacttcatctgcctccgtatctttatgctaagcactgcaccctctgacattggagggcaagaaaagaaaaggtgttacaaggaggaggctagaacctatcccaggagtaatctgagaattgagccagtggttgacaaccatcctaggaagtatttggaaatgtgtggagacatggtacggtggacacaatgatagggaggggcactgtaggtgggagccagagatggtgagcatcccaaaagtgcagaagatcccaaagccaagagcatccactgagatatactgaagtcagttccatctaccccagctgctctgaccatacctgaaccactgtactcagcacaaagccacaacaaatgtggaaggcagggaagaaccaagagttgcaagaagaaaaaaaatacaacatgcccaaaaggtggtgatgaggaaaaggggaaacttagaggcagattggggccaaaaacctatagacaacagctagcaggatttaccaatgagaacggcaagcagcttctcaaagagggatgcccctgccaacacggatgctgagctgcagcaggatgtcttcagctggagggcgctcttgagcccatcagcagccaaggtctacctgtcctacctccaagcctcttgtgctcgtcacttcctctccactgccacgatgtggccacacctctcatagctcaactcatctcatccaccccacgattcaccttgggtctctagggtcccaggtttgccatttaccaccacgggcaaggtacataatacctctctgcacctctgattcctcctctataatggcacacagaggatgaggtcaataattacactttacggccgggcacggtggttcacgcctgtaatcccaacactttgggaggccgaggcatgcagatcacctgaggtcgggagttcaataccagcctgaccaacatggagaaaccccatctctactaaaaatacaaaattagctgggcatagtggcgcatgcctgtaaataattatgctttacacttggatgtctcaaggtagcgctggagtagttattctgagctactggaatatcagcgagtgccacctccagagggagcttcccagagcccagccctgtaccatctctgagcttccaggagtccccagctctccagccgcagaataaaacctgcctggaagctggcactggagggtctccatgggcccagcctaacctgtccacaccctcccagggctcccccttctaccacccacacttctggccagactatagtgccacttgcttatcacacccagcccattcccaggtgttcccattcagttttctgattccaccatcactactgcctctaccaacatcccaaccgacccttcaggcccagctcaaatgagacctctccgaggagtttcccagatccccctacccaggaatgacctgctcccctatctccctatgcatgcctccctatggttctagctgatgtctactaggcctggcttcacctatgaggctggggtcagggtggtttcatggatgtgtgaccttgtgcagtctcacaaggctcacaattggcttcgcactctgctgttgccatcgtgaaatcctcaatgatttatgtgccgcaaggagctcccaattttcattttgcactgggcctgcaaactgcaaactgcagatgtggtcctgctgaggacttctcaaggatgaggctttggtttatctctgcatctcacagactgcagcagtgactgggacacagtaaggacttaacaaaggagggaaggtggtgagtctccatgtctctttgttctgtgagcagctgtcacctcacacagctcattattcataggctggtgagctcacctctgtcccccaacagacacacacacacacacacacacacacacacacacacacacacgagaagaaagcaacaattcagctcagctcattcccaaaagccacattccctccaaccccgctacacatcactcccacaggacatcacaaaaaaaggtcgctggatcctactgaaaatgcagcccctcagcacttcatctcaaacactttctcccacagcaggtggctgagggctggtgtgctgaaaagctcacattctgcatgcgggaacactgactccggagccatccggctctgctgcttgctggctgtataactttgaatgagtcccctagcacaaggcccagaaagggggaaccctcagggatctggctgtccccagccctgcccctctctcagactcgaccctgcctctttctgcaggttggctcagagacacaggcccccagggatcacagcaccctgccctcatcatctgcatttatggtccccacaagtcccagactcgggaggacggacacacccacaggccaaacaaggcattaggaacatgggatggcacagcttcctgggatgccccagcttcccgggatgccccagctaatggaatcgcacccagtcctggctctgatcgcagtagcacatctgacacgtgccctcaatccctccctacctcgtgacccataagcagccttttggcacaggcacacagccattagtcaagcaacctgtgagaaaaacactgcctggccatgcaaaacaaatgtaggtggcccattagaaagtgaggacttgtttgtgaaaaggtacatgtatggaatgcaacagcctcctccctctgtatctgacttgggagcactttcatcataaaattttggttgacactagatgtgttcttacttgtaagacagcacagttatcaggaagagtcacagaatgtcaacaacagaagggaccccaaagataaagtagtccagtgccccatttgacagatggggaaactgaggcctctgtgttcccagggccccagcctgctccccttggacactgcacctgtgtactatattgccaatgactgtttacaagacacctcgcacaccagacagtgaattcctggagaccagggtggtaccttcatctctgctgccctagcttccctcacagggccaggcagccaggagacacccaataaaggattgctgaatttcaaaacaatacgtgtacatgataaatatatacagtatttgtccattttaaagggtaatcaagtttttaaaatgaaaataaaggattgctgaataaatgaacaaccagagaggcggccaccagccaaggacaaacaaagctgaatctggaacactggcttcctgctgtcctctcagactaaacgcagtaggtactgggtcactgggagaatggcaaggccagtatgctgtgtgtgcagggacagggcacccccaggttgggagccaagcctagtcccagccctgcctctggcattggcattggcgtgctagccatttgaccaccagagcagcccctctctgaagctcagtttcttccattcttgattgcaggacaaataaacgtcaccttacctacccaccagtgtctcagcaaggaaggagagagagaaggaaacgtcaccttacctacccaccagtgtctcagcaaggaaggagagagagaaggaggtgaaagtgcactgaagacctaatacacaatgtatacttaagcgggactgtcaggggacaaaggtattcactggggaccccctgcccccacccagtaatgctgccacattttccttatccaccagcccatttactcctccataaccctgttaggtaatgagaacagacatctcagccccactttactgaagagaaaacaaggtcgagagaggccatcgatagtgtctgtcctccagtggccctgccaggccaaggggttgggggcacggcaaagggctccaggagtccctgcccgccccagacagcagcacctgccaatcttgtgtatcaatgggcagcagtgctgggctgtgacttgccaagtccatagtcagtccctgaatgccatagggaagcatctgctctggacggtcccgtgcttgggggcagaatgacataagtccaaagtagttcaaacggaccagcaaaaagtaaccaaaacatagccaacggcctgtggactagaagtcagtgcagacaccattacctggttttctaattctccctggaggaaactggatcaatgggggatgggggaagggacagcagtttttgaccccctactccctgggcctgaacccttcccagagctgagtcctcttctccactccctactgtctccctacccggcgcgtggcccgcatggggccttcccacaggtggactgatttttctgtccctcagaaccagagccagtggacaaaacctccgttcccaaactccaagccaccaatggaaggcctcacataggaagctgtgggtggaagatggtgcgtttctactgcctggtggttttagatctctatcgcctactcagaatctgaaccctagcctgtgtgtgtgagaggctgcacgtgcacatacaaaaacagcaaggtatctacaaggggggtcaggattgcagaggggctacctgtgtgagctctggagcccaactgcctgcctgggaatcccagcttacccactgactagctgtgtgactcagggcaagttctttaaccactctgtgcctctgtctgcacctcactctccttgcccctaaaacaggggtaagcaaagtacccacctcccaggatttttgtgaggctaaaatgagataacacctagcacacttgccagacaagaaaagttctatttttccccagcacaatgttaatagggttgcctctgggattttgtgtgcttttctttttcttcttcattaattaaattttctacatgaatgtgcatgctttattgtcagcaaagaataaagctttttttttttttttttttttgatggggtaggaagaacagctcagaatcccaagtaaccctttcttttaaacacagaggatggaagcagccctctctctgctggtctattttaggatcttctggatgggcaaggagttctactgcccaaagcagcccaaccttttctgctccctgattcccagcgtaccccttccccacctctgcccatccagaaaaactcaaatctcacctcctccaagaagccctcgctgctagctcagcacctctcttcctcctggggaacaaggcctttcctcactctgccctcccctagctggcactatccactccagaggtcttgtaccggtctctgttccaggggcaaggggtttgccaagaccccagcacagcggtcttgaggggcagggccaccttccttcctatgtcctttcaaagcactcgctctgcttttcttcttggaacttcgatacaaccttatgagaggtggacatgggttcagggaagaaaagtgatgagcaggtcacactgctggacttaaccccagtctgaccaagtccatcagggctcactctgcagccccaggctgcttcccatgggaggctcacagcaggcactcagctgacagaccctcacccgcagggcagcactgccctggcccatcatacatctcttcctccaccctgtccccgccaatgccgtttcactactcacgccccttctccttcctccccaggatttcccttctcctctggctgtgctttggtctgcagtgaccctagctgatgttctgaaggtgttcagagctaaggaggccagtgaccccacatcaaaaggggaaaagagagaaaaagtttctgagctttgtaaaagatgctactggtttttctctgttttatgtcaaataacctgtaacactcctggcaatggtacatttgagccctgagtatagaaaagaatttggcaggacagtttaaaatgtccagacttgaaggtgtcagattttgtaagtgaagaaattcagaacacagaagcaaacctcaattcagggacactggagaagtccctcagctgttcagaccacagattctgtaaaaaaaggatagcagatgtccccagatctcccagtcccctcccaagtttcaagaattctaaggctatcctggggatatcagtagtcagcgtaggctgggcgcggtggctcacgcctgtaatcccaacactttgggaggccgaggcaggcggatcacttgaggtcaggagttcaagaccagcctggccaacatggtgaaaccccatctctacccagggctcaaatgtaccactgccaggagtgttacaggttatttgacataaaacagagaaaaaccagtagcatcttttacaaagctcagaaacttattctctcctttccccttttgatgtggggtcactggcctccttagctctgaacaccttcagaacaaaaattagccaggcgtggtgatgcacgcctgtaatcccagctactcaggaggctgaggcacaagaattgcttgaacccaagaggcaaagtttgcagtgagccaagatcccgccacagcactccaggagactgtgtctcaaaaaaaaaaaatagtagtgagtgtaaatgtctatatcataacaacgtgttctaacaaagatctgtcaaccatggataatccagattttatttggctagtataacgttagcataacaaccagttgcaacatgtttcttcagagcctagatttttaaaaaatctataaaaggcaggtatagggcaattagagagatttaagaagaactatagactagaggatataattgcatcagtgctgaggttcttgggtctaataatggtggtgtgtcatgtaggaatatgtactggtttgtgcatacttcaaggtttaggggtaaactgtcctgatgtccacaacttttttccaaatgaatcaggaaaacaagttttatatggatacatctgcagagtgagaaagtaaaaaagcaaatatggcccaggcgcagtagctcactcctgtaatcccagcactttgggaggccaagggggggtggatcactgaggtcaggagttcgagaccagcccagcaaatatggtgaaaccctgtttctactaaaaatacaaaaaaatttgccgggcatggtgacgagaggctgaggcaggagaatcgcttgaacccaggaggcagaggttgcagtgagctgagatcacaccattgcactccagcctgggccacaagagtgaaattccatctcaaaaaaaaaagcaaatatggcaagctgttaaccactggtgagtctcggtgacgactaaacaagtgtttatcgtactttcccttccattctttgatggatctgaacattttcaaaacaaaatgtcagagaaagaaagtatcattaaaatgtttaaaacagaaaattcgaagaaaaataatcccactgcccaaataattctataaaatatttgttgcttactgcaggaaaaaaaaataggcatcaaaaaattaaaaagccaggcatggtggctcacacctataatcccaacactttgggaggctgaggcgggcagatcacctgaggtcaggagttcaagaccagtctggccaacatggtgaaaccccatctctactaaaaatacaaaaattagctggatgtagtggtgcatgcctgtaaacccagctactcaggaggctgaggcgggagaatagcttgaacctgggaggcgaaggttgcagtgagtggagactgcgccactgcactccagcctgggcaacagagagagactccatctccaaaaataaataaataaataaataaataaataatttttgctatttaacaattgatttaaaaacaagtgagtaatgttgtgctactgctgccatgtttcatgtaccccaaaagggaaaatatcctaagagaatctttcctcttaataaactaatgtttaggcaaacagataaaaataacacttgaagaaaaaatctggttggctcatgcctgtaagcccagcactttgggagaccgaggtgggtcaataacctaagcccaggagttcaagaccagcctgggcaacatagtgagaccctatttctacaaagagagaaagagaaagagaaggagagggggaggggggaaagggagagaaggggaaagggggagataggaaagagacaaaagaaaagagaggaaaaagaaaaagatctatcatataatttcttagtggtagaattaaagaaaaaaaaaaggatgtggttcccaaaatgagggcctatacaaacacaggagacatgatgaagtttgaaaatattctatccaaatattctggtccccttgtctctgtgtcactggagagtggtagaatttccaggcaggttctatctcctttcccatagatagcatagcccctgaggctccccagagaccctccgaagtcctgtgattgcccattcaggagtgtgggaccaccaaacactactcaagaccagcatggcttcaaggaagctttggcctcagggtagctgctgctaccacaagcaccttcctcccaggagccagaacagccttctccatcagcgcaggtgaccaagtggcacatggctcacttggccaccacgcttaggccaaagcagccctgcatgtccccatcaacctggcctccccaaagacctggattctgtttccacatctccaccctctaccacacgtggactctgcagttccctgggacttcacttttcttggagaaggagagagaaaaagggaagcaaatcctgaattgctcgtaggatttaaaaacctctccacagaggggagctggggacaaggtaggggagacagtgctagcagcacaatctgaggacgggtcccctgccagccctccgggcacacagggagcaaaaggagaggcagaggcacatgggagcaggggctgggagatgctgcatggcgcaggctgtgggcttggctattaaagccagaaaaggcctgcctcctcctgccaatagagttatcttttaatccgaaccccaatgacaccacctggcaccagcgcaggagcagctcctgacggcacacgagtcacgcggctgggccccgcgtctatcccttcaggtcagggcttgccctgagtgctcctgaggaagtgggcccctgccccctccatggcctggctcctgacaggcctgtgcatgcctgagagggccaggcaggcggtaaggaagtagaggaagctccgtgctgtgcaaggtcaccaaatgctagatgcaaagacccagaaagggagggcactcacccaaagtcacccacgccgggacggggcagcaatcccaggattctcctcctacccagatgcggcaaagaggtttgcagcccaggacagctgttatcaactagccagtgctggaaaacagcaggtagcaccccagacctgccactctccacgtactcagacaactcatggcccaatctgaagatggctttcctctgaattctcccacatctgtgccctcctgcagggcttggtttctgaggtcccatccgccttgaagttggcaagggctagggtagcatgtaacctatctccctagtaaggatggcactgactctgctgtggcagcatccaggccaggcagccatccaggccctcccagactgggggagctcagcacctccagaggcagccacctcaccacagaccaacacaccctgctgcagcgttcttccttgtgggcaatggaaatctgccagcaggaactggtagcagaaaactccccaaagcctgctccaattctccaccccagtacaatgggcgtgccctcaggattccaacagccaagggcaaaatcccgactcactggcttgggactctgggcaagtgacttactctctctatgcctcagttccctcatctgtaaaatgaggagagtagtggccttcatcttagagttgctgggatgagatgatccttgcaacctcccggggcacacatgagtggtcaacaaatgctttctatggctacactacaatgcacagttccacaggctcaaggcccagctttctgcccctctcctcatactcattccactttctcatgaccagacttgtgctcagcaagtgtccactcctataggttcgctcaggggtagctggctcaccagggacacattttaaaccctggcctcttcctccaaaacttcagctcagagccttggcaagccatccctgccgcccactggagatggctgacgagaaaaccagaaagagaccatgaaagaggaaggctcttctcactcctcactcatccttatcttggaccagtatcctccacacaacaccaacacccaaacataacagcaaatggatataatcttatcaatttcatcctccacaaccttctacggctccctctggcctaaagtcaaaaagccttaccccagactttaaaaggaagagataaacacttagtgaacatttgactatgtgtcaagttctctgctctacagtgtatatatattatatcatttaataactccctctaaaattcgtcttattgcttgcatcttacaggtgaggaagctgaggctccaagacactaggcaacttacctaagcgtcacagctcagaaacagaagcagatttggaggccagatctgggaggccacaaggctgggtccttggcacagcctctacctcctctccaggtcatctcctgcaacccctccctgacccagccactgtccagtcaccacggtgcccatggtcacctggcacacctggctgtgtcctacattaatgcatatcctcacgcttctgcttctcctgcctggaacgcacctacctatcacctaatgaacttctactcagcccagaaagctctgctctcaagttatctccttcaggagacagaccttcaccccggggcccccttccataagagaaaaacgatcccctttggctgggcatggtggctcacgcctgtaatcctaacactttgggaggccaaggcgggtggatcacttgaggtcaggagtttgagaccagcctggccaacgtggtgaaaccccgtctctactaaaaatacaaaaataaagcctgggcacagtggctcacacctgtaatcccagcactttgggaggccgaggcaggcatatcacgaggtcaggagtttgagaccagcctgaccaacatggtaaaaccccatctctactaaaaatataaaaattagccagatgtgatgacatgagcctgtaatcccagctactcaggaggctgaggcaggaggattgcttgaacccgggaggcggaggttgcagtgagccaagatcgtgctactgtactccaccctgggtgacagagcgagactccgtctcaagtaaataaataaataaataagcaagcaagcaagccgggcatggtggtgcacgcctatagtcccagctacttgggaggctgaggcaggagaatggcttgaacccgggaggcagaggttgcagtgagccaagatcgcgccattgcactccagcctgggtgacagagtgaaactccatctcaaaaaaaaaaaaaaaaagaaaagagaagaaaaaagaaaaacaatccctttccttggatgtgtttcccaagcgcccacagcaaggcacaacttatcagtccccaagtcagctgtgctgccgtctgctccctaatgtggaccattcatcctgactactacagcacagtacgtttacttgaagaagtgaataaatgatgttccttctgacttacagaccaagaaacagggccgtcagagcagacttgacctttacagggacaactggtaaacagcccatctacagtagcatcctggaggttacacctggcaaagagttaccccttggctgggtgcacctgagcaaacccatctggactaacgccggtgtcaggaagtagcacatccacacagtgcagctatggccctctgaggaaagactgctgcatcgcatcagaaaggcagcatccgtgacttctgcggtccacgctgacgggtggggaggcaccttggggcctccttcccgcactgcagacaatggctgggaagcccacaccccagcctcctggcactctcacttctaggcacaggatgcagcaacccctggcaaaagcagctcctctttgctgacctggacataaggacgccaggacccacagtgggcctgagccaacagcacccggctccaacggtggagcagcccaaggtccccctggggaagggctggaaagacgagctctctgtcctgacccacttctccctgcacactcttcccagatctggcctggcccagccagaaagccaactatgagatccttctcatcttatgacattagtaagagaaatactcactcgtatgctggtattagcacattagactccccaaggccactcccactttacagaggaacaaagtgacacccagagccaagtccctaaactgagctcctctcactcgctgccaccgagctgcactcacaccacagctctcccttagagggaacagacaggtgtggtctctgtctcccttccaggacaggcttggacactgaggagatgccgtgcctatttcccaaacaccgagtaaaaggaacccctggggtccagcccacacccaggttctgattcacagacctagggtgaggccaaggggtttaatctttcagaagcttccccagtgactctgaaaaagccaatccaaagactgcacccggggaaccccaagcgtgaacccaggactgctgtttcagcccagcaatttgtatcaacagccgttcaaagtccacaccctttgacccaacagcaccacttctaggaattcatcctgagaaaataaagaagcatacaaagatctatagcatgaggtgatgcaccgcagcattgtaagtacagaaaaaatgggaaatctctacatctccaatcaagaagaactggtgacataaatctcaatcaggcaagactgtgctcccattaaaaacgagccattgagggccgggcgcggtggctcatacctgtaatcccagcactttgggaggccgaggtgggcggatcatgaggtcaggagatcgagaccatcctggctaacatggtgaaaccccatctctactaaaaatacaaaaaattagctaggcgtggtggcatgcgcttgtagtcccagctactcgggaggctgaggcaggagaatggcgtgaacccagcaggcggagcttgcagtgagccgagatcgtaccactgcactccagtctgggcgacagagcgagactccatctcaaaaaataaataaaaaaataaataaataaataaataaataaataaacgagccattgagcatccctcattctgggcgacagagcgagactccgtctcaaaaaataaataaataaataaacgagccattgagcatccctcattcaaaaatccaaaatgctccagaatcccaaactttcagagcatcaacatgagatagtaacacctttgcattctgatggttcaatgtacatacactttgtttcatacacacaattatttaaaatagtgtataaaatcaccattaagcagccgggcgcagcggctcacgcctgtaatcccagcactttgggaggccgaggcaggcggattgcttgaggtcaggagttcgaggccagcctggccaatatggagaacccccgtctctactaaaaatacaaaaattagccgggcgtggtggcacgtgcctgtagtcccagctactcgggaggctgaggcaggaggactgcttgaactcgggaggcagaggttgcagtgagctgagattgcaccactgcactccagcctgggtgatagagtgagactctgtctcaaaaaaaaaaataaaaaagaaaaataaaattaaaaatacaattagccgggcatggtggtgggcacctgtaatcccagctactggggaagctgaggcaggagaatcgcttgaacctgggaggcagaggttgcggtgagccgagatcgtgacactgcacttcagcctgggcaacagagtgagactctgttttgaaactccatctcaaaaaaaaaaaaaaaaaaaatcacttttaagctatatgtagaaggtatatatgaaacataaatgaatttcatgtttagacttcggtcccatccccaggatatctcattatgtatatgggaatattccaaaatccaaaaataatcaaaaatcggaaatacttctggtcctaagtattttggataagggatattctgcctgttacagcatcagacctaaaacttggagcccacttcaattagtgcaggaaggactgcagatggcatctacatacaccatgaaggtgatagaactccttccctgacatggctgaggttctacttgaatattcccagaaaacaagagctctcgcaattccttaacagtggtttctggcaattaaaaggctgctctaagtcaagtgtggtggtgtgcacctgtatctcagctactcaggaggctgcagtgggaggatcagtgggaggataacttgagtccaagagtttgaggctgtagtgcacaatgatcacgcctatgaatggccactgcacttcagcctgggcaacatggcaaaacccccatctcaacaaaaggaaaaagaacatgttgctcctctcattctgtcttgctgccaccatgttagaagtgccttttgccctccaccacgattatgagacctccccagccatgtggaactgttcataggcggaagggacttgccttgtctcagatgagactttggactgtggacttttggattaattctgaaatgagttaagactttgggggactgttgggagggcatgattggttttgaaatgtgaggacctgagatttggaggggccaggggtggaatgataatgatttggctgtgtccctattcaaatctcaactgaattatatgtcccagaattctcacgtgttgtgggagggacttacggggaggtaactgaatcataagggccggtctttcccatgctattcttgtgatagtaagtctcgggagatctgatgggtttatcaggggtttccgcctttgcttcttcctcattctttcttgctgccacattgtaagcagtgccttttgccctctgccatgattatgagacctcccagccatgtggaactgtaagtcaaattaaacatcctgttcttccaaataaaaaaaaaaacaaaaacatgttgctcctaatcctgagcagagttttactttcctgaaggtaaaatctcctggctccggccgggcgcggtggctcaggcctgtaatcccaacactttgagaggctgaggcgggtggattgcctgaggtcaggagtttgagaccagcctgaccaacatggtgaaaccccatctctactaaaaatacaaaaattagccgggtgtggtggcaggtgcctgtaatcccagctactcgggaggctgaggaaggagaatcacttgaacccgggaggcagaagttgcagtgagccgagatcgcgccactgcactctagcctgggcgacaagagcgagacttcatctcaaaaaaaaaaaaaaaactctcctggctccttgtcatttttaaaaatattttcatagagatgagttgtcactgtgttgcccgggctggtctcaaactcctgggctcaatcgatcctcccacctcggcctccaaaagtgctgggattacaggcatgagtcacctcatccagcccatcttcctgtcttatgtagtatcacaagctcaataaacacgtggaatggagtggttgttttcctagaccattcatactttttccactatggccaagatgagaatatgggtttttacaagcactgctgatgcatattcacaatgccatctttaaatcaagtgtttgcgcacctcttccttccacaatcacctagctaatcatccttgtccctacgttaaaaacacccttgtccctgctgtgtcaactatcacatgacctgaagttgtccctccccacctggtgaccttaacagctatgtaacagcatgggtaactctttaccaagaccatttctgggtgaacgacctgcctgaggttgccagctcagccaaggcacaaggtgccacagagttgagtgatggagcacagccaagaccctcccctcaaagacagcactaggatgggaaagagatgtatttatttcctcttctctctctcgtcttatttatttccttttattcccatttccctcccctcacccacagtcaaccattctcttgtgttaatctgttcatattcttgcaagatgggtattgttctatatcagcaatctacataatagcactgcaccatccatgctctatttcttatgttttcactgagcactgtgcatttaaatacatcatgctgcctgccacgtgtgcttctcaccagtcacttggaattgctgcaagggactacagactcatacccacccattatacccatttgctctgcaggaatggacatccagctctacctcaccaccacaaacaacactgcagtgaacaccctggaccttccccttaggacctgcatgagaacctggggaactgacacccatgggaggggcttctgggtcagggctttgctggtaccctgccagaggctccaggacagctgcaactgcaaaggcaagagttcctgcatccccacacccactgctgataggcagcatccagctttctagttcccaccagtctaagaggtgaaacaggatcgagctcaaggttgtgttccagtatggattcttaccaaacctgactgaaccgtacctgctaagggaatggcaggaaaagcacttgtaccgtaagcatcactggtgtgaaatggaaacaactgctcattgataagtctccactgtgaggcctcactttcttgaatcgtcagggacttctggaacacaaatgtcatgcactggcctacaaaatgccatcaatcccaccttctcccactggctgaggctcctcccaaggaggtcgactgttcaggatgggcagcaacagtgctgcgctccacttttttttttttttttttttttcctgagatggagtctcactctgttgcccaggctggagtgcagtggcacaatcttggctcactccaccatccacctccccagttcaagcgactctcctatctcagcctcccgagcagctggaagtacaggcacgtaccaccatgcccagctaatttttatatttttcagtagacatggggtttcactatgttggccaggttggccttgaactcccgacctcaggtgatccacctgactcaggctcccagagtgctgggattacaggtatgagccaccgcgcctggcccagagctccacttttttatttgcaatcacatcatccttctattgatgacttacctgcagctcacactacacaccactcaccacgtgatctgacaacactgaagcagtctatacctgttcaatgagtactagcaaggtcaagttgctctaaaggttgctaaacactcaatctctgtgcttgcttacttcatcacagaccaggaaccagaagattgcaaaccagcactggtctgtagaccacaccctgagttgggggtagagtagggagaaacaaaccaaccaacccgccctggatgtcatggctgggctcctgcccccctatgccacttaaacagccatggaactgggacaatcataagaatgaaaataactgggccggcgcggtgactcatgcctgttatctcagcactttgggaggccaaggcaggcagatcactttagcccagaagttcaagaccagcctgagcaacatggtgaaaccctgtctctataaaaaatacaaaaagtagccaggcacagtggcatgcacctatagttgcagctactcaggaggctaaggtaggataatcaattgagcctgtgaggtggaggtggccatgagctgagatcatgccactgcactccagcctgggcaacagagttataccctgtctcaaatacacacataaatatagcagcttacgcttacacagtacttaccatgtgccacacactgctgtcaacacttactaacttatttaaccctcacaatacaaggtcctgttattatccccattccacagatgaggaaaccaaggcacagagagagaaagcaatttggccatggtcacggtaagtggcagattcaggattcaaacccagtatcttggctcaggtacaggctcttaattactctcctaaactgactcctgagtaacccggccttccttacctgtttcctcacttgtaaggtcaggtaaggacccctaaaaggttgctggtgagatcaaatgagaaaataaatacaaaaataataaagtatcctatgcaacacaacacctaccacctacacagcatacaaccacccatgtgtggccatgaacctgcagcagccacctacctttcacacaagccacaagagggcgagggagtcacggatcccactgcagaggtgaggacatgaggcctggaaagcagaggtaccctcagccccctctctccttagccatgctcttctcctccccaaagagacagccacaacacaggaacatgtcccacactccccagaggacacaccaactctatttccaaacatccccactgtaactctcagagttgaaactggggagaacgctggctttccaatcctcctagcaactcacagacagccagtcagacacctcaggggatcctgggaaggccagccagtctacatcctcacctacccacctgcggccaccgggtcctccttcacacatcacagaccacccatcagcctcccacccaatgccaacccaacccattcccctctccagccccagcagcctcacaagagaaccagcccagagagaatgactggaaggacagcagaggctggttggcctggcctcatttttccagcacctgctgagcgaatgctccaatcagaagccctgaattaccagacaaacccgccagtcacagaatggattctctcccaagtcctgctctgtgctctcccctcgccaggtctacctccctccttccagccgcctgcctatgcccagctcaccatacaccctccttccttaggcactgaaacttcaagcagcctcacctgtctggcactatctgtactactagatacccacttgttcaagttttccaacaagacaataaactcctggggggtggggggagagaagccatcttctttgttgcccttctgagaatctgatggatttttagacacaaaaacacttgccatgtgctataaagcacaaaatggaaggtgagaaggaggaagtcagtataagctaggctgattattttctggtatttctaaaagctccacaatagagcaattaaaaaggaaaacctttgaaacacaacagcaggatatatatgttccagctaaaagaacgaatccaggttggaatattgttcatggtagatatctttccatctttgcatgctcagcacttagccgagcctggtaaagagtagtgaccaggtacttgctggagagatagacagataaactcttgtcagaatctgggctccaccctaaagcttgtgttatctcatgcaaggagaagacactgtgaccagctccactgagttctcatgagaagcctgaagatgagggaggttacagaaaaccaaatactgcatgttctcactcctaagtgagagttgaacaatgagaacacatggacacaaggaggggaacatcacacaccagggcctgtcaggggtgggggtctaggagagggatagcaacagaagaaatacctaatgtagatgacgggttgatgggtgcagcaaaccaccatggcacgtgtatacctatgtaacaagcctgcgtgttctgcacatgtaccccagaacttaaaggtattaaaaaaaaaatgagggtggctgaggacaaaagatcaagactacatgaaatttcacaacttcccacagaaacaaggacagctggtcaccgttttgttctctctccctgggctcacaaaatcgggggaaatgcaacaagatacagaaaggtggtttgccattttctagcaaaaatgagtggggggatacataggcgcatatatactcacacccacagcccctaaactctaaaccgccatgggtttagctccgtttttttcaggagaaggactcaaaaccagcacattttggttttgtttactttcctgctttttcttggatccagctcctactgagattggctatcagggtgggtcccaactcagtgtccacggggccttatcctcttatctttataaaaggcttttttccctgggacaagaggcccggtggcctcattttcctgcctgaactctgccctgtgactaagcaagaagaagccacggcagccagcacccagagtttctgctgtgtcacaaaaaggagtcatgggtctccctgccagcatcagacccattccccgactcagcactcaatttagatatcacgtcctacgtctacatccagaaagcccccagtgtgacagatgctcagaacacatctgctgaatgaatggacgaatgctgtgacgaagagaggtggagaggtaggcaaggctcagaccacagaaatggtcacagggtggcctgcagtaccgagtaaaggtagtcattatcaaaaaactgacaaggactccagggcttgcctagcctctcagcagctgatggccctgagcaggctaccaaactctactggccgagtgtgcccatctgtaaaagataaatatcaattgcagaggctgataaaagatttttttcattgatcaggaattaaaggctgtagctcaagtccagaaactgggatgctgtgtcacttgctcaccctcactgtaaaggctggtgcccacaaagccaggagaatgtcaggaaaaactagccacggatctgagacttcccacccagcctgctcctggtaaagaagtcttggaaggaaccccagcctgggaagagacctgtttctcatttgtaaaataaggagtttgggcaaagtggtttctaagatcccttccagccatggcattcaacaatcataggctccttaagaaatgtaggccgggcgtcgtggttcacatctgtaatcccagcactttggggggccaaggcaggtggatcacctgaagtcagagtttgagatcagcccgaccaacatgataaaacgccgtctctactaaaaataccaaaaattacctgggtgtgatggcacacgcctgtaatcccagctactggggaggctgagacacaagaatctcttgaacctggaagtcagaggttgcagtgagctgagactgcaccactgcactctagtctggagtgcagcctgtgtgacagagcgagattctgtctgaaggaaaaaaaaaaaaaaaaaaaaaacataaacaggaaaagaagttctggtcagatgagaagaaaggttacttggaatgagaatagaggttaccatgaatactgaaaaggccactatatattttttttaagaattaaagtgttttattgattgattgattgattgagacagggtcttactgtccacccaggttggagtgcactggcccaatctcagctcatgcaacctctacctgtcaggttcaagggatcctcccacctcagtctcccaagcaactgggaccacaggcatgcgccacagctaatttttgtattttttgtacagatggggtctccctatgttgctcaggctggtctcgaactcctgggctcaagcaatccgcctgcctcccaaagtgctggaattacaggtgtaagctaccacacctagccagaattaaagtattttaaagtattacttcttacgttaaaatatgtaaatagaattagattttgtttcctttgttttgctatcaccttcctcaatattggctggaaagatctttactacatttggatagcagattggcaatggtcaaatatgtgcagatttaatttggggactcaggggtcatcttagagccagggaggtaccattcagacaagcaaactggggtggactctgaagaagaggtttgagaggcatgccacatctataaaaatcctgttggcagggaaaacacaccctggcttgaggtggccaccagggcagcagctctgagtcagagatggccatctctaatggcaccgctttccacacgggcagccctgcagcccccacggcaggctgcatgttagcaggagcttgtttacgcataaaaacgaacagttctcttatgcaatagaggggtaaggcaaacaagtgataacattttcttaaaaaaaaaaaaaaacaggctgggtgtggcaactcatgcctgtgatcccaacactttgggaggctgaggagggaggatcacttaaggccaggagttcaagaccagcctgggcaacacagcgagaccccatctctatgaatttttttttttaattagctcagcatgatggtgggtacctgttgtcctagctactcagggaggctgaggcaggaggatcgcctgagcccaggagttcaagattacattgagctaggatcatgccatcaatcatgacagcatgggcaacagggtaagaccctgtctctttaaaaaaaaaaaaaaaaaaaggttaatttttctatttatatctatctatcaatttatttatagagatggggtagggtctcactatgttgcccaggttggagtgcagtagctattcacaggcatgaccccaccactgatcagcatgagagttttaacctgctccatttctgacctccttaggcaacctggtggtctcctgctcccagggtcaccatattgatgccaaactggccacctgattagcatagcacactacagcccagaactcttgggctcaagcgatcctccctcctcagcctcccaagtagctaggactacaggaacatgccagcatgcccacaagaataatttttcaaaaaaaaaaagtaaccactgctcactgcaattgaccttctgatgggattttcactctgctcctccccacatcactgtcctggttaacagagagtggtttttactcgccacaaagtggctatgtgtcttttttaaaagcacagttcatcccaagaggaaacctacaaaggaagcaggtgaagacaagagtacccagtgaaaacaccatctgcagcctctggctccagcagtggctcaccaccccagctcagctcacgcaaagcaaggtgaggctttcaggtggtgcttccctctcccacatggggagcatcttaaaccaaaagcaagcagaccagtggttttcaaactgggttctgtgaactgtggagaaccccagggaaacctgtggaggagcctcaagaaggccacaagctcaagggacaagctccaagcccatactccccatcagtgcctctctcgtctaatttacagatctggctctcacctaagagtgcagttaacaaaaaagacctcatggctaaaaaaaataaaaataaaaaacttaagtcataaaagacatttacactttgtacgtgttatttcatttaattgtttgcatcagccctctgaggaaaccatggctaaacagtttcaggattgcaagtcgccacctagaacagtccactccagagctggatagcaccaatcatttttaaaagttcttcctgaaacaaccggcctgggcaaggggagctgccagggattataaaacagacttcagagacaacatcaactaaatgcagtgggtggcccttgctaaaatcctgattttaataagccaccaataaaatgacatctttgagacaagcaaaactgagcatcacccgggcaacttgataacattaagaaattattattaatgcctcatctcttagagacacatctttaagtatttataagaaaaatgacatgctgcctgggatttggttgggagagatgggtgattgttacattatcctctctgttcttccacatgtgtgaatgtctttttcattttttacttttttagagctggggtctggctctgtctcccaggctggagtgcagtggtacactcagagctcactgcaacctcaaactcttgggctcaaccaatcctcccgcctcagcctcccgaatagctggggatacaggcagtgtccccttgctcagctaatttttttttatttttgtagacatggggttttgccgtgttgcccaggctggtctcaaactcctgggctcaaggaatcctcctgtctcgacctcctaaagcgctgggattacaggtataagccaccatgcctggctcttgaaagtctttaatagaattttaaaaggaagaaagacagggagggagaatggttcttccttaaaatgaactcaattctacctccaagtaccttctggcaatcagaccatgttcagctttctgggatcaaagagaatcaggtcttatcacataccctgcaccatctgaaaatgagcagcatctaagtccctctaagtatcctttcctcaaaaacaagctcttcaaggtccttttggaactgaactcacaggtcacagcaatgccctccttaaaaatgtgggcttcaggaccaaagaattgtgaaggtgtcttttgagcagcccagagaagcatgggcctcctcgtccactgcaggcctctgccttgggcatctcccatttgaactccaagtatggcctatgccctgggatgcctcctgattccatgcacaggctgggagcttgttctctactcagggacaagctacccccagtagctccagaggcggcagcagcagcttgctcctgtctcacctaaatcatctccaccctcaccaaagccctgggtgaatattattagcccctcttctacagatggggaagagaaagcaggcccaggaggttaagcgacttgaagtcacacagcttaggagtaaagagctaagatttaagccccagtctgtgggggtccccaagagtggactcatgacattcagatgtctccagtcccgcagccttgctccctggctccaaacccaccaagaatgccccctgggtcattcatccatgtccttctcctcccaggagtaacataacactctgaaagcagagaccaccttccccacctcctagcccagaacctcccaggggctcagcaaagagttgcccaaaacttaaccagtcccagacctgcagccgccaaaccaccaggatggctctccacaaatctttccaaggctctcccagaaaccccaactgtggcccaaagcccagttctcttcactcatttctagtctctagagcaattcaaagaataatgatcacaaaaccaggcttcattcttggcgaactccataggggaaacaggaccagagaagacacacatctataaaataatgactactagccccagaatcacatgtgactatttcagctggtatcagaatttaaaagactaggggctgggcacggtggcttgcacctgtaatcccagcactttgggaggctaaggtaggtggatcacgaggtcaggagttcaagaccagcctggccaagagagtgaaaccccatctctactaaaaatacaaaaattagctgggcgcagtggcaggcacctgtaatcccagctacttggtaggctgaggcaggagaattgcttgaacccgggggacgaaggttgcagtgaaccaagattgcaccactgcactccagcctgagcgacagagtgagatgccgtttcaaaaaaaaaaaaaaataggaacgtttagtgttttggtactctgaatgagagggctaggggaaacgtaaaaaaatgatggtatacgttgatgctccagtttcacacattaatgttttaatttcccaaaaatgcattcctcagaacactgatgtcgcaagatgctccatgataaaggactctgtggttaaatcagtttgggaaacactgcctaataaagccactctagtgaagccccaaagcacactggcttagccctctcaaggggcctgcagaaaagaacctagcactgcctggatgcatttgaccacagaacccttttagggcatagcaacactaacatcccagcaaactagcagttagaagatgtttctttgggaaatgctgatctaggccttttgaaagaaagtctcaatagccttgttatcccggatttgagactgaaaaaccaaaccaatcctaaacgggataaggaggaagtatccaaagagcaaaaataacgaacatgcttcaaggcctttagggatgaagatgtaagtactgaaaacacaaagaaaatgtgtgaacattccttggctgccagatatgaatgccactaggattgtttggttaatgtctggcctccaaagagtcacatgtaggacaggtgtggtggcttattcaataatggattgtttgaggccaggagttcgagaccagcctgggcaatatagtgagaccttgtctctactaaaaataaaaaaaaaattagctgggcatggtggcacacgcctgtagtaccaactactcaggaggctgaggcaggaggattgcttgagcccaggaggttgaggccacagtaagccatgatcatgccactgcactcagcccaaacaacagagcaagaccctgtctcaaaaaagaaaagagtcacagataactactgaactgtcctaagactttccaaaccatatctgaaggaagaaaaaaaatttttttttttgtaagacagagtttcgctcttgttgcccaggctggagtgaaatggcacgatctcagctaactgcagcctctgcctcatgggttcaagcacttctcctgcctcagcctcccaagtagctgggattacaggcacacaaccaccacgcccggctaaatttttgtatttttagtagagatggggtttcatcatgttggccagctagtctcgaactcctagcctcagatgatccacccgcctcagcctcccaaaatgctgggattacaggcatgagccaccacgcccggccaaaaacaatttttagaagaaaaaaaggaaagaaaatgctatccacccccatgtcagggtgctgtgaacagtatggatttccttaattaaaactcagagtaaacagtatggtaccttctcaaaaaattgaacacagaattaccatatgacccagcaagttcacttctgggtataaacccaaaagaagagaaagcagggactcgaagagatatttgtacacccatggtgtcatagcagcattattcacaatggctaaaaggtgaaaacaacccaaatgtgtccatcaacaggtaaagaaacaaataaaatatagaatatatatatatatatatatatgaatattattcggcctaaaaaaggaattttgacatatactaaaatatggatgaaccttgaggactttatgcttagagaagtaagccagtcacaaaaagacaaatctgtattgacttcacttataaaagatacctaaagtagtcaaattcctagaaacggacaacttgagaggccaaggcggccagatcgcttgaatccaggagttcaagaccagcctgggcaacatggcaaagccccgtctcttaaaaaaatacaaaaacaaaaaatcagtcgggcatggtggcgggcgcctgtagtcccagctactcaggaggctgaggtgggagaatggcgtgaacccgggaggcagagcttgcagtgagccgagatcgcgccactgcactgcagcctgggcaagagaacgagactccatctcaaaaaaaaacaaacaaacaaaaaaaggagctgggtgtggtggcatgtgcctatagtccctgctactcgggaggctgaggtgggaggatcaattgagcatgggaggttgaagctgcagtgagccatgagtaccaccgcactccatgcattccagcctgagcaacagagtgagactccatctccaaaaaaaaaaaaagaagaaagagagagagagaaagacagcaagaaagaaagaaagaaaaaaagagacagacaggaaatattcatataatggtgactgtcaaggtctagggggccatgtagttattattcaataggtacagagtttcgattttgcaagatgaaaaatttctagagatggatggtgctgatgtttgcacagcagtgtacaaatacttaatgctggctgggcgcagtggctcacgcctgtaatcccagcactttgggaggccgaggcgggtggatcacctgaggtacggagttcgagaccagcctggccaacgtggtgaaaccccgtctctactaaaaatacaaaaattagccaggcgtggtggtgggcacctgtaatctcagctacccgggagactgaggcaggagaacccaggaggcggaggttgtggtgagccgagatcatgccattgtactccagcctgggcaacaagagcaaaactctgtctcaaaaaaaaaaacaaaaaacaaaaaacttaatgctactgaatttgtacacttaaaaagttattaaaatagtaaatgttatatatatttttccacaataaaaaatggttcaaggccgggtgcggtggctcacgcctgtaatcccagcactttgagaggccaaggtgggcggaccatttgaggtcaggagttcaagaccagcctggccaacatggggaaaccttgtctctactaaaaatacaaaaaaattagccaggtgtggtggcacatgcctgtagtcccagctacttgggaggctgaaggaggagaattgctgcaactggggaggcgaaggttgcatgagccgagatcgcaccattgcactccagcctaggtgacagagtgagactctgtatcaaaaaaaaaaaaggttcaaatggtaaatttcatgttatgtaaattattatcacaattttgtttaaatcctcaaagcaaatgggttatgagccttagtgtgaaatgaacgtcaaggtcaacaggaattatctaccaagggtttagagggatagactgccaacatgggacgctccaaacatctctatttggtttaaaatgtttctgtagcacttttgtggaacgcagtctcaaaaagatcaatagagatacaccgttcagaggaatgcagtctatcccaggtaaaaggcgaaaaaaaaatccaatttccccccagcgcaatcccatttaagattcttccctgctgaacacacatagcatccctactgtccaggccaacacgcagctcagccctctttctctatgtttgctacctctgtggctcacatcttcccagggtttcaggaaacgactatagagccccctcgcatggggcagaacatacaggtggttggaatgaggtgggacaaaaaaaaatgagacaacggccgagagtggtggctcatgcctataatcacagcactctgggaggctgaggtaggcggatcacctgaggtcaggaattcgagaccagcctggccaagatggcaaaatcccgtctctactaaaaatataaaaattagccgggggtgatggcacacacctgtaatcccagccactcggaaggctgagacaagagaatcacttgaacctgggaggcagagggtgcagtaagctgagattgcaccactgcactccagcctgggcgacagagcaaggctccatctcaaaacaaacaaacaaaaaaaaaactgaaacaaaatatttatcctactctgcttactttttcaggaaatggaaaaccagagtatcaaaaaccactcaacactaacattaaatcagattaacagcaatcctgatgtagagctggaagggcccccaaaatcgagtccaacccaatcacccaacctccttggaccaaatgccacctgggaagtgctcaaaaccccacaggaatgagcaagtctcccgtcaatgctcaacctcttctgttttgactgttgaactgggggaaaaaaaaaaaacaagcaccaggaagctaaaaggctctgccaaggtcaagattttgcagttaggaacagatctccagttcagggcttttttttttttttttttttttttttttaaagaaaagttcctcagtattcttttgaggacatcaagttgacattcaaattctatgtgtagaaagggaatgactttctactcttagacagcgtgggtgctccacatggctcctggcagccagctccacaccaccagtacctgatgggcaaccttgggaacttcagacatcaatgtcacaccacctgcttccatcacagacataccgtgggcggtgatatccctgtgtacatctggggcttgctcaagccttcctcctctcccacagcctctgccaccatgaggtcaccacttaggaatctgcatgtatatttgaagatgatctggacaaggatacatcattcactctacacacagctgactattcattcgttcaacaaaaaattatcgaacacctatcttgtactaggctctattctgggcatgaggactataacagcaaattcagctcagggaggacagctctgacacctgcttggcatagtatacaaggagctcccacagaaccctcagaaacaccaggagattcccagttttctggttctaaggctagttgctgtctactactgccactgttgtgctatattactcagggtaacaaaatgctcttccatttttcctaccatggattgtcaaatagcacagtgaagtagttagtgttttaattactttgtagaggagataagctcagaagggttaaaaaccttgctcaaggtctaaaaccttgtaaggtctgatcattactacctagacccaccatcccactccagcaatgaccgcctgtgctaactgtattatcgcacaaaggtggtaatgcttggagtggacattcatctgctcttttacctgcgtgacatcgctgctgcttgtcttcctttagacaactgctctgcctccctctaaaaacccacatagtgttggaatgggctgccaatcacagtagcccatcaccttaccctggggttccactgctgggcacagtgccaaagctgagccagtcttagtcctctagccctggccacagtgaccgggcctcatgtggacacataacactggccagaccaatcagaatcctaccatgaggtttgtctgcctgggctgattggatagagctccctttcttccctggtcaggggctgtgaacctgaacagaggggcctgaggtcatgttcagacccgtgggaaaagcccacagcatcgatccaagaggtcaaacgtcccaaaggccagtttccaccatccatccaaaggttgtggaatattctaagtcaatacatttctctttttctacctaagatgatctgagctaagtttctgtcattttgcaataaaggtaccctgaaatgatacacagataaaatctgcccttcacttaaaaacctcttctcaaccattaatttcaaatgactctgccacttcctcttaaataacacaattaaaaccacctaaattagccatgcagggtggcatgcgcctgtaatcttagctactaaggaggctgaggcaggaggatggcttgagcccaggagtttgaggctgcagtgagctatgattgcaccactgcactccactgtctctaaaaaataagtaaataaacaaacaaaagaaccaaaagaaaaaccacaacagctggagcttttacttatgtcccttgccctgctgaccctccagggcagaggggatgaagaaaaggtggctggtacccgaaggaagtggagagagaacaaaaggccaggcaacctctgctgaataataaataacccacacctgacaatcagcacccatctgcattagtcccactagaaaagcctggcagggttattcccttggggaaaaaaaacaaacttccagctctaatttctgacagtgtacaatgcctaaattcaaacctcccactcagcctagccattaaggtcctccagattacctctgcatccccaattcccttccacccagagccaaggccaaacccctgctctgctcaggctgggtaaacacatggctcctctctatggctcagcctgtgcggtccagcctacgcagcccacacgtcctccctccatggctccatgcattcagagcttcacttcaacaccaagtcccagcacattcgtgaagctctcctcggcttctccagcggacgctgctggctccattctcttaagtttgatgaagcaagccagccagttcactaggaaagtaaagaggaggcacaggaggtgtggggagtgggaacgagaaggaaacatcaggcaatgagcacgcgagaggtccagccaagttctgccatttctgcctcccaatagaggcctggtgggaatgacttgaggagtcccacatttagatggtaatgagagccactaaaggtgaatgagagtatctggggaaagtgtgtagcataccgagttttttataaaagaaaaagcctgtttgtgcatctctatcagttgacctgtctcataatgtcactctcatgagcgtcccattcccccaacaaggcggcaagctacggactagaattacatcctgtgcaccccggcccctgtctacaccccagccccacctgggccaggcacttcaatgctcccggtgacagaggcaggcagtgcagcaccattagccccatcttacagatgaagatactgaggctcaccccaggggcagggagttgagaatcctcaagggaaaaaactcaggtgtttccccaaatcaaagggaaaaaacaaaggactgcatggggctccaagtgaccaagctagacttggttactgggaaaaacaagagacccaactgagccactcagaagtaaacaattctgtcttctccctaccaccagctggggcaaaggtgttcgcttgttccccgcagatccatgtatcaaatccgggacaaaagaaagctacataatttcagagtcccacagtgactggaaatgtcctgaaattgtagtgggaaggcctaaccagggaacaggaaaaaccaccccagacaaggaatcaggggcactgggcttggccttgactcaggcacctttctgccctgcgacttcttccttacagacagggccctggaaccaaagatcataagacaccactcatctccctggggctgccacagagttaatgagatatgaagataggacacaaaatcctgaatgacaatgccctatcaataccggaataagagccacacctccaacaaaaaaaccacaacacagtgtgtctcctagtcactccacacccccaggcctgagcgtggtaggtttaaatgtctggggatctaactcagcaagagttgccccgatgggttgggtttgctcacctgcccaccaacacccaggcacatgtcctccccagtttccttccagttccaggccccacgtggtaggctgctgccgatgcagactccctcagcacccaagtgccagtgggggatgggcattctggatcaggagcccacacagggtgtggaatccatcaaggaagctcctaggtgggtgatggcatcatctccaacagagaatcggtgccaaagcagccaccccttgacgctaaggatcccagggagccagctggttcctctctcaggctccgcaatggcctcgaactgaggccaattcaaacccagagctgctgcccagagcacagagtggaaatcactcaggagtggaaggaggcaggaccaagtgctgggttttcctgactatggctcctcaaggaagaagacttccattccttcagccagagccgctctcttatgcactgagctttgaccataaggaatacttcctggctaaaagaaaaaaaagcaaaaaagtggagacctacaacacagcaatttacccttcacaaaggagcctcccctgcgccggggcagtggctcacgcctgtaatcccaacacttttgggaggctgaggcaagcagatcgcttgagctcaggagttcgagaccatcctagacaacatggagaaatgccatctctacacaatatacaaaaattagctggtgtggtggcatgtgcctgtggtcccagctacttgcggggctgaggcaggaggatggcttgagaccaggaggcggaggctgcagtgagccgagattgtgccactgcactccagcctgggtgacacagtgagaccctgtctcaaaaaaacaaaagcccccaacacgccactgtttgctgacacaccatgtcaccctcttccccaggggcttcaggtggcatcttgccataccaaatgctgtcctaacttttttctttctttttttttgagaaggagtcttgctctgtcacctaggctggaatccaagggcaccatgtcaactcactgtaacctccacttcccagattcaagtgattctcctgcctcagcctcccaagtagctgggactacaggcgcccacaaccacgcccagttaatttttgtatttttattagagacggggtttcaccatgttggccaggctggtctcgaactcctggccttaagagatctgcccgcctcggcctcccaaagtgctgggattacaggcatgagccaccacacccaaccagcgtttttctaatgcattaagtaaaatgaacttaacttctccttgaaaagtatttttctaaggatttcatgaccctctccaaagtcacataactctgcattgtggtaaaactggggtctgaaatcaatgccctaggggataaaatccaaaccctaatctctgccttccttagaggtcaagactagctcctagaacttcagccccatgaggccccacattctccaccagacacggaaagggtgagacctaattaatggcaattgatccatcaatcaattttcagagattaaggcgagcgttgattcacatgcttcccaacgcagacttccagtctgtactaagttctgtgctttacgaaagactttcagaaacagatcttaacttcttcattcagagatagattagatagatacatagatacaattaaaaagaaaaaaattactttgttgagatcccctctgtccttatcctcatggccacatctgacagtcccttcctagcatctcccaaagcactatcccaggaaaggactaggtttgcccagtaactctgacatgaccacaactggggggaaagaatgcaggtttgagggacagagatgcaagtcagaagctcaaagtggagacgggagggccaccaatgaaatgacctgctgtgtggccagcaatttagtctctctgtcagtttcctgcagctacaaaaattgaggttaagatggccaacgtaagagagctgttaccaggaatgccttataaaatcattcccttaataagtggggcttttaacagccaaataaatgggtcccatcagcctttgaccttcaggttgctaagggcagtttctcagccctctcggttcacttgtttttcttttatacatatatccttatttatttttactgtacctatcgattcactgttaaaacagggacaagacctagaaagatggcactttgtttcctggctctgaacaagttaaatcaaacaataggttataattcaaaattcctggtgcccaatactttctgagcattttaaccactccaagccagagttttctctctggcaaagaataacagaaagctcacatagtggcaacgacaactgaacgtgataaagcagagcgcctgccacaacagtagatgcccaataaatgctagttctcctcctccctcagtgccatgtcttcttcctccagctgccttgtctaaaaaggctggcttccacactccacggccaggccaggacaagcctaccacttgtcagaaactcccgccagtatccgttcctgcacccagacacacacttacaaatcagtcatccccaagaccaaagacacaggggttccaaaaggcaccctcaagggaaccagtcaccagccttcctcgttaagcagctctgtgctctcagggagagaacttagccccagcagccactactaggattttcccatggtgcaatgcaacttccccaacttttccgggcccagtttccaaagaaacccaggcaggcgttgtgcacaatcagccaccagtctgggagagactgggctctgagcagagaaaaaggagctgggacagccagaaaatgaaaaagcagttgtggccccggcacaggatggcagcgaccaaaacttaagagtaggggtcctggcccaagtcccattcttctggacggtacccttggttaaaggctagcacagggtgccaaagctagcggacggtgaggagcctcagaaaagggactgatggacatcctccgaggtaccccctacccgctactggacctggtggcccccggggaccctgtcgtcgaggcacctgagagtgaaggccttcagcggggggcattgttcacagcgaacggcgggactgggggaggcggcgggacttcgggatccgcgcaccgccgcctccccaactgggccagaggagcgagtccaccgaggccatcgccaggtggagcggcggccccggcgaggtaccctcggccagcaggagggagaagcggagggcgcgtcccagaggcgggggccaagggtctgccactcacccgcgccttcggcgggctgcggcggcccgacgacgccgttcaggtagagaatgggcagcaggtgaggctgcgtcttctccagcgccgcccgcaggtcctggaagtggtcccgctccttggccaagagcagcttgagcagcagctccgccttggcgcctcccgcctcctcgtccagctgccgccgctcgccgggactgagcgctcccgcggcctcgagcagcccgagcacggcttccacctccgtcatggcctgggccaggctctgctgacactgggcgagcagctcccggcgctggggctccatggtggcgggccgcgccgccccgccccgccggacgcctcccgggccccccgaggccggcgggcgggcaggcgagcacctcggcagcagccctagggcgccgggagccgtgaggcggcgggagccatgggccggggcctgggcgggctgggggcccggggcggcgggcggcgctcagcagcggccgcctcccgggctccggagcgcagccatgttggctgccgcggcggcgggactggaagaggaggaggaggagacggaggaggagaaggaggaggcggaggtggggacggcggccggggcgcgccccgaggccgggctccagccgggcatgctccccctccccctcagcctccgcgcgcgccgcccgccccgcgagaaaactcgccccgaaagccgggccgcgcgccgcccccagagcaagactacaactcccgggagaaagtcgcctgggccgtgtttcccaggctcccgacagctccggcccggctcggaggccgcctcggcccccgtgcaccccggcccggctcaccggggccccgcggccgccacccgctcccccgtggccacagccccgccgccgccggcccgtccctcctctctcccctccccaggccgtccctccgggaggcggcagcaggggaggaggggacgggcggaggggaggggtccccggcccgcccgctaggcggggacgcggcgccggctggttcccggtcccccgaggcccaggcgcagccgggggtgggggacacggagtcaggcctggcacgcggccagcccacaagctgctggagaccccctcatacaaatcttgcccccagtccagagggtcctaatctgagaactccaaaatacagcctggagacaaatggtggggagggtttcccctaaatttggacatctccagattaagacctccgccgaatccgtgaggctttccctctccaaggagctcctaagagaatttcccagtaaaatcgcctcaactgcggtaaataggctgttccccgcgccagcatttgagaagagctggtccccagagtgtaaaggagttaggatgttggcaggaggaaggatgtgtcgccggatgaggaaaagaaaggtgggtgtctgcggtgcagtccttggtctttctggcaagtgaggcgctctccccctaaatgtctcagagggagacaaatcagcggactaccttgcttcctttgatgacttggaaaggatctgcagtcccccttaaagcccaagaatgtcttctcttccacgacagccgtttgtggacacatactgcttacctccctgactgcaggacaaggtccttcaaagctggaactctgactgcgctcagtgatcccgcagtgctcctctgtagagtgggaacccaggtccatttcaaatatctacgttggaatgagtggatctcgctgggggtgagaggcactttgtctacccacactgccagtcccagccacatgcctcctcccttccctcaaaaagcagtgtcttcttagtctgcttcttcaaggggagaagtcgtttttatttatggaaacgaactcactatatggtagaaagaacaagagtatcagaatttgcactttggacttggactcccctctaagcagctgcacaaggtggaacaaaccaataatccttgctgatctgttttgtccttaggaaaaatggtggagggagaatattagatcaggggttcttagccttggcttcatgaataagctcaaggatgtcaatgaagcttttgacatgatctcaacttttttgtgaacatttatatatttttctggaatggggtccatagagttacaagttctttaagacctccagatggaccccaatatggcagaaatgaactatttaaagatacctgcctgctcccgtagtctgaccctctatggctaagcaaggttttagaggagtggaaggctggccattgcacagtatcagggttccagacaggctccctggctcttccctcccagtcctgctcctgagatatagttctttctggccgccacttcccttagggcaaccccagagcttaaatcatctgcaaggcagtcacctttcaggcacctttcatccggcacctgtgttcttagctggattaactagaaagctagttggaggaaggaaggtgaaagtggaggaaggggaaaagaggaaaagttggagacgaatctggcttatggttagaagcatattttttggccaggcaaagtggctcacgcctgtaatcccagcactttgggaggctgaggtaggcggattgcctgagctcaggagttggagaccagcctggccaacgtggtaaaaccccgtctctaacaaaaatacaaaaatttagccaggcatgatggtgcaagcctgtaatcccagctgttcaggaggctgaggcatgagaattgcttgaacccaggaggtggaggttgcagtgagctgaaattgcaccactgcactccaggctgggtgaccgagcaagactctgtctcaaaaaaaagaaaaaaaaacttattttttgagacagagtctcactctgtcgcccaggctggattgcagtggggcaaacacagttcactgcagcctcaatttcttgggctcaagcaactatcctgcctcagcctcccgaggagtagctgggatcataggtgcttgccaccacacctggctaattttttaaatattttgtagacacagggtcttgccacattgcccaggctggtcttgaactcctgggctcaagttatcctcccgcctcggtctcccaaagttctggaattacagatgttagttaccacccggaccaattttaggattcctttagccagtgaccttggtgtgaccttgtacttctgcagcattttataccttctgcggcacacccttgtagtgggtcgaattgtgttcccccaaaagatatgttctagtcctaattcccagtacctgtgaatgtgacttatttagaaatagggtctttgcagatgtaatctagttcaaatgaggtcatactggattagggcgggtcctcatccaataactgttgttcttattagaatagggaaatttggatgcagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtggagtcagtggttcttgttttaagccacccagtttgtggtcattggttatggcagtcctaagaaactcaaactcacctcagcacagtggggaggtgagaaggacaaagacgggggtccctattttacaaatcaccctatcacttcactcttctactgcctaaggacatctctgtagatttacccacctttcctactttcttctggtcttagaaaaagagagctccttgtctttaaggagagcccttccatgctctggatataatctgtgtatccctctcctcccctgcacacacgcactcacacacagtctgcttctgctttggtttgggctccttctcatttgtcaaaaacaggcttgagtctccccattctcaagggtcctccctttcctctcatgtttccttcggaaacaatcattgcttgacattgggacctccacatctcatagactgctcaccgcttggttggtgctttacaatcagcttcttttttttttaattcttgtgtttgctttttttaaatttattttatttgtttttctggagacagagtcgcactctgtcacccaggctggagtgcagtggcgtgattttggctcactgcaacctccacctcccgggttcaagcgattctcctgcctcagcctcccgagtagctaggactacaggtgcacaccaccaagcccggctaatttttgtatttttagtagagacgggggtttctccatgttggccaggctggtctcgaactcctgacctcaggtgatccacccgcctcggcctcccaaagtgctgggattacaggcatgagccaccaagcccagcctatttatttattttattcatttattggagacaagagtcttgctctgtcacccaggctggaatgcagtgggctcactgcaacctctgcctcctaggctcaagtgattctcctgcctcagcctcctgagtagctgggattacaggtgcgtatgaccacacctggctaatttttttttttttttttttttttgagacggaatttcactcttgttgcccaggctggagtgcaatggcatgatctcagctcaccgcaacctccaccttccagattcaagcgattctcctgcttcagcctcctgagtagctgggattacaggcatgtgccaccacacctggctaattttgtatttttagtagagacggggtttctccatgttggtcaggctggtctcgaactcccaacctcaggtgatctgccctcctcggcctcccaaagtgctgggattacaggtgtgagccaccacacctggccttaatttttgtatttttagtagagatgtggtttcaccatgttggccaagctggtcttgaacacctagcctcaagagatccacctcttgggcctcccaaagtgctggattataggcgtgagccactgtgccccgccctatttatttatttttagagatagattcttactctgtctcccaggctggagtgcagtggcaccatcatacctcactacagcctctaactcctcaagtgatcctcccacctcagcctcccaagtagctgagactgcagacaccatcatcacacctaggtatttttttttttatttttgtagagacagagtctcgttatgttgccgaggctaggttcaaactcctggcctcaagctatcctcctgccttggcctcccaacgtgctgggattacagacattagccaccatgccccacctataatcaggcttctgagcacaactccccatagaaaactgttgtctcccatcctgatgccacctccaggccttatccttcacacctcctctactgtcaactctgctgggcttcatccactggggacatcttgttctcccaccttcctctccctcccccctggctcctttctctctaaggttgactcttcaatcctcttctgtccccatgctccttccctcctgcagaggagctggacagaaatgagctcagtgcccagctctgacactcactggctatgtatcctggggctaggtactgtacttcccggagcctcaatttctgcatctctaaagtggcaataaatatcaccctttggtagggttattaggagaagtaaatgataggacttatacaaagccctccacaatgcctggtgtctggcaggcatataaactccctaatgttagagcaggcaactcctgtaggtcagaatgcctgactgaaatgctggcttggcaacttatgagctgagcgatgttgggtaaacctccatctgcctcgttttcctcctgtgtgaaatggggatgtcaataatagtatcaaagtagctagtgctgaatccgtggtaagtaccactgttcttttggcttccctctgcgaggaaagactccacagcatgtagcaacaggttttgaacagatgtttttagtttcatgaatgagtggttgtggactctagctgaaagatttccatttagcttgtcttcagacagtgaggcaggggcccccagtaccttgttatctgctgtatctccacagcactgtaccgggcatgtggtaggtgctcaatagatagtatttttaattaataggtgaacatatgaatgaatgaacaaactaaagagttttgcattgaggccctacttcaaaataatatcaactaaaaatgggaagatggggaaggaaagtacctcaaaaaggagaagtggctgggcgccgtggctcacacctataatcccagcactttggaaggccgaggcaggattgcttgagcccagaagtttgagaccagcctgagcaacatagtgagaccagagtctataaaaaataaaaaaggagaagcatcagaagcaaaatgagagaaggtcacaaattctccctggtgccacaggaaatgggtggcaggttgggaacttaatgcagggaccatgaactctgcccactgcagagtggccactgctggggcgctaagcaccaggagctccaccctgtcctgctttgtcctgctgataaacttggcctaccaggccccactgctcttcctagctgctcaggtgactgaggaggaggattacttgaacccaagttcgaggccaaacagggtaacatagtgagactctgcctctaaaatatgttctttgggtaataaaaaagaaaaaagatgcccctgctcagaaattcagacctaaactgatggcaccaaggcaaatatagccctgagggcacagtcccctcaagctttctgcaagcacagtgctgtctgggagcattaactctttgactctgagcccattcttcacacttcagcttagatgttaacctttaggaagccatacttgccttaccaatctccttgaaaagggtttggtgtctctgctacatgctctcattgcaactttttactccctttattaaggtttatcagtgtgtattttttgtttgtttttgtttttgtttgggtttttgtttttgttttttgttttttgttttttttgagatagagtctcgctcttgttccccaggctggagtgcaatggcgtgatctcagctcactgcaacctccgcctcctgggttcaagcaattctcctgcatcctgcctcagccttccaagtacctgggattacagatgcccgccaccacgctcggctaatttttgtatttttagtacagatggggtttcaccatgttggccaggctagtctcaaactcctgccctcaggtgatccaccccactcagcctcccaaagtgctaagattacaggggtgagccacggtgcccggcttatcagcataatcccagctactcgggaggctgaggcaggagaatcgcttgaacctgagaggcagaggttgcagtgaggagagatcgtgccactgcactccagcccgggtaacagagtaagactctgccttaaaaaaaaaaattgcgtttcttttctatattcctgtgataaacagaatagctccccttccaagctcccaaaagacaaccatgctccagtccctggaacctgtgaagatgttttgttatatggctacagggacttcacaaatgtgattaaagttctgtactttaaaatacggagagtaggccgggcacggtggctcacacctgtaatcccagctacttgggaggctgaggcaggagaattgcttgaacccgggaagcagaggttgcagtgagctgagatcgcaccactgcactccagcctgggtgacagagtgagactctgtctccaaaaaaataaaaataaaaataaaataaaaaagggcaagtaggctgggcacggtggctcacacctgtaattccagcattttgggaggccgaggtgggtggatcacccgaggtcaggaatttgagaccagcctgaccaacatggagaaacccccgtctccactaaaaatacaaaattatccgagtatggtggtgcatgcatgtaatcccagctacttgggaggctgaggcaggagaattgcttgaacctgggaggcagaggttgcagtgagccaagatcacgccattgttctccatcctgggcaataagagtgaaactccatctcaaaaaaaaaaaaaaaaagaaaaggaaaaaataaatacataaagtaaaatagggagagtatccttgagtatccaggcaggcacaatctaatctgataatgtgagctcttaaaagcagagaatttcctccacctggaggcagtagaaagggaagtcagagagattccaagcatgagaaggatttgactggtcactattggctctgagatggaggggcccacatgcaaggagctaagagtggtccccagctgacagccagcaaggagccaggaacctcactcttacaatcacaaggaactggattctggcaacaactgaatgaccttggaagtggattcttcccagagccctggagaagatcccagcggctaccaccttgatatcagccttataaaagcctgagcagagaaacctgccaagctgacctggacctgtcatctacagagctgagaaatactaaatgggtgctgttctttttttttgtttttttgtttttttttttttttgagacagagtcttgctctgtcgcctaggctggagtgcagtggcacgatcttggctcactgcaagctccgcctccctggctcatgccattctcctgcctcagccttcccaatagctgggactacaggcgcccgccaccacacctggctaactttttgtatttttagtagagatagggcttcactatgttagccacatggtctcaatctcctgacctcgtgatccgcccgcctcggcgtcccaaagtgctgggattacaggcaggagccaccgtgcccagccttaaatgggtgctgttctaaggctctaagttggtgggtttttgttatggcattaggagaccaacaatccccaatgagctatgagctctgtgggagcagaagagacatcgacttgttcattattgtaccctctgtacctacctgcctagatattgcctaggacactgccctaggcactcaaaaacaccctgtgataggaagaatggaaacctacccttccaccaggctttgcttttggagaagttatctgtggcagaatccattattccactagtgattggagggaacattttcaaataaagatactggatacagggctttctctgcaggctaagtgagcagaggccccactctggccttggattttatgttttaatggataagctacagctgctccctggagaaacagatcctggcggtctgctctgagtgtgcagctcctttggaagtacacaaggctgccaacaagagcatgtgtacatgtgtctgtgcatgttagcgcatgcgtgtgcacacataagtgtccatgcactcacattgacaagagtgtgagggcactgtgagcaggagaggaaccatttccaggtgcctgtgggtgtctgtgagtgcaaactgcacacgtgtgagtctgaacacgtggatgtgtgtgagcagaggagcagttgtttctaggacaggtttcctgtcccacatgggaaattgcacgtggcccaacatccgagatgcaacatttaaaaggatttccttccagagtttcttaaaagaatgaactcccccaggatgctgaaaatggaattctatttaggaaaatgccatattgcacacacctttttaggaatgctatatctatgaaatgaattatgcctgtttgttaaaaattaccttcaacttggctcttggtagcttctcaaatcatgaagacatttttcttccagactgcttttgttgttagttcaggaatggcccagaggcaaatatcccaggattttaaaacagagaatctggctgggcatggtggctcatgcctgtaatcccagcactttgggaggccaaggcaggtggatcacgaggtcaggagatcgagaccatcccagccaacatagtgaaattccatctctactaaaaatacgaaagttagctgggcgtggtggtgcatgcctgtaatcacagctactcgggaggcagaggcaggagaatcccttgaaccaggaagttggaggttgcagtgagccgagatcacgccacagcactctagcctggcaacagagcgagactccgtctcaaaacaaaacaaaaaaaaaaaaaaaaaaaaaggaatctgagagaggcccagacctagtcatgaatcttgcccagataccaaggacaaggcaagattctgagatgagagattcaaagcctttgagaacctcagattaatccttagaaaggactaatgaattattaacgatgaaataaataaaaatactatttattaagtgcttactgtgtgccaagttcttggctaagccctaaggctacctaacctcactttgcaaatgaagagctaagaagttgcttgcccaaaaccacacgtcaattattgtcaaaactggagtgggaattcaagtttatcacctcaattctttgcagcaaccctgcgaggcctatgccctagctcctcagctgtcatcccttcttcctgttaaaacattcctacaatgtgtctcttttacaggaaccagtttgaagtcacagctggaaaggatctgacactgtgataacatcatcctggttacttctcccaaaggattgacactttaacctgaggcctgaacagccttctcggtgaaccccagtgagccaagcagattatctcctggtcagcctagttttccaatgcacaatgcctcatgcattgtgagagtcacctcttcagaacaacataccactccctcaattcctcaagaatattcactagctccccattgcctgcagggcatccagagcttggctgtcttctaactcatctcctattgcttggcccaatgctccagctactgaccctctctgtcctccaccaatacaatgtgccccttctcccccagggcccacttctgcctcctctttgcctgtccaaactcctctcattctctagggccaggaaactcctactgaccttgcctttccctcccagaagtcctgatgtgctatgctttgaattgcctcttcctcttttgccattatctattgccttgcatcatttgtaagtttggcctgggatgtctttgcctcccagacatgctagggacagggaccctgtgctgttatttttctcatatccctcacagtgcctatgacagaggaaggcctggagtagatgcttcagaaatacctgagaattgaaaaaaccaaggcaagggaaagtgtgccaaggggagctctcatctttctgttctttaggtctcagtttaaaggttatttttgcatatccccaccttgttcccacctaccccacaaatgaccaaaattggattctatgagcagtcattttccttcctggcattcatcacattttatacttttttttttttttttttttgagacagagtttcgctcttgttgcccaggctggagtgcaatggcatgatcttggctcactgcaacctccacctcctgggtcaggtgattctcctgcctcagcctcctgagtagctgggattacaggtgcactcagctaatttttttttttttttttttttttagtagagatgaggtttcaccatgttggccaggctggtctcaaactcctgacctcaggtgatctgcccacctcagcctcccgaagtgctgggattacaggcgtgagccaccgcgcctggccatattttatactacttttatgtgactctgtgtttgctgactgctttctactagactctaagctccacagaacacctgttcggttcacctctatatccccagtatctagcttgatgcacaataggggctcaaaactatttgttgaggcagggcatggtggctcatgcctgtaatcgcaacactttggggggccaaggaaggatgatcacttgatcccaggagtttgagaccagcctgggcaacatagggagaccctgtctctacaaaaagtaaaatgaaattttgccgggcatggtcccagctacttgggaggctgagatcggagaatcacttgagcccaggaggtcaaggctgcagtgagctatgattgtgccactgtactccagcctgggtgacagagcaagaccctgtctcaaaaaataaaaacaaacaaaaacctcacctacttgttgaaagaatgaattaggaagggagaggagattacttgttttgggtatttgtaattgtcctcaggaactctccataagaacacttccatttttcagtctagaccagggactcaggtctgagaggaccagtatctctagggtaaatataaccccagccacaaagcaaattgaagcagtccccctttcctgagcactaagtatgttccaggcactgtactgagtgctttgcccacaggccccagttactcttcaccacacccatagaaagtaagcatcatgagcagctccatcatacagatgagggatctgaagctgtgcatttctacccctcccagcctttctagttgtgtgtggttcccatcttgcaggggaagaaaatctcaggagtggctgagaagtcccagaagagcttttgcacatgcatcaaaactgcccctatcaggcccggtgcagtggctcacgcctgtaatcccagcactttggaaggtgggcggatctcctgaggtcagaagttccagaccagcctgaccaacatggtgaaaccgtctctactaaaaatacaaaattagccgggtgtggtggcgcatgcctgtaatcccagctactcgggaggctgagacaggagaatcacttgaacccgggaggcagaggttgcagtgagctgagatcttgccattgcactccagcctgggcaacaagagtgaaactccgtctcaaaacaaaacaaaacaaacaaacaaacaaaaaactgcccctgccttccaaggaaggaaagccagttcctggggaataagccagaaatcaacagtggccctgcctgccctgccggtgggtgcagacatgtggaaaccagatggaaagggggcccatgggcccaatcagactcttggaggtgatgagaatgccccgaagccagaaacagctggctagaagagacgggtgtagcttgggaattctggtgtgggtaaaacagaaacccccctgggcaccaacccttccacggcattcagagtccctttcacccacacctctattgttcctccttttctccatgtagccattgcggtaccaccattccacactgaggctcagagaagcaagtcagcctgctcaggatcatgaagctggaaagtgatgaaatcaaccaccttaaaacaactccccacaggtgggggcaaggctgacccctttaagcaaacctcctttgtgtagaagcagcagctggagaaacagctgccagatggaacactggccttcactttccagctgggagccatccagctctatgcagctttactggaggagttccttggaggaaaagctcctccatgggaggcctcgtttaagcaaacacggtcacatgaggtgttgcagcagcagcaggccaccgcagagatagctgcttgggtgcagggccatgaagacctctgagactgaacatacaaatgggcaatggccagactatatttaaaaatagaactccaacccacaacctgtagcaaccaattcagaaagctgacccaccattggcaaccaagtccaggaagccaaacagtctctgcggcaatcagcccaaaatggccagaacttgaccaacaactgacaaaatgcccagaacttgaccaacaacatcctaatttttgccccagtgtgcaacttaggaccaattggaggaagccagatgtgctcccctaaccagtcacataggatgtcccgcttctaataggcccacctacagcttcctgatgtcaacagcctccaatcagggcacacccaaagcctccccttttcccaccacaaagcttctccacttccctgcccacctttgaggcctctgacaaaggcaagtgatggtagctgactcccttgctatagcaagctctgaatcaataggctttgctcattttcatgtgggcttcgtttatttctatacctcctagttgcttaattgttttatgacttgattttcttatctgtgaaatgggaccataattttggacacaaatcttttgggaggaaaatgccttgaattgcaggggagtccccgatacatccccactccctgggtcacctctgatctcagttcagctgccacataacccacctccctcttgttctgagcataactgggcacatctacatgcccagttccttcattttttcaggggaggaccctgaatccaagcaggaaaatgctgacttacccgaggtcctctcctccagaggtttttaatgacccagtcttgctctctggtttcctccctcctgactgcccaggaaagcaagcacatgagccttttcagcaactctgcagggtggggcttcaatctatggtgaaactgaggaggctaaaggaggaaaaatgcacacaggagtgagttaccaggccacagaagcttcccaaccaggaaaggccagttgtggcctgcatacggagctctgccctccatagggaggtttttcttccttggtttcagggagcgtgagccccacccaggttttctgaacctcttttattcagggaggctggctggctctaggagagtcccttttcccttcctggggttgtttccacccaagcctggctccaccttctcactgcaagacaaaagcaaaggggatcacaaatcacagtactcaccattctagtagtagtgtgccataatacacgatattaactacttttcatatatagaccctttcagtcctcagaacagccctctgatacatatatgtaccattattagcatgtccatttaacaaatggggaaactgagtcatggagccatcagatgatgtgcccaaagtcacacaaatagcaagtcgaagaacagggattaaaacccacatccagagatgagctctcaaacaccttatggtaccacttcagaatgttttcaaatgaacacaagtatgaataggacatggtcaagcgtagttgctcatgtttataatcccagcactttgggaggctaaggcaggaggatcacttgaagccaggagttggagacaaggctgggcaacatagtgagaccccatctctacaataaaataaaataaaataaaattagctaggcatggcggcacacacctgtaatcctacggagaggctgaggcgcaaggatcacttgagcccaggagttcgaggctgcagtgtgctgtgattgcgccactgcactccagcctaggtgacacagccaggtcctctctctaaacaatatcaaaaaaatcaaatactaatagaacagtattttgcgtgttccaaagttgggagcaggattcatttatatttcagagaaatgttgggttctttctcatttattcttagttcatttggcttccacaaacattcactgacccctaagagagataccgagagatatgaataaggccttctccgcctcagacctagcactttcccggggttgaggaggccactctgctaacccccaacccactcacttcagggcttcccagatggtgaaatatagtttacactcagaaaagagcaggacacacgtatcaccagacaacacacgtaacactggaagagctagttttacatccagattcctgggcttcaacctaggaaaagagcctgagaaactttttttttttttttttttttgagacaaggtctcgctctgtcactcaggctggagtgcagtggtgcagtaatagctcactgcagcctcaaatgcctgggctcaaggaatcctcccactttaccctcctgagtagctaggactacaggcacgcatcaccacatggggctaatttttaaaaaatgtttgtagaggcgggatcttgctttgttttccaggctggtctcaaacctgtgggctcaagtgatcctcttgcctcggcctcccaaaatgctgggattacaggtgtgagccactacaccaggccaaacctaattttttttttttttttttgagacagagttttgctcttgtcacccaggctggagtgcaatggcgagatctcggctcactgcagcctccgccccaccccaccctaccccaggttcaagcaattctcctgcctcagcctcctgagtagctgagattacaggcggctgtcaccacacccagctaatttttgtatttttaaaatttatttttagttttttgagatggagtcttgctatgttgcccaggctggagtacagtggtgcaaactcggctcactgcaacctctgtctcccaggtttaagcaattctactgccttggcctcccgagtagctgggattacaggtgcatgccaccacactggctaatttttatatttttaatagagatggggttttgccatgttggccaggctggtctggaactcctgacctcgtgatctgcttgcctcggcctcccaaagtgctgggattacaggcatgagccactgcgcccggccataatttttgtgtttttagtagagacagggtttcaccatgttggccaggctggtcttgaactcctgatgtcaggtgatccacccaccttggcctcccaaggtgctgggattataggcgtcagccaccgctcccggcaaaacctgaatttttaactagcatgctgggtgaattttatcaggacagtgaaccaggactctctgaaatcccttccccgggatagtcaacgaggctttcaatttaaacttgcatttgaagcttgcagagactcacactgacttacccaggccctaacacacagcagctgtctccatggttgcgccaggtagtgaaggatacagggcagcaggaaacgagtcccggttctcaggtggatcccgtgcttccacctctgttagagcccaggccctgagggcatagggccaaattgccacagagctccagagaaatctgtctctcccgtcccccaccctaagactgagctgctggaggaaagaggccaggtttgtttccttttattggttaactctcttcagtcgcccctttctcctgcagacaccttggggacttttagtaattgtcagctgaatgaataaattaatgacagagggagacagacgtgttaacagctaacagtaattcaagcagaatggagtaagtgctaaatagtggtggaatgagtcatgaatgctgacagggaaggaagagggaaaaaggcattcattctctccccctccactgtcaaaacagtgccttcactcttcctccctccatctctcttacaggcaccagagagcagaaaatgtatgtgtatagtttcaagaacagttccaaagcaaacacccatatagtcacccccatgtgctggcccccaggataagaaatagaaccttgccagaacctcagaagcctttcctggccccctccatgacatcatcattccccgcctcttgccctcatctaacttctaatctgattctgaggggaatcattttcttacttttcttttttttttctccttctttttttttttttttttgagacagagtctttcgctcggtcacccaggctggagtgcaatgccatgatcttggctcaccgcaacctctgcctcccgggttcaagggattctcctgcctcaacttcccaagtagctgggattacaggcatgcgccaccacacttggctaattttgtatgtttagtagagatggggtttcaccatgttggccaggctggtcttgaactccctgcctcaagtgatccacccaccttggcctcccaaagtgctgggattacaggcgcgagccaccgtgcctggctcattttcttacttttcttaatttttttttttttttttttttgagacagagtctcgctctgttgcccaggctggagtgcagtggcgcaatctcggctcactgcaacctctacctcctgggttcaaacgatcctcctgcctcagcctcccaagtatctgggattataggcacctgccaccacgcccagctaatttttgtattttttgtagagatggactttcaccatgttggccagactgcctctggtctcgaactcctgacctcaagtgatctgcctgccttggcctcccaaagtgttgggattacaggcattaccactgcctctggccattttcttacttttctttattgtttgactgtgaatgtctatgtcacaagacaagacgttgccttgttttgaatttatgaccacacgttttcttctgtggcttgctttccttgtgcaatattttttggacttttgcctgtgtcgatgcttgtggtggtaggtatacattctcactgctgcatggccgattctattgtgtaaacataccacaacttacttagccattctcctgtggatggtcatttggattgtgtccagtctttggcaattactagcaatgctgctgtatgtgactcctaatgcacacatctatttaatatatttaagaggaagtgctgggtcatggggtatgtgattttcaactttcccagctagtgcctaactgttttctgaaatgcatctgcttctagactgtctcatttgcagttcaacttactcagtagcactagggtagtctctcctaacaggtaataccaattgaactctcttagtttcatcagggtaagcgtttggggaaaggggaggataaaaatggttaggtgtggccgagtgtggtagctcatgcctgtaatcccagcactttgggaggccaaggtgggcggatcacaaggtcaggagatggagaccatcctggctaacatgatgaaaccctgtctctactaaaactacagaaaaataagctgagtgtggtggtgtgtgcctgtagtctcagctacttgggaggctgaggcaggagaatggcgtgaacccaggaggcggagcttacagtgagctgagatcacgccactgcactccagcctgggtgacacagtgagactccatatcaaaaaaaaaaaaagaaaaggtcaggtatggtggctcacacactagcactttgggagggaggctaaggaaggaggatcacttgagtccaggaattagaggctgtagtgagctattatcatacccctgtatgccagcctgggcaacagactgagtccctatctcaataaaaaaaaaaagaggagaagaaaaatggtgtatagagacccccgatgggagtaagcccaaggttcattggctactgtgacagtcagttaaattatttttttctggctgggtgcagtggctcatgcctgtaatcctgcactttaggaggctgaggtgggcagatcaattaaggtcaggagtttgagacaagcctgaccaacattgcaaaatcctgtctctacaaaaatacaaaaattagccaggcgtggtggcgggcgcctgtaatcccagctactagggagactaaggcaggagaatcacttgaacctaggaggcaaagattgcagtaagccaaggtcatgccactgcacttcagcctgggcgacagagcaagactctgtctcaaaaaaacaaaaacaaacacaaaaaaacccaaaataaaaaattatttttttctgtgagtaacagaaatccccaaataacagcagattaaacaaaacagaaatacatttctctcccacataaatgaaagtctgaagtcagctatccagactgatacagtgctccacgaggtaggttcctttgctcttgttccactgtctctgcaaatggcttgagctgcttgagctccagccatcacgtctatatcctagccaacaagaaggaggaaagacaaaaagaaatttttgtctctttcctttgaatacactttcagaaagtcacacaggcactgcatatattccagtggccagagcttaatctcacagaaagaaagatctgcaagtgatactgggaaatgtagtccttgttcttggtggctgtgtgcccagctaaaatccgggagtttcatgattaaggaaggagggagaatggattttgcaggacaatgaacaatctctgctatggatatccttgctcaggaaagcacttctgggtaggtctgcctaatgccctcaccacacacacttacagatacatatctcagaagtcgaaatggagagtaaagtaggtatttagcaatgccatgtctttatttattttattttatgttattttattttttgagacagttttgctcttgttgcccaggctggagtgtaatggcgcgttctccgctcattgcaacctctgcttcccagttcaagcaattctcctgcttcagcctcccaagtagctggaattacaggcatgtgtcaccatgccccgataattttgtatttttggtagagacagggtttcaccaggttggccaggctggtctcaaactcctgacctcaggtgatccgaccacctcagcctcccaaagtgccaggattacaggcatgagccaccttgcctgtcaatgccatgtctttaaatattacaagatatactctctgttcatctaggaaactgtggtgcccaaatggtgagtataattagttattttaggcaaatactctgctggatcatatggcaatttttttttttttgagatggagtcttactctgtcgcccagggtggagtgaagtggtgccatctcggttcactgcaacctcctccttctgggttcaagcaattctcctgcatcagcctcctgaatagctgggactacaggcacttgccactttacttggctaatttttgtattttcaccatgttggccaggctggtcttgaactcctgacctcaggtgatccaccagcctcggcctcccaaagtgctgggattacaggtgtgagccactgtgcccggcctggatcatatggtaattctatgttttatttatttacgagacaaggtctcactctgtcatccaggctggagtgcagtcatgtgatcatagttcactgcaaccttgaactcctgggctcaaggtatccttctacgtctgcctcccaaagcgctgagattacaggcatgagccaccacattcagcctatgttgaatttttttttttttttttttgagatagggtctcgctctgttatccaggctggagtgcagtggtgtgatcacagctcactgcagcctccacctggctcaagtgatcctcctgcctcagtttcccaagtagctggcaccacaggtgcacaccaccatgcccagctaattaaaaattttttttgcagagatggggacctctctgtgttgcccaagctggtcttgaactccttacctcaagtgatcctcttgctttggcctcccacagtgctgagactataggtgtcagccaccatgcctggtctatgcttaattttctgagggactgccacactcttttccatagcagatgcatgattgtacatttccacccagagtgcacaaaaatttcagtttctcggcctggcacagtggctcacgcctgtaatcccagcactttgggaggccgaggtgggcagatcatgaggtcaggagatcgagaccatcctggctaacacagtgaaaccccgtctctactaaaaatacaaaaaaattagctgggcgtggtggcgggcgcctgtagtcccagctactcgggaggctgaggcaggagaatggcatgaacctgggaggcggagcttgcagggagccgagatcgtgccactgcactccagcctgggtgacaaagcgagactctgtctcaaaaaaaaaaaaaaaaaaaaaaaaaatttcagtttctccatatccttgctaaggctggttattttctggtttttatttatgtttaaaatatgtatttatttacttatagagacagagtcttgctctgttgcccaggctggagtgcagtacagtggcatgatcatagcttactgcaggattgaactcctgggctcaaggatcttactatctcagcctccccagtagctgggactataggcatgtgtgaccatgcctggctaattttttaattttatgtagagacaggttctggctatgttgtccaggctggtctccaactcctggcctcaaatgacccacccggtttggtctcccacagtgctgagattacagatgtgagccactgtgcccagtctatttttaaatatattcttaaatttttcattgtaaccatctttttttttttttttttttttttgagacagggcctcattttgtcccgcaggctggaatgcagtggcacaatcttggctcactacagcctctacctcccgattcaagcaaccctcctgcctcagcaccccaaagtagctgggactacaggtgcatggcaccacgcctgcctaattttaaatgtcttttttgtagaggcggggtttagctgtgtcgcccaggctggtcttgaactcctgagctcaagcgatcctcccgccttggcttcccaaagtgctgggattacaggcatgagccaccgcgcccagccagatagtagccatcttaatggagtgagatggcttacttttaaacattatttctaaactgaacccagaccctggcatattagaggtggttacacagtgaacgcatttgacgaacagtcaaggtaattttgttttccagggtttgctccatgaataaacaatctctgagaggctagtatcttgtccaaggtcaagagcctgaatttgaattgtctgactgaaaggcagcatgttctctactagtcacctctctacctggttccaccctatgcaaggcaaacaaacgcagaagaaagaaacccattgccgtgcaaaatccagtgattccaaacccaaccagcccaccagggatgttctgggagtccgagctggggacaggagcacagccagccctagccagccctccccccaccacactcagtgcctggcggggcagagcgagtcacatttcagcctcactcacaggccagcttgaaattcggcccagccgccactgcctcctgagaactcctccggatgcctgcaggcttatgcggggctgagtcacttcctcaccttaattctcccctaataccttccctttctctgctgctttactcctggcaccactgtctgggtgtggaatgtctggggaagctgtgcaggtgggttggctgagctgtctgcccagataccacaaacatggctggggagagaggatgcaggggtaaaagtaaagccagatttgtctgctggctcttaagcgcatcctaatcccctcagtcagtttgatcttcgcaaacatgagcacaggtcaatatctctaagcttgggtcctgaggggctggtggaggatggagcagaggatggatgaagaggaacaggaagtgaggggagagtgatggctgctttggcttttagaaacttccatcccacattactttccctagggaagctcccacctcccatccctgggagaacagactgcatcctggaaggtcaagttccaggtcatgttaaatatgatggtttcctggatgagtctaaggacatatcattaatatcttcagcctatttccagaagtcctgctgttcctcttacctacatgtatgctgttcttccctgtgtacaacttaactttccttttcaggtttcggatgctttgtctgtacattgctttgtgtgtttgcctgcctcagcttgtactttcggagatagaaattgggtcaaagttttaatttttatttaagttattcatttatatagtttaaaaagtcaagggatggtgcaagatttatgaaaaagagccctctcccttccccttagcagagataatcatcttcaccttttttcttttttttttttttttgagacagagtgtcgctccattgcccaggctggagtgcagcgacgtgatctcggctcactgcgacctccacctcccggattcaagagattctcctcctgcctcagcctcccgagtagctgggactacaggcgtatgccaccatacctggctaatttttgtatttttagtagagatggggtttctccatgttggccaggctggtcttgaactcctgacctcaagtgatctgcccgcctcggcctcccaaagtgctgggattacaggtgtgagccagcattcctggccatcttcaatttttatagctcattcttttggcatttgtctccatttccctcaataatattattttattactacgtcatgatttttcagttttaggcactatttattgtcttccatacttgaacaacccatgcacccttcctggcctccatctttccactacagtcatacaataatttggttagagcaatagccagtttttacattaataccactatgtaaagactattaccatgtgatggactatgcacaattttttattttccctggagctaataattatctccgcccccaccccaattcatttacttagtttcctatgtgtttaatgccaagctctttcagttgttataatcttcccttaatactttcagatgatattctaccaattttattttcttgaagaaatctctcttagacatggctgggcacggtggctcatgcctgtaatcccagcactttgggaggacaacatgggtggatcgcctgaggtcaggagtttgagaccagcctggccagcatggtaaaaccccatctctactaaaaacacaaaaaattatctgggcgtggtggcaggtgcctgtaatcccagctactcgggaggctgaggcaggagaagtgcttgaatcggggaggcagagtttgcagtgagccgagatcgcaccattacactccagcatgggtgacaagagcaaaactgcatctcaaaaaaaagaaaagaagaaatctctcctagacatttctgaccttatctggtctaggctggttgtcctataggactgttgcattgtcgtcatcttgcaatctctttttaccaacatcctgggggattctctttatctatcacatgtcagattcctgtttccccttgtctttttcttggtttactaccttatcatccaggagcctcctgagtatataaacatttttttctgaaccttaaatgactcaaatgtctttttctatcttcaaccttgattgatagtttggttctgtagtcccagctactcgggaggctgaggcaggagaatggcgtgaaccaggtgggcagagcttgcagtgagccgagattgcgccactgcactccaacctgggcgacagagcaagactccatctcaaaaaaaaaaaaaaaaaaaaaaaaaaaagatagtttggttgggtataaaattttaagttgaatggctgggttccatggctcacacctgtaatcccagccctttgggagtacgaggtgggtggatcacttaaggtcaggagtttgagacttggtgaaaccctgtctctactaaaaatacaaaaaattagccaggtctggtggctcatacctataatcccagctacatgggagactgaggcaggagaattgcttgaagtcagaagatggaggttgcagtgagctgagatcgcgccactacactccagcctgggcaacagagtgagactttgtctcaaaaataaaaaaaaaaaaagaattatgttggagatgattttcctttggaagtttgaaagcattgcttatcttctaacttccagtgcatctattgagacattcaaggcactctaatgcctgacctcctcccctttccctttggaaacttgcaggatcttctctttgtcttcagtgttctgaattataatgatttgtcttgatgttggtctcttttcatccattgggccaagaaatcttgggcccttttaaactggaaatatatgtctccgtttttgaaaattttctttgggtattttattttattttattttattgagacagagtcttgctctgtcgcccaggctggagtgcagtggtgcaatctcggcttactgcaacctccgcctcccaggttcaagcgattctcctgcctcagcctcctgagtagctgggattacaggtgcctgtcaccacacccggataattttttgtatttttagtacagatgaagtttcactatgttggccaggctggtctcaaactcctgaccttgtgatccacccgccttggcctcccaaactgctggaattacaggtgtgagccactgtgcccagcccaggtgtttttttaatcatttcctccattcctttttctctgttgttttttgtttatttttgtttatttttttaatggaattcctattattcaggaagtggaattcctgtattaggcctctaattttcttatctattctctcctattttctgtgactatgtttttgtaagatttcctcaattttatattccaatccttctactgagtttttgatttctcacattatatttttaagtttaaagagctccttttttgtcctttgaatgttcccctaaacaaaaaaaaacaatagtggccaggcatggtggctcatacctgtaatcccagcactttgggaggctgaggtagaggactgagatcaggagttcaaaaccagcctgggcagcaaagtgagaccccatctctacaaaaaaataaaaaaattagctgagtgtgatggcatgtgcctgtagccccagctacatgggaggctgaagcaggagggttgcttgattccaggaggtcaaggctgcagtgagccatattcgcaccactgtactccagcctaggtgacagagtgagacgctgtctcaaaaacaaacaaaaacaaccaaaaccccaacagtattgtgtttttgtctcaggtttatatatttgcatatggaatgtctatataaattatgttcttgctgggcatagtggtttgcacctgtagtgccagttcctggggacgctggggcaggaagatcacttgagcccaggagttctgggctgtagcatgctatgccgatcgggtgctaagttcggcatcaatatgatgacctcccaggagcagaggaccaccaggttgcccaaggaggggtgaactggcccagatcagaaaaggagcaggttggcagtttaaattgcattgcattgaagaaataggtggtgggatcttgctgggtgtttgattagccctttctctgtcttgcttgtttgagcttcagcagaattcaaaatgactggcaataaggctgggaaggactctggaaaaaaacaagacaaaggcggtttcccactcgcagacagctggcctgcagttcccagtgggacatattcatcgacacctgagatctaggacgaccagtcatgggcatgtgggtgcaaatgccgcagtgcatagcatagccatcctggagtaactcaccacagagctacctgaactggcagcaaaggcatcaaaagacttcaaggtaaagcgtattacccttcgtcacttgcaacttgctgtttgtggagatgaagaattggattctgtcatcgaggctacagttgctgatggtggtgtcattccacacactcacagatctctgatggggaagaaaggacaacagaaggctgtctaaaggctgcctggattccttattatctcgagactctaagtaccttaccagctgtccagcgtggtgattccagtaggctgtatctctgtgaaaaacataatttcatctttttctttcttttttttttagacagagttttgctcttgttgcccaggctggagtgcaatggcatgatctcagctcactgcaaccgcctcctgggttcaagctattctcctggctcagcctcctaagtatctgggtttacaggtgcctgccaccatgcccggctaacttttgtatttttagtagagacgggtttcatcatgttggtcaggctggcctcgaactcctgacctcaggtgatctgcctgcctcggcctcccaaagtgctgggattacaggcgtaagccaccacccccagcccaattttgtctttttgtaattgtgtctgagcaagttggaagtttaattagctttccaactgaccaatttctgcattctagtcttaaccatatttaattgttactatggcttcaaagaagctattgattccaaagtagtgggttttgattgagttttttaaaaactggattttaacagtgatgcagaagttatagtaacaaacatttggttttgtacaggcattatttccactctggtgcataagctcaataaaggtcatatcccaaactaaaaaaagaaatggagcaggtcaaaactcccatgctgatcagttgatcagtagtgggattatgcctatgaataaccactgcactccagtctgggcaacatagcaagactctgtctcagaaagggggaaaaatatccatgtaagtattatgtctgtttttgatagtattgtgttcttgtttcagaaatgcatgtttgtttttgtttgtttgtttgtttttttgagacagagtcttgctctgtcgcccaggctggagtgcggtggtgtgatctctgctcattgcaacctccgcctcctgggttcaagagcttctcctgccttggcctcccatgtagctgggactacaggcgcctgccaacgtgcctagctaatttttgtatttttagcagaggcagggtttcaccatgttggccaggctggtctcgaactcctgacctcaaatgatccacccacctcggccttccgtgctcagcctgatgcatatttttaagatctcgctaagaaataataatgatagggtttttgccgtatttttaaaagttctcttttccctgcataaaatagttttctccaagtaggtttttccatttatttttatctctgcctttcatgttagagactttggtcagatgtctgatgacttggttatctgagtaggggcactaaaaagctgattgaaaagtctgagcacatggggagaactttttgactatgaacttcattgcagggtgatctggctgagccattcattgttatcagtatcttaggtttttgtttgttgtttgtttgtttgtttgttttttagctagtcagattctccaaaatacactctttcactgatcacctggagttacgaagccctgggagctcagtgaatgaagaaggctggggtttcacactacagctgtaaatgtttgcttaatcccctgcttgaagtacagatctctcttactagctgagtccagaatcctctagagaccatgcagtttactttcttccgggaataaactttatttatttatttatttagagacggaatctctctgtatcacccaggctggagtacagtggaatgatctcggctcactgcaacttccgcctcctgggttcaagagattcttgtgcttcagcctcctgagtagctgggactacaggcacatgccaccatgccacactcattttagtattttttatagaggtagagtttctccatgttggccaggctggtctcgaactcctggcctcaagtgatccacccgcctcagcctcccaaagtgctgggattacaggtgtgagccaccatgcccagccatctcctgggaataaactttaatctcccgccaattttctggatggcaggatatggggagggcatttggggtatataattttttcttaaattttcaaacagttctcttgttcttaagccccacgttcacctctaattctggtgccaattcctgagcctgttggaaattccacagagtaaatctggttacttttagcttcttctcctgttcagtttaggactcagctctcttggatctgctaaattagttgccacttattcatttgttttccagcttccaagagggcatagttgtctccattcccattgctaactcatggcccactctgcgtgtgtatgatctttctaggatctcaagtgaaaacctcaggtcttcgccaaggtctctctactctggctggggccaaactccaactctcctagccctgaaaagcctctgaaacttcaactcagctgtctagctgcagaggctattctctactccatctgcagagtcttgccctgtgtatgggagtttaggagtcagcgaagcctcaagaaggagaattttaaaataatcaacttctggctgggcgcggtggctcatgcctgtaatcccagcactttggaagactgaagcgggtggatcaattgaggccaggagtttgagaccagcctgaccaacatggtgaaaaccctgtctctgcaaaaatacaaaaattagctgggcgtattggtctgagcctgtaatcctagttacttgggaggctgaggcaggagaatcacttgaacccaggaggcagaggttgcagtgagccgatagtctgccactgcactccagcctgggcgactgagtgagattccaactcaaaaaaataaaataatcaactttggctaggtgtggaagctcatgtttgtaataccagcactttgggaggctgaggatggaggatcacttgagcccaggagtttgagaccagcctgggcaacatagtgagactgcatttctattaaaaaattaacaaattagcagggcttggtgatgcatacctgtagtcccagctacccgggatgcggaggtgggaggattgcatgagtctgggaggtcaaggttgcagcaagatgcgatcgcaccactattttccagcctggacaatagagggagaccccaactcaataaacaaaataaaatacaataactttattgatttaaaatacagtacgttgggatttaagatgagcaatgccaatctcatcgtattttagcctattgtaactatcactgccttagtaaaattactaggaaatggtctagggcaatttttttttaatgttcattcagagtgttggtgatgatgggtgagcttgacaaaggcattcttcaaaaataaaaactggccaggtgtggtggctcacacctgtaatcccagcactttgggaggttgaggcaggaggatcacttgagcccaggaatttgagaccagtctgggcaacactgggagaccccatctctacaaaaattaaaaaattagctggccatggtggtttgcacctgtagtcccagcttctcggaaggctgaggtgggaggatcacttgagccccaggggacaaggctgcagtgagctgtaatcgctccactgtgctccagcctgggtgacagagcgagaccctgtttcaaaataaataaatacaaaatgtaattaatatattgatatacttacaataaaactcactcatcttaagagcacagtttaatggcttttgatgaatgtaaacacatgtgtaaccatcaccacaatcaaaatatagaatatttttatccctcaaaaagcttccttgtgtctcaagaaggatttttatgcagaatttttgggtttctgctctgtgtctgcttcctctccccgaaatccctgttgcctcagcagccttcactctcatctgttttccccagctagtaacactgctagtctctccttggacactgtttcccatagtcaagaaaacgtcttcagcgtgaaagcaggggtgaactctcttagtgaccatagccctgtactggttgatgttgcatatctgcaaagagttatttactatattttgtccgggctttatattcacccacagcagaggccaaggaaagataaatatgatacccactactccatcagacacctccatcagacctagaaccagaggctttaaaataccttttttttttttttttgaaagggagttttgctctgtcaatcacgctggaatgcagtggtacaatcttgactcactgaaacctccacctcccaggttcaagctatcctcctgcctcagcctcccgagtagctgggactacaggtgcatgccaccacgcccagctaatttttgtatttttttagtaaagacagggtttcaccatgttgaccaggctggtttcaaactcctgacctcaaatgaagtacccaaagtgctgggattgcaggcatgacccacctagcctgacctaaaatagatttttaaatacacatttttcacattttcttgacatgctggctaaaacggggaacatgcagaaaacacttcaccaaagtctcttccttatggcaataaggagagcccttgtatttggagctctcctggtatcttgaagataatccaaagagaatgaatctagtggtgctgtattctgccacttcctcattgggtagcctctggccactcctggggggtgagtggtggtaggatgttgtgattgtcaaaccaactacctgggaggccctgtggggtgtgatttttatttatttattttttgagacgaagtcttgctttgtcacccaggctagagtgcagtggcgcgatctcggctcactgcaacctccacttcccaaggtcaagtgattctcctgcctcagcctcccaagtagctgggattacaggggcccaccaccgcccctggctaatttttgtatttttagtagagacggggtttcaccatattggccaggctggtctcgaactcctaacctcgtgatcacctgcctcggcctcccaaagtgctgggattacaggcgtgagccactacgcctggccagggtgtgattttagagtcagatggagcagggtttgcattttggctctgacatttactgtgtgcctggggaaagtgatggaatcactctgggcttggttttcttatttacaaaacagagagagtgataccaatcttggaggatcattagaagagttaatgatgtagcatatcatatgctcagctgagtgccttctacgtagcaacatccaatatgtgatggccactgatagctctatttatggacaggaagatgctttgtaccctgttaagtagttcataaacttggtggtcagcatcttttggacagcccagcgtctaaatcccccttcctccactgtgtgaaggcctccccttgcttcttgttccccaggacaggaatgatagatattcactgtccccgttcttgctctgtggtggtcagtgtggctcactggatgctcctgctaagaaaaacgggagaatgttatttgggtagtggaggcagaggcagcaccgggtcccttggcatggaacccagtgtcctaaccggaccatgccttgggtgggatccagctggactctgctgccagtaacccttgttttttgctcattttctcatcctgggtttccagccttcctgatgattctgtgagctgcctgatatgtttccaaaaacatgacaaaacaaagcttttccacttcattaaccagatttggtttctatttcttgttaccaggaactctgattaatacacttggcgccaaaaacaatgcaagttattaaaaacagggccatgaggtctgacacacctgtgggactgagaacgctaagtgaacacacttgttctcctggttgctctcttagccttaaggacaggcaactcatgaaaaaagaaaaatagccaagaaaatctgaacctcaggagtaaacaaagaagtaaaaattaaaacagatagggccagacacggtggctcatgtctgtaatcccagcactttgggaggttgaggcaggcagatcacttgagcccaagaattcaacaccagcctgggcaacatggcaaaacccgtctctactaaaaattcaaaaattagctaggcatggtgtcacgtgcctgtagtcccagctactcaggaggctgaggtgggaggatggcttgagccccggaggtggaagatggtagtgagctgagattgcatcactgcactccagcctgggtgacagagcaaggccctctctcaaaataataaataaagaaaataaaatagataacattttctcttgtcaaattgataaatgcccatacatagataaatacatgtgcatataatgaagtgataatagctggtgttggcaagggagcaagtgtcccacaaggcgacagagagagtgcacagcctgggccagtcccagggaagtccagcggagtgatggaaacttactatttgagaaacactttaaagacggcttactgttgtctgagccgtttttcttttttggagatggagtctctctgtgttgctgaggctcgagtgcagtggcacaatctcaactgactgcaacttccacctcctgggttcaagtgattttcctgcctcagcctccggagtagctgggattacaggcacccgccatcacacctgctaatttttgtatttttaatagagacagggtttcaccatgttggccaggctggtcttgaactcctgacctcaagtgatccaccagcctcagcctcccagccttctggattacaggagtgagccactgtgctcggtctctgagccgtttttctataggacaagagcagggacagtaattactcccatatgcatggtttttctgggaagtatgacttggctgtgcctttacaaaaaagtatggtaaaatatatgtaacataaaatgtactatcttcactgcttttaagtgtatatttcagtgaaattaagtacattcacattgttgtacaaccaatctccagaaccgttttactgttttcatcttacgaaactgaaactcagcacctttaaacaataactccccatttcccccaccccctacccatagcaaccaccattctatttcgtttttaccaatacgactgccctaggtatgtcatataagtggaatcacacagtaggtgtccttttgtgattggcttatttcacttagcataatgtcttcaaggcccatccatgctgtagcatgtgtcagaatttccttccttttcagggctgaatcatatttcactatatgtatagaccacattttgttttgatggacacttgcgctgcttctgctttttggctattgtgaataatgtggctgtggacatgggtgtgcaactatctattcatttgtagcctgggtaccagctcgggtcaccttcttttgatactttaataaaattgacttgaaatatacatacagccgcccactaccccaaacaaaagagaagggaagccttcctagaagttgatgtagtatctcaaggtgccccctgctccccatggagaccctgatgacaccacttctggagtgccaagtgctgcaccaggactctactgcttttgttctgactgcagcctcacgaggtgggcaaggccactgctgtcccatttgggcctctttacaaatgaggaaaagacgcacattttccctggcaaaactccagcttggacagcagagtagggagcacattggaggccccactcaggtccttggcatggctcccttgcacaaggtacagcctacactattctacatgacagccctgaggcaggcatggctggcaacccagccttactggtgagaaaagcgaagcacagaggtgaggagtctgcaaatttttttttaactttttttttttttgagacagggtcttgcctgttgctcaggctggagtacagtggcaccgtcgtgactcgctgcagcctcggcctcccagactcaagacatcctcccacctcagccttcgaagtagctgggaccataggcatgcaccaccacatcctgttaattttttttttctttttttttgaggcagagtctcactctgttgtccaggctggagtgtagtggtatgatcttggctcactgcagcctgtttcccaggttcaagcaattctcctgcctcagcctcctgagtagctgggattacaggcacgtgccaccacacctggctaatttttttgtatttttagtagagacagggtttcaccatgttggccaagctggtcttgaactcctgacctcaaattatccatctgcctcagccttcaaaagtgccgggattacaggtgtgagccatcgcacctggcctcacaccctgttaattaaaaaaattttttttttgtagagatggggtctccttgggttgccgaggctggtctcaaactcctaggctcaagttctcctcccacctgggcctcccaaactgccgggattacaggcatgagctcctgcgctgggcctagagtttgcaagtttgaagcctagggagcatgtagccggctttcaaatgtagatcttatttatattcacatatggtgaggccaggagatcaggatctgattgctatcgaaagaataattgttactcacagttcccaagtagagagggcgggtcataccaggcagggccaggagtggaggcctcagggtggtcagaaggcagagtcagggaggggaaaatgtaggcaggagcatttgctgtgtttctgagggaaggaatggtcgaggcagggtaggaagcaggcctagaattggctactgtgaataatttcagtgggcttgtcagtggggtgtaagggctggggaatagtggcctggagcgtgagaaccctggaagggccctgtaaagggaatagttggaaaatagactctggattggttggttggtatacaaaaggcatgctcacaagtgagtcccttaccatctctagccatgggaggggcagtttctctagggtcagcaaagccccaagatgtcaaacatcagaataaagacatgcttaatacaaagacaaagcctaggttctgaatccctttgccatcattttttaaccctttctctgtcagtggctttcaaacctttgcatttcttttcctctggcagggcaccccttttcctaagtgaaatcttgaggcagcccagtctgttaaagaacgctgctctggcagaagggaattgtggggagggaccctatcacctggcaccagttcatttttatttttaatttttttttgagagacagggtctcactctgttgctcagactaaagtgctgtggtgtgatcatggatctctgtggccttgagcttctgggcttgaacaatgctcccaccccagcctctcaagtagctaggactacgtgtgcacaccaccatgcctgactacccgttcattttattttattttttatttttatttatttatttttattttttgagatggagtctcgctctgtcacccaggctggagtgagtgcagtggtgcaaccttggctcactgcaacctctgcctcccgagttcaagtgattctcctgcctcagtctcccgagtagctgggactacaggtgtgcgccaccatacctggctaatttttgtgtatttttagtagagatgcggtttcaaccatattggccagactgatcttgagctcctgacctgtgaacctcctgcctcagcctcccaaagtgctgggagccactgcgcccagcccccgttcattttagaatcagtcttcaaggctgccccacggagagtcttctggtcccccttaacaagagcagaaaagtaaaaggataggcaggggcagggcacttggggtggctactcagtggttatgtggccctgggtcagtgccatccctctctcctttttaaacatctttattgagacataattcacatagtatacaattcacccatttaaattgtacaattcactggcttttagcatatttgcataattgtatatctatcaccacagtcagttttagaacattttcatcaccctaagaagaaactccttagctcaggggtccccaactcctgggccacagactggtaagagtaatggtccacagcccagcctgttaggaacctggccgcacagcagaaggtgagcagtgggcaagcgagtgaagcttcatctgtgtttacagtcactctgcattgctcgtattaccacctgagctccacctcctgtcagatcagcagtggcattcaagtctcatagaaccatgaacgctattgtgaactgcgcatgcgagggatgtaggttgtgccccttatgaaaatctaatgcctgatgatctgaggtgaagctgaggcggtgatgcttgccctggggagtggctgcaaatacagatgaatgttagcagagaagtttgcctgcacagagaccatcataaatcaattgcttgcagacccatatcaaatccccatcagtgagtggcaagggaaaattaagctgaatctggtggcaggttttatggtggcaagtgagtcaatgtacttcagttgcacagctgccttgaaagtatctttgagacaacttcaagtctctgtacgttctggattaaagtcaaggcagaatgtcctgagactgccagaaaaacactgaaaagcctgcttccgtttccaacatcctatccttgtgaagcagggttttcctcagtgaaccaaaatgagattatggagtagactgggcataagcaacacacttagggtatccctgtctcccaaaccccctagatgggaccgtctagttgcaggaaaacaagctcagggctcccactgattctacattatggtgagttgtataattatttcattatatattacaatgtaataataatataaataaagtgcacaataaactgttatgcacttgaatcatctggaaactacctcccatcctccagcagtctgtggaaaaattgtcttccatgaaaccagtccctggtgcaaaaaggttggagaccactgccttagctgttctctcaccctgatttctcctctcccccaaccctaggcaaccaataatctactctctgttgctttcaatttccctattctggacattccatatgaatggaatcatttactatgtgatcctgtgtggtcttctatgactggcttcattcacatagtatgttttcagagttcatccatgttgtagcatgtatcagaacttcattcctttctatgattgaataatatttcgttgtatggacagatcacattttgtttatccattcatcagttgatagacttttggggagattccatttttgggtactacggataatgctgctatggacattttcgtgccagctttcgtgtggaggtatattttcatttgtcttgggtgtctactagctaagagaggaatggccgggtcatgtggtgtccatatgtttaattttttgaggaactgccaaactgtgtctcaaagtggctgccccatttgacattcctaccagcagtgtaggagggttctgatttctccacatccttgcaaatacttgtaattgttcatctttttattccagccatcccagtggccgtgaggaggtatctcattgtgtgtgggtgttttctttttgagacagaatttcactcttgtcacccaggatggagtgcaatgatgcaatcttgactcactgagattacaagtgtaagccaccgcgcccggcatcagccatgtgtttttcaaaaaaaatttcttttttctattctgttttttgagacaggctctctgttgcccaggttggagtgcagtggcacgatctcggctcactgcagccttgacctcccaggcactgatcctcctacctcagcctcccaagtaggtggaactacaggtgtgcaccaccacgcctggctaatttttaatagagacagggtttcaccatgttgtccaggctgaaatttttattttttgttttttgagacagggtcttattctgtcacccagactggagtgcaatcttggcttactgcaacctccacctctcgggttcaagttattctcctgcttcagcctcccgagtagctgagactacaggtgcacaccactacacccagcgaatttttttatttgaaaaaaatgtttaaaaaaaatttttaggccaggctcagtggctcacagctctaatcccagcgctttgggaggccgaggcaggtggatcacgaggtcaagagatcgagaccatcctggccaatatgatgaaaacccgtcttcactaaaaatacaaaaattagctgggtgtggtggcgcacgcctgtagtcccagctacccgggaggccgaggcaggagaattgcttgaacctgggaggcggaggttgcaaagagctgagatcgtgccactgcactccagcctggtgacagagtgagaatctgtctcaaaaaaaaaaaaaatttttttttaaagagggtctccctctgttgcctaggctggtggtgcagtggcacaatcttagctcactgtaacctcaaactcctgggctcaagtgatccccctgcctcagcctcccaaagtgctgggataacaggtgggaaccaccttgcctggctccagtgtggttttgatgcacactttcctggtggctcaccttccctgcttctcttatactctctgcaaagggagaatccagaggtttctcaagttccctgaggggtgctgtcacgcccctttcctccctgtcaccacactccctactccccaccccccacctacagctgtgattctccatggtgctgagaggaacccttcgtgaactcaggatgtcaagctagagagaccttcatcttcatccagtccaaactgctaaactatctgacaggtgaggaaactgaggcccagagggatgtgggttacttaattaatggtgcctggcatgttagtggcagagctgggttgagaccagagaatccatgcttgcacaggggacaaggagctctgggtttgattctagactgtcgccatgactgtgccctccctccctccctccctccctccctcccttccttccttccttttcttccctttctttcctttcttctttcgagacagggtcacactctgtcacccaggctgaagtgcagtgttgagattatggttcactgcagccttgacctcctgggctcgagtaatcttcccagctcagcttcctgagtagtcgggattataggtgtgcaccacctccagctaatttttaaatatttttgtagagacagggtctcactctgttgctcaggcttatcttgaactcctgggctccagtgatcctcccgccttggccttccaaagtgctgggattacaggcatgagccgccactgccggccttgtgggccactttctgaacctttctgaacagcagtttcctcatccatataatggagatgatacctaccctatggggttgttttgagcatataaaatatttaatatagtaagtaaataacttatttaattttggaataattactatttaagtgcctatgataaaagaaagtcaaatagtacaaaggagtataacgtgaaaaagaaacctctttctccaaccccgtcctgggggccaccattaccaccagactcttgtcttttctgtcagatctcttctatggatataatggaagttatttatcacatgggaccttagagttggagatcattaacttgcctgcttttctaagctggtctttcccactttgccccttcaaccccccttcttgtggcagcacacaaaccgtgggcctcccttatttgtccagctcccccttcccaagccccctccacctggtaatgatttcctagagcgtctcccaggggtctccatggggacgtttcctgctccaatctccatggcaactcttcaggttgccatggtgacacttaagcgattatttggagacccttaaataaatcacccgtggtggtatatgctagacgtgtttggctctggctcttgtgtttggggccagggttggggcccaggcccgaaggcagaaaatgtggggaggtgggagatggtggtcagagcccgatgcccttggtctggccctgtgaggggccctctttgggcaaaattggaattgagccttttgtgaagtggtgggaggacaacaggcagttatgcttgtgcagtccttaaatagggagaccctgcagccagcaggacatcttaactctgatcaggatgggggcaacttggagctatgcagtaaccaagcagggattccactccaggcctgctgggctccaaggccctcactcctccttgacgtcaaattctaaaagggaatttaagatggaatccactccttcatatattcatttatttgaccgatgtgtttaaagtggctactatgtgccaggcactgtgtgctaagcattgggaatacagcagtgaattaaaaaacaaaacccctgtcctcatggagcttatattcgaccagcgagaggcagacaattagcaaaacaaaacatccatggccgggcgcagtgcttcatgcctgtaattccagcattttgggatgccaaggtgggtggatcacctgaggtcaggagttcgagaccagcctggccaacatggtgaaaccccatttctactaaaaataccaaaattagccgggcatggtggtgtgtgcctgtaatctcagctacttaggaggctgaggcaggagaatcatttgaacccaggaggcagaggttgcagtgagctgagatcatgccattgcactccagcctgggcaaaaagaacaaaactgtcccccctctccccatcccccctccaaaatgcaaaaaaaaaaaaaccacccaggttagacagtagtttcagtattagggaaggggcctagagaacagcagggtaagctgtggcacacactgacaccagggccgggttgggggggggtcccaggcaccgtcttggggctcagcttcaggtcccaggacaattcctgaaaggtaagagggtgaggtatggaaggagctagccaatacttgagactccatcagcagtgaccagctccctccgcgtgttctgcctaagcgatgtacaaagctttccagcttctagatgcctcacggatgcttggaagcagaaatgcatggctgagactttaatctccactatatagactgggaaacagatgcagaagggaggcagcctgccgaaggcaatgccgctaatggcaggcagaaaggtggctagaactggagtcatggctatcccagtccaggtccatttctgccagaccagtggatttatcaccagatctgcaaattcatacttccctgagtgctgtcttactgaataagtagcttatcttgtacatgaggaagatcatgttgtctatggggagagattgtgatttacctgtaacaccagtgtcaggtgattataccatgctccctgactcggagctttactgcaggccactcgggtcaggcctgttcctcggtggtggaacagactgcaaggtacaagaacaggcttcttctagcctccgacttccccagcccactggcactcctcccagaaatgaagtttggaagcacaggcctacttaaggcctggacaacccaaaaagcttcctgagaaggtgatgagactcgggtctggatacactgggctctcttcatgttttttccctttcctttctttttcttttttttccccctgaaacagggtcttcttctgtcacccaggctggagtgcattggcgcaattttggctcaccgcagcctctgcctcccaggtccaagcgattctcatgcttcagcctcccgagtagctgggactacaggcacatgccaccatgcctggctaatttttgtatctttagtagagatggggtgtcaccatgttggccaggctgatctcgaactcctgacctcaagtgatccatctacctcggcctcccaagtgctgggatgctgggattatgggtgtgagccactgcacttggccttttcttttttaaaaaaattagatccatatttttaggacgagttcatttggctggtgagttgttccatactccttggcagattccagcttccatgactaccatcctgcttctcttttctgagtgtggactatccaccttcatacaggtctcagggttggggccaggctagcaggaaatagaaaatcatttctggttagcctaagccccaggaagcatttactggaaagttcttggagagtaaatggaggagctgaatggccaacccctaggctatgtggctactgagcatgtgaaactcgctatgtgctaagtgtaaaatagacactggaattggaaaacttagtatgaaaataagagtgtaaaatatctcagtcatttttatattgattacatgttgaaatgacattttgggtacgttgggttaaataaaatgcattgttaaaattaatttctcattttttctccctaggctcaggtgatcctcccacctcagcctcccaagtagctgggattacaagtgcgtgccaccatgcctggataatgttttgtattctttgtaaagacagggttttgacatgttgctcaggatggtctcaaactcctggattcaagcagtactcctgcctcagcctcccaaagtgctgggattacagacgtgagctaccatacctggccaatactagatttaaaattacatatgggccaggagtggtggctcacacctgtaatcccagtactttgggaggccgaggtgggtggatcacgtgaggtcaggagttcaagaccagtctgaccaatatggtgaaaccccatctctactaaaaatatgaaaaaattagctgggcatagtggcgtgtgcctgtactgccagctacttgggtggctgagacaggaaaattgcttgaacccaggaggtggaggttgcagtgagccaagactgcgccactgcactctagcctgggcaacagatcaagactccatctcaaaaacaaaaacaaaaacaaattacatatgacttacataattactgtcatctatattactatatactacagtactgctggacagtgctgtgactagattaattccacaaggaaaagagccataggaatattgctcatcattctaaacccaggacctggtattggcgccaggatatagtagggggtcaaaaaagtgttatttgttgaatgaatgtttgacagtcacattttccatcagccctgaaacattttaaacagcctgcaaagggaatgtgatctaatttaaatgtcagtttatatatttaaaacaaaacaaaacaaaaaaaccccaccgtaactcaagcatgaaatttgcaagaaggggaaaggaaaagggagaatgaagggatcagggtctcagtctcttttttctgagggattagggggatattctgacctttgtcaagccaaaaaagaaaaaaagaaaggtcctgcccatcagaggcagagatacgatcatcctccacttcctgtggccctccccctctttctttgctaacagaggcgtctatttttagctaggcacatggccacccagagtccaaacattttccagcctctctggagctgggtttggctacgtaagttctggctcatgggatgtaaacagaagtgtcaagtaacttttgggaactttccttaaagggaagtgctatgtctctttccccttctcctggctggaatgcctagaacctcagcagccacattgaaccatgaggaatggtggaggggtggtgtagcagaaggctgggaggggcctgggtccctccccgacaacttggtgaactgtcgtatcagccttggaatgcctactgtggacttttcatgtcagaaaagaaaatcctatgtatttcaggcttgttgacttgcattttttggtcaccttgtcctaactggtgactggtgcctaccagccttacgttgctatcactggaagggaccactcaactaccttgagaacactcaagtaccttcccggacagggtctgctccaagatgactggatttctttaccatcagctgttgatttatttttttgagacagggtctcactgtgttgcccaggccggaatgcagtggatcttggctcactgcagcctccacctcctgggctcaattgatcctcccacctcagctgggaccacagatgtgagccatgatgcccagttaatttttttgtattttttgtagagatggggttttgccatgttgcccaggctgctaggtattgattaaaaaaaaaaacaaaaactggcaagaccttcagaaggtacaaaattagaaaggtacaatagaacagagtgaagcctgggcaacatggtgaaaccccatctctaccaaaaaaaaaaaaaaaaaaaaagaaagaaaaattagctgggcaatgtgcctgtagtcctactcgctctggaggctgagatgggaaggactgcttgagcctgggaggtgaagaggttgcagcgacccgagatcatcacgccactctactccagcctgggcgacagagcatgaacctgtctgggaaaacaaacaaacaaaaaacatagggtcacttcctacctctgtccttgtcatacccattttctgttccattcttcttcttcttcttttttttttttttttaacagggtctcactctgttacccatactgaagtacagtggcgtgatcttggctcatcacaacctctgcctcccaggatcaagtgattctcctgcctcagcctcctgagtagctgggattacaggtgtgtaccactagtacccggctaatttttgtatttttagtagagacggggtttcaccatgttggccaggctggtcttaaactcctgacctcaaatgatccaccagcctcagcctcccaaagtgttgggattataggcatgagccactgtgcccggccctaatatattcttttaaagagagagaaaaatgttaagttctcccttatgggataccttcttacataatctaaatacatagctgttgtcaacatccatacctctacaaaaaaacctgcctgtctgaattattctggtcttactacctgtgactctaaaatgagatcacgcttaccttatggcctgcattaaagtgttcaagccctcaaccacacagtggccacatccatccccttcccgaacccttctccccccccatgtaaaatacttcccacgacctactgattgagcagacagctgggtagtcattatgtctagggaggctggatcccaagtccaccaagctccacttagggtcaaataaagagagccaggggattggtttttagttgtgaattcacagaccatgtttttcagtaaaaaaaaaagtcactgtattaataattgcaaacatttaatgtgtattatgtgccaggcactgtactaagacctttttatgtgtaatcacgtttaaaactcacaatgacccaatgagtcaaacactactaaacagtattcctagcttataaatgagtaaagtgaggcaaggagaggttaagtaatttgttcatgtgcaccagatggaaagggagaattgacgctgggcatggcggctcacgcctgtaatcccagcactttgagaggattgcttgagcccaggtgttcgagaccagctgggcaacatatagcaagacctgtctctatttaaaataaaaaaaaaaattataaaaataaaaaaaagaaagggggagttgggatttaaatcctgacactgattgtagaactcaggctcttaacaagatgaccctgaccagatggtaagctccattcatgcagggaccttccccaagggcctagtgcactgcctggcacagagcagaagtgtagcaaatattaatggattcaaatgttcacacgctaacactgccagtaggttgaggaaaggatggtggcaacgtttcccagtgactgcaggcttgtgtcctcgctcagggcacactccccagaatccaagcctaaggtaaggaggccaaattagtgtcatgagaggccctgtgggaggggttggaaccagagggctgcagccacagaaggacctttctttaccctggtgggcctgatgtgcccacgggagcacaatcccttgatctgcagcttccaccccagagtgtgctggacacacttctgcacactgaacctgagcctttttgcttcacccgcttctgtggaattccttttagatgtattaacatctttttttttttttttttttttttttctgagatggagtctcgctctgtctcccaggctggagtgcaatggtgtgatctcggctcactgcaacctctgtctccttggttcaagcaattctcctacctcagcctccccagtagctgggattacaggcacgtgccaccacacccagctaatttttctatttttagtagagacggggtttcaccatgttggccaggctggtctccaactcctgacctcaggtgatccactcgcctcggcctcccaaagtgctggaattacaggcgtgaaccaccgtgcctggccagatgtattaacatctgattcacctattgtgtttactgctgcacccctaatacctagaacagtgccttggaagtagcaagccttaaatctttgttgaatgaataaaagttaagctatgcacctgatcctggccagacggcccttcagactccagacttgagtcctttcagcgcctcctactgggactggattagctgcatctcagagggcactttatttcctacatttctaagtcacaggggtgggggtaactggggcattcactgttgacctccagcacccgaagaggtgagctcctgacgggggttggttctcattctaggagttagaactcatacaaggccaacgtcctttttcacaacccataaggatgattctgctatagttttaggtaacgcaaatatttcctctcttgggttttggctgaaaaataaagaggtctgccaacagacagcaaaaatcaagaaaagtaaacatacaatgccaggttcaatcagacatgaatcaatgggaatacacatggataaaccctgaaatagaaacacggcaccatagtttaactgacacatatatatactgaaggactccagaatgtctctcccacccctaaagtgctgaacactgcagggagctgtaactgagtcaggagctattttaatctcccttgtaaaaaagacgtaaaaatggcaaagaactggacagaatgctagtcaagaatttgtaactattcatggatgagatggaattcacacgtatttttatttcttccaagcaggtacagagactcaaatgtaaccctttgagctctcatgcttgaggatgtgctgctacctggcctttgagctctgtgctggcataaagcccaaggcctgggcagggcagatgatcaaagtagggagaattttaacaccagtcatgggacacagtggggagcacaaacagtagggtttaccaggcaatgctgttgatgttgatagtcctagcaaggctggcagttccaggaggaggaccagcacctccaggacgtatgacttccccccctacccatgggtgatgtgatccttcacataaccattctgctccaaggtctgccttgttctcaagtgctatacgctgattcgcacccatcacaatcacacacgtctcacacagactccagaccctgcagcgcccaactgagtactcactcacgcaaggtgaggctccttggcggtgccatctttattattcccagccacaagttatagccacaacctctcttccatttaaagtgtgcgtcacccgcagaagacaacaggtgccggagttcactcctatgattcaattctaccctcccctggcctttgcacggatcccagtggtcctggctcggatcaggcctacagcttacttcccaggcatgcttccaggaaggcagttggggtggggggtacccctttatggctcttcccaggttacatgagaactggtgatctcggtggggtctcaagtagaagccctgaattagtgttcattaacaaacttaatcctttgtcctaaaccaggctctagctcaattcaaagataaaggggggttaaacattaagaaaaatggcattttttttccacatcactgataccccaagagaagttaataggtctaccttgtagatgcagggaaatcaaaaggtcaaactataattttttataaaaactaatttttttttacgcttaatttttttcttttttttttttgagacaaggtcttgctttgttgcccaggctggagtgtagtggcacgatcttggctcactacaacctccacctcccaggctcaagtgaaccttccacctcagccttaccaatagcaggtactacaggcatgggccaccatgcctggctaatttttgtattctctgtagagacggggtttcgtcatgttgcccaggctgctctcgaactcctgggctcaagtgatctgcccccctcggcctcccaaagtgctgggattataggtatgagccacagcacccagcccaaactacaaattttaatagaattttaaacccaaccactggccaaaaatcactcggtcacgaattcctaatccacaatcacatcagtaggaagggaaagcactcattctaacacagatccaagaaccaatggctaccccgggtaccttaacagcatcaactcagaacttaaaaaatcaactagagatcatccaaggaacgtaagtataattctacaaaaaaccatctcatccccattgcagcaggccccaaactccagtgaggcttccataggccatggagaatgggtttggctcttgtcacagggtagagccccatgataggggtctgaggtagatgaaaacaacagggtagccaggggcatctatagaagatgttacagagctgcctgggcctcatgacagttgcacctcagttacaaatcccagacggctctatttgcttaaaccagtttttccagtgacgcttacatgctgactttcttggtttctatagatgcttggtttcaaaaataaaactaaaataacaaaaattccaaatccctcaaatggaacaaataaataatagtaacaatatttacataagtatgtcacattgagagattccagcatgaccaaggaatggaaaatccaagaatgtgccctggcctgtgtggggctcaggcctggctcatcgtcaggtgtgaagacaccatggggagccgatggatgtatgcagtgagctgggatggaccatgacacctggctgggctttaagtccagggaagcagtgtgtgcacgagctgtggggccgtctatagattaggtttcaagcaagcaaacaataaaaccctcagctctcccgagcagcgtggcacagtcagggtcactggtgtgagctgcaccctatcagaggagaagctgctcctggggatgccaagagggcttctctgattgctggcataggtggggacctcaggacccccgtcccagggagcacaaaactctttatacatcagctggagacaggacaaggagtcaaggtcaggcatggtcccctctttctttggactatgtgacaagggggatgtggaattcatttgtgtcgaagatcaggggcctcttgggagggttcgggtccctgtcagccttgtgaagcagcttgaagagcccggttccaatgttcattgggattcccatgatgatgcactcagacacccctgaaaccaaccagaatgaacatcagagagcctctaaacacaaggtacattttcacgaagaaagactattggcttaagtgtcagaaaattaggatgtgagtcccagcgccactccacatcaactgaactttggcaaatccctttccttcccatctaaaaagggtggctgtggagtgcagacagggggattctgcactttcagggaagggcagggcttgctcacagcccaggagcttgttggagacagagtcagctcctccagttctcctctcccacctgagccaaaggcaccctgggagggccctgcctttgagaacacaacttagcaagaatactgaaggatgcttaggaaactctaagtttgccacccagtgcttccttaacttagagcctccaagaaaagcaaacaactgggacagtagtgagcagaatacaatccccttggaaactgcggtaggcagctgttagctgtgctcaggggaaggggccaggccaggcttaagagcatctgagccttcatgatctacagccctgatgagaaacacccagaaggcagggcacctatagagttacaggatcaagggggtggtgcagattctttctccaagccccatgtcaacctggcataaggcttgagtctacgatgagcaagcaaatggctactgtgttgtagactttgtgctaccaaggaaccggagaggcaaacaactaaattaaagaccaacatgcaatgagggcgaacactgggttacaatgtgctgaaggaccaggaggaggggaaaacttcaaattgggggtggggtggcagtgccaggcagtcaaggagactggtggtggagaaaggtgctggtgtatggggccgcagagctgcggcaaaggcccggtttccaggtgtcaggcttgagtgctgggtctcagccctattgtcaggcagacttgctcttctcttggccttgggctttcttccagtcttctgtgtacctccctctggccccattctaactgctgctccttttcttttcccttcatgctagttttttttttttttttttgagacggagtcctgctctgttgctcaggctagagtgcagtggtgcaatctcggctcactgcaacctctgcctcccaggttcaagagattctcctgcctcagcctcccgagtagctgggattacaggtgcctgccaccgtgcccagctaatttttatattttttttagtagagacggggtctcaccatcttggccaggttggtcttgaactcctgacctcgtgatccacccgccttggcctcccaaagtgctgggattacaggcgtgagccaccgcgcccggcccacgcttgttttttgattttaaaaatatttaaatagacacgagttctcattatgttgcccagcctggcctcaaactcctgggctcaagtgatcgtcctgcctcagcctcccgagtagctgggacaatagcaacaccatgcccgctctcacccttctttatcttaaagacttatgtaatatttatttccctccatctccaatccctgtcccttctgaaaagagaaacagttaatcttagaggcaaaaaatgggtatatactctaatgatgccaatctgtacaagagcaggaggtgagagagcaaagggctactgggaagcagagctctggcctggaaacagcagccagacttggaatccctgtgtgggcctgactggtgtgtgccccggggcaggttgctggccctctcgaaccccagccccttaccagctctcaccccaagcctgcagggtcttcctgcggaatcagaaaggctcgagcaaagctcagcagtcagtgctggtctcacggaagaggcagggaagccagacactggggagagttcccctcgtgctccctctcccccaggccagcacagccccataaagccatgttttgtcgagtggcggggatgaggcatggtgcagagcaaggctctgctggtggactcgacagcaagcgaggtcaccttggtcttctgacttgtcaaagggcttaatatccacaccccacgggtgggtagagatacttgacacatatgatgcctggcacaggggctcagcaggcattgatggccacctcccaaggacagtaggacactctgctctgcccagcgcccagccagtacctgctcctgtcagccctggtgtcacacacaggggtcaggatcagtgtggctgactacaaagtcaagggctagaaaaattcttacatgcccagggttgctctttgcttcgtggaccaaaaaccatctgtgctgacagagggaagtcatccaacagatgtaaacggggatgcaggatgctacagtcaggatttggagataaaagatccagcagttccaattcgtgtctattgacattattcttgaaaaaataaacgctctgccactcagtttttttcattcccttggaagcctagccatggtctatttgtaaatagtaaaggcctttgatgctgttcatagaaacatcaaacctaccacacacagagtccttctgcccgaagtaggcagcgtcaaagagatggtcagccgtcttctcaaaggaggccagcatcagcacactctccttcatcttggccaggccaaacctagtgatgcccaggacttcaccctgcgtcaagggagaaagagtcacggtggtactcacaccaatggcaaaagctcgaaaccaaagcacggtgcaccttcaatacaatcaacaaaaatcctccaagacccaacgtcaggtgtgaaaggccctgaggagctatgggtccgccctctgtgtcccattgaggtggtcaatcgtcggcaacatgaaacttcacactcgcatccagacgccatcagaacaaagaagaattgagaactagaattcagagactaactttaaaaaaggggagtatttctgaagagatttcttatggctcaaagaactaaaaataaaagaatgtaaaaacctcaagtatgaagagaattaattaaatttaggtaattctactcaaaggaatattgtgccataatttaaaaagtatatttattaaaaccatgaaacaagatggaaaacatttgtgatgttaaacaaaaagtcacaacaaaaactgcatgcacacagtttcctgcgactaaagcaaaagatgcataaagaataggacttcacagaagacatcgaaccgacagcctcagggtggtaggaaatgggccatttccctcacctggtttctaaatagtctgtaatactctatcgacttgtttggggaagccttatgaaaacctgctgccctaaggcacagctagagggaaatacgttttttttggaaaagagagaaaaaaaaaatcaaaccaaccaacccacctcagcctcccgcccccaacttcagatcatgttaacttattttttcctgggaatggctacagaagagtgatggatgggtttaataagaaagaaacacctcaacttgccatgggactctctgggctttggcagtggctaattttgctttaggatgacattcaggatgaggacggaaccaagctccagctctcttcactccaccgactgggtatgagtttgccatgaggctgtaactctcatactgggatttcaccaggacactcagcctgaccagcatactttggtttttgagcaatgttcacatcttattttctctctatgatggtcctcacagcagcgtattctacatgtcttagaaactccacaggcttattctcctgaaagtgagtttcgggatgcccaggcagcccgggggcctcctgcccacataccttgtaggtcatgaggtcggagagcagcatcacgtgcctcctgtcgatgctcatgccgtggttcaccatggtgtactggatttcattgatgatcgttgtccgggcggcctcgatgcccagagttttctccacctacagagagccagtaatgagcagaagcagccccttccgggaggccactgcaaattctctccactttctcctctgccctgcagtttcaaagcaaaccctgtgccgttttccagaaatggattgctgggcaattttcagttgcagacccacggcaaatgggatggtcagagaagtatgctgggaggccgggcacagtggctcatgcctgtaatcccagcactttgggaggccgaggcgggcggatcatgaggtcaggagatcgagaccatcctggctaacatggtgaaaccccatttctactaaaaatacaaaaaaaaaaaaaaaaaaaaattagccgggcgtggtggtgggtgcctgtagtcccagctactcgggaggctgaggcaggagaatggcgtgaacccgggaggcagagcttgcagtgagcagagatcacgccactgcactccagcctgggcaacagagcaagactccatctcaaaaaaaaaaaaaaaaaaaaaaaaaaaagaagtatactgggaatcagtggaaggcctgcagatggcacaaggaagacagcctaaccctaaggcgaccccgtgggctgagtggtacctcataggtgttattggaggtggttcgggtgcccttcacaccgtgtgtggccatgactgcccgcaggttatcaccttccaccagaagcttgtacttctcctttccactctgctcgtcaatgtggatgacagctctggacacctctggaatgccctgcaccaccacctggattcagagacagagaaagctgtgaggacggggtgagccatgccctgggctgatcaccttgatcaccccagctttcagcagtggtcatctgttaacacactagagctagttttagggataagggagaacagaagttgttcaggggactgcacctcatcctaacatcagttttttgatagaacagagaggaatctaacagactaactccttggggataaggccaagaagaaattaagaaatcggactaagtgacaaagcccttaggtcccagccctgggtgtcacaccacagggagatgctgggtctccatgagaagcgacttctgtttcaccttggggagatcctctttcaggaactgcagcacgtagtacatggagctcttgctgttctctctgggggtgacacacaccacagcctcaccatgaacagccacatcaccgggcttcacacggagcttggatgtgcagatggaatatctcactgtctcagcgttcacctgcaacatggccaggtgtaggtgttactgattccagtgttgttcttcgtttatttcattgttgcccctctaagaagtccttttagtcaggtttgttctaagcaccccccacccgcaccatgaaattaataccataaatatgctacatatgttttatgtactatatgtgtatatatatctatgctttattcataaaaagagtagtttttttcacccacgacaaaatatttgcccttgaaaattcatgctcagttcatggcaacacacgcagcctctgtgggaagctctagggaggctggaggttggaggccaggctaattaaaagcttccgtggggcctcccctttacctgacactttcacaatggttcatgtgctacgttcctggatacaactcatctcttctgcaaaggagccacaaggcaggcagcaagagacaggctagagaaatccccaaactggagagcaggttgctgcatttgagtcaactgttatatgggtaacatatgaacttgatgcgtgagagaacgagctgacagaatgtgttttaagggctagtacagctttaactacccgagagaaagaagagggtgtcgggaagttactcagtttgtaccccaagttggtctgtttgtgagaaaggctgatcatctttcaactgttgcctattacccatgcatgccagtttaagaagccaggttaatctccccatctaaacacatttactgaacttcctaggctagctgccatgctgggcgctggggatccacagatgagtaagacacagccagccctagggtccttccagacactgggaagagggacaacaagaccacttatcataataccgtgtcacagtgaactggtattgcggtctgcacaaaatttcaactaattttctgtgtgtctttagatgggtatatttgtatcaaggtcaggtttagaaagaaaatgtgaggggacaacagaatcacaaaaaccagaaaccacacagaaggttctgcaatgcttcctctgtcttgcttagctcttgccctagtttatcagtacctatcttgggactaacaggatgacttcctctctacatttaattatgtgactcacttccagtctcagaagcctaatccgttccagggagagcttgacgagaataaagcagtcatcaggaagaaacacttcttcaatatactcggaaatctggagtgtcaaaagatcagactgttaatcagccgctttcccctttcctaagagcacacgactgcttgcttttttgaagagcttgagtagtgtggacgccacaggctggtcaatagatggcagctgatttttacacttccttgcaacattgctgagctagttttcttgttatcaatagggatttcttcttacctctcccaagagggttttctcaattctccctttcacgaggcgagcataatccgcgtcgtcatccttgtctagctgtgctgtgataattggagtgctgttgagaagcaaaggaaaaatggcactagcacaagggaggaggctgtttgaggactactgctttgttaaacccaagtgctatttagaatcataatgttactagcaaccccagtttactgagcaagctctgcctcccaggttcatgccattctcctgcctcagcctctggagtagctgggactacaggcgctcgccaccacgcccagctaattttttgtatttttagtagagacggggtttcaccatgttagccaggatgtcttgatctcctgacctcgtgatctgcccgcctcagcctcccaaagtgctgggattacaggcgtgagccattgcgcccagccgactatctttcattcaatgctacgtattatcattttgttaaatataggtcataggtaaaaatcattatttttgtcatcgaaggcattgtaatacatttctatttcttctagccttagatcaactagaaatcccatcatgaaatcaccaggggctcacagaatatgaccacagggcaagtggcagacatttcagtcaggcctagttaggctggaataatgacatcaaaaggatgaaatctccactgacacattgctccaatttttccagtcattttaaacattttctctcttcatgttacttgtggccataacaaaaccattgcttctattttgactgtatccagtttagactttttcttgagtggcttttttaaaaaccaaaataggattaacacagcaagcatgccacccagagtttaagacacagtcctatgaggatatcacacatatgcatgtgacacggggatcattgtttctcaggaaacaggacaggcatgtgtggaacaagaaggaaatgaaagcaggcacctgatggccttggaagcgttgatgatctctttaatccggggcacgcccagggtgatgttcatggaggccacacctgcaaagtggaaagtcttcagggtcatctgggtgcctggctcaccaatgctctgggcacacagagcacccactgcagaacctggctccatctgtgccctagaaggcaaaggtatggatgagattgcagcatgccaaagaaaagtccagcaaaactgctggggagaggcttctggttatcacctttcaacagagaatatagatgctattagggtcggaaagggtatgtctgtgacagagaaaaagcctggcatagaccagaaataggtacagacaggggaaagtaaaggtcagagagggggcagcagtgcaactcaattctgcatggctgcttgtggtcagcatgtaatggatgcagaaaatctaagcagtctgctaaccaatggtactgatggcaaacagagcagtggcatctgccatattcgttagcagtttccccatggggagaagacactaagaaatttccttgcaattatttccgttatcttggagcattcagactggcaattcatcagaccccctacagaaaatgtgacagaatctgatcaaatactggcagttaacaagtgagctggtgcagggttttgtacacatggggaaacagaagggatacgtgagacctatgtggatgaccgtcagtccaagacaaaagcatccctacctcatgtacttgtccctacaggtctccagaaacttttctacttgggtgggggtgatgcggtccagctggtacagcacacggggctgggagaatacaagccaagcacagagttagggccagcggcaactacaaacagctcggggttctaacgcgtcttggagggatattacctctgttgtgccgttatcattgatgccatatttatctctggttttcttgatcttctcagagacccccttaatgaatttttttatttcctgaaagattacacagcaaacatcatttgtaagtttcacagtcatgcagatgacataattcatttcataaacctcagttgtatatgacaagtccatcatattttagtgttagctccatatatagtataaaggacccaatctggatactgcttctactacaaagtggttttccaaggaacacaccacactgtccataccccagacacacactccattggttaatgtgtctctaagaccttctcctccaactgctctcatggcactatctacagagcccacaaagtgcgtgggagcctttgttcttgctctcccacgtgccacgagggctataagaacacagctcaagacaggtacgactgaagcatttatactgttcttctacagattaatttttgagggtttcttctgaaggtattatgctcagtttaaatactaccaactaaagcatagctttgttgacagtaaatgcatttcaaacacactttgagcttaccttcatttcaaagaaaacactccccaaacccagcttatcttttcccctctggtaaccacctctccccacaggcctaggcctacactgtcttcccacacacaattagaagtctgtaaggattcctggaaaccattgtcaaagccagatgtgaagcatcagtatatgctgcgattcccactgtatttaagaacagcactctcagccccgggaggatgaccaagtagagcaagaagaaggtgaaaaatacacaggtggaagatcagagcagggctagagactacagccctgactcaggttttctggcaaccactcaaatgggtaaaactatctgttttaggatttacagtgtgtctgtgaaatagacccagcccaccaccactcctaaagccaggatcagccagcaccttcccctggagagtgctcacagggaaggagcacttacagaggagcggttaacatcctgctcacagtgggtcaatcatcacggactacagactggctcttaaagcaattctcagggtgagctgatggcacctgccatgtagtagcaaccatcctccagaggccattatcctgccatcccgggagctggcatcggctgctctggtgtggcctagggatgatatagtctctgagaatatggggaagaggagatagactgcccctcctttgtagcagcaaggaaatcacagtggcggtaagcttgaatggcactctggccaaatgcaggcattcagctgctctgtgtgtctggatgagtacagatgcccacacatggaggacaagcagcttgagggcagactgcgtactgtggtggccgagaagcctcatgaggttctgtttcttgattctggggtaggctgagggtcccccagagagaaggccagcatgccctgcccaaagtccactcagcctattacatggctgaaaatgcctaagcctgaaccaggagcccatttctgcaaaaataaaatcctataaggtatccacagacagcttaagacttcctagccccattctatcctaaccttgcaaaaagaaatctcattagcctcctaactagccatttctagttactaccctttctacaagcaaactgctagaactttatgttcctgttaaaatagccttagcatctgtgtccacatggtcttatgcctttcccagccagctgctgcccagcttggcaagacctcactgtgaggtggcatggctttagccccaccaccctagagcagaaggcactgaaggcctgaatgaggtcagcgcttggccaaggcaaccaaccactccacgaagtcagatgctttcttcaaagtcttttctctgaacaggggtttcttcgatgtaatctttgcctactgggaaattccgtctgtctcccaggagcccaggcagccaaggggctacctcgggggcccaacacatcctggctgtcagttcccatgaatactgctttctcatgactctctgtgttggcccactctctttcttcccactgagaaagtgcagaggcccacggagggtgaccctgcagcccaatcattgttctacatagaaagggctttttatttaagaagttttaccagctgggtgcggtagctcatgcctgtaatcccagcactttgggaggctgaggcaggtggatcacctgaggtcaggagttggagaccagcctggccaacaaggtgaaaccccgtctctactaaaaatacaaaaattagctgggcatggtggcacgcacctgtagtcccagctatttgggaggctgaggcaggagaatcacttgaacccaggaggcagaggttgcagtgagccgagattgtgagactctgtctcaggaaaaaaaaaacaaaaaaacttttattaattcgcaagaactttagagttctcaagaaactctttttaaagagaaactctcctgattccttgttattaatgatgagtctgacactgtgttttcagatacagttaccttttgcaaaccagagatgaaaaataaagctgtagagggcagtgggacaacctcttctggcatggctctaacagaatattcaaaggcatttgcacttgctgccactgaatttttcctctatatattcagtataagagggggctttgcctggcagtggctgggtccttttgagaaaggtcccgaaagccctcttggcccagatgttgccatttgatcaccagttgttaaaagctgccttacctgttggcacaggaaaaacaggagcagaacctaaggccaagccttagacccagaaggttttcatctgcaagggactgtgcacacatagggagtaaaattaacacacctaaaacaatctgccggcttaggcactgggaatgacatagctcagctttcaccccaatggacacatttcccgtgggtttgctgaatgactttccctacacaaaggttctggaaattaggtttaaaaataaaaaaagaaaaacagctcactttttggaaatgaaaactgaaacaatctgctaaaaattcacactgagtcaacccatgcatactagagggaacgaactcacaacatggctattggcaggcaattcatcacacgattaaccagaagttagtgtctcatgctccacagcaggcctatgagcacgggcattctcctctggcagggacctgggctcaatgccactcaggagtgcctctgtcacctcagctctgatacgggctagggctggagaacatttcacgggctcagacacatctgttctggccagtggattttggaccctctcagcaaatctgagctcatcggattgtgagctgccggtggcaaggacatgtttagtcatccttgcatccccaggatctgtggactgtgtgacatatggtgagggctaaaccagtgctcactgaataaacaaatgctgccgggtaggaggtcacctgtgttaaaccttttcaagggcaagaaaggaaccagtccaaagcaaagcagtgtttgccagaaccgggacagaaacctgctctctctggcgctggcaaatgctggggtgctgctggagtgggccctttctgttggcgttcacagcatgctaagtacgttacctcgttatagctttcataacctgtctcagttaaggtctttgaggacaaacagataaatacgtaaacatgagcgtgaagaaaaaccaaattacaactctaatttgttagttaaaaaaaaagaataagaaagcctttggaggagaaaaacagacaaaggcacccagccttgccacactcttgattttaaaatctggaagagtctctttttcacctttcacaccttgacacatgaacacaagaagcgaggagcttccttaacacaaatattcttatttaagcttcactcgctgtttttatttttgatctacggaaagagatacattcttctttggcctgctgatcttgtgctacatttgaattactatttagtacacaaaggaaaccatttactgatttctgtatccctttgcttttgatcctaaccatgattataaacatgaaggagctgcctgagcaggtcagaaccataaaaaaaaaacaaaaaacaaacgaaccaaaaaaccttaagagggtatcaaagtaacagctccctggaagaatagaaaaggctgattcaatggatttttgatccacaatacagcaaaagaaagagcagtttaaaataaatggtatcaaaacaagactactagtactaataattattgggattcagaatgattgagggaagagttggctcacaagatagagtaggtagtaggctggtgttagggacagcgctcaaacaaaatcagcatttttcttctaacaggggaaaaaaacatttttcttctaatagggaaatggcttgagtgaaagacataaactaagaaagtcatgagataaattctgcttgttggctggtgagattttgccttggccatttttgaatgactgcctgtcatttttttttttttttttgagatggagtcttgctctgttgcccaggctgaagtgcagtggtgccatcccggtgtactgcaacctccgcctctcaggttcaagcgattctcctgcctcagcctcccgagctgggattacaggtgcccgccaccacgcccggctaatttttgtatttttagtagagacagggtctcatcgtgttggccaatctggttttgaactcctgacctcaagtgatccacctgcctcggcctcccaaagtgctgggattacaggcatgagccaccatgcctggcccattcttgaactttctaacaaaggaacaaccctaccttaaaaaacaaccagcttataaaatccacttgccagcccttggcaaacagagttctttacgacagccaggctgggtgcagtagccagcacctggcagagctcacctgcaggaagctgtcctggcagcagaggaactcactcttcttcatgatggactctgtggtcaggatcagctcgtttttgctgagagcaggctcactgggacacgggaagactgccttgagtattaaaagaaaattgcattatgtgtgggtgccacagagagcaggcggtagtagatgagagaacttacaaaggataaaatgaccttacccaaggtgagcttttagcaacctgtgatttttctttcaaaacaaattgtggactctacctttcatgtgaaggtgaaaactggataaatggatactccatcctatgcaaaaatttctgggctattcagcaggtgttgtcccatcacttcccagccttcgccaccccactgccccccaccagatttacattaaaaatataagctgttatttaaaaaactcaaacatttcaagagtgaaaatattctcccacttctgaagctcataaatttctcttttttttgagatggagtcttgctggattgccaaggctggagtgcaatggcgccatctcggctcactgcaacctctgcctcccaggttcaagtgattctcttgcctcagcctcccgagtagctgggactacaggcatgcgccaccacgtacgattaatttttttgtatttttagtagagacggggtttcaccatgttggccaggctggtttcaaactcctgacctcaagtgatatgaccgcctcagcctcccaaaggactaggattacaagcgtgagccccagcagaatttcctcttttttcctctcctctgctttgtccaagttgactcaatgttttaatggctgcattattattcttttgtatagacagaccatcatgtatttgaactatcctctactgatggtttgcctttactgtaagcagcgtagaaaaaacattcttggcatagttagaccatttctagaggacaaaaggagtttctgtaagggaaactactgggtcaaaagggacacgtatttaaaactcagaatggtattgtccagctactctccaaaaaggttgttccaagttatattctcaaagtatgtgaagtgtgcctgcttttcaatgcccatgacttataaaactggtctctagtatgctctacttgacacagagcgaaaccaaacaaagccctcttctgttggcatttgattactaccaacactagactttcaactgaaaacaactttttttttcatcttttttttttttttaagacagggtcttggtctgtcacccaggctggaatgtagtggtaagatcagctcactgtggcctcaaattcctgggcttaaggattcacctgccccagcctcctgagtagctggaactttaggagcatgccatcatccctggctaattctttttttttttttttttttttttgagatggaatctcgctctgttgccaggttggagtgcagtggtgtgatctcagttcattgcaacctccaactccctggttcaagtgattctcctgcctcagcctcccaagtagctgggattataggcacgtaccaccacacccagctaatttttgtatctttagtagagatggggtttcaccatgttggccaggatggtctcgatctcttgatcttgtgatctgcccgatgtctggctaattctttaaaaaatatttttttagagatagagtttttcctctgttgcccaggctgacctcaaacttctcgcctcaagtgattctcctgccttggcctcccaaattgctaggattctaggtgtaagccactgcacttggcctttttcctttaaatattggaaagtaaaaaaaaaaagcaaaacttttttcttttttttatagagacggggtctcactttgctgcccaggctagtcttaaactcctggcctcaagtgatcctcctgccttggcctcccaaagtgctgtgatcacaggcataagccattgtgcctggcccttcccttttaatatcggaaaattatacagagtaacacaaagaaaaaagatactaatccagtgcttgggattataaatactgaagtatttattaactgcaattgatagtccaaacagtacttccgtcctaaagaaacatccttaaaaacactctaaccccagatataatgctaaatcttactttgatgttgtccagaacccttttaaactccaaaggttcatcttttccctccatagctgcaggatctaagccatctcctccataaatgaactggataatatcgccagtagagcttcggactgtcagatcatactgggagcaaagatcttcaagagatttgacaagccttcgctaaaggaaaaggaggaaaaagctcagctgctttgagaagactagtcacatggggagaggataagatttgcaactcaagagtctcaaggttacaagcactttaatcacataaaaatactttattagaaaccctttaaaaagagtcctctcaccccaagaacaagagcaagaatgccttactagcctgtgcagtgggatttggaatatgctccaacctccaacattttagtgtattttagaacacatgcaatttaaaccgcatcacccacaaaggactctgcaactgctgttttcctaggctgttttaccttccttctctttctccctaaggtataaattaatgcaatagctttgcatttctaaacagaacttaagccaggacccctgcagacttcaatatgaattacggaggatcaggtgcaggccctcttctgggacagagggggaagaagagagaacagggacagtattgtgtctgaaccagcaggcagcaatgacttctcaaatctgcttagggagaaccgtccaccagctgaacactccagccagcaatgctatggtggctcagtgaattaaagagaaggaaatcttcctctaggcaacttcaaaacaaaaaatcccttatgccagaactaatttagtttacattaacacactgctctggcaaagtcatactctctaattcaaaaagtaaagacaaaaaaattaagtaaaaacacacattatgacaagagtggtaaaagtatttcacagtctattgggtttctgacaaaagcagcatgctcccacactgaagggcaatttcccattgaaagatgattaattgtattccatggatgacacacacaaaaaagacgattaaaggtatcagatgatacacgagctacaggagagatgatggaaataggcgtctactgacttggaaataggtgtccactgtcacactaatcacagtgtttgttctggcccactcattcacatctctggtttatctaccctggttttccagcttgcaaagggccatgcttccatagtagggagagagaagacacaaagccacagcaagttcatggcccagcaacttgtagtgttgactttatctggtgttttaagtagttaaaaacattacttaaaaaaaaaaaaaaagcagaagactcagtagccaatgcgatcaactggaagaaagggtatcagtgatggaagacgtaatgaatgaaatgaagccagaagagaagtttagagaaaaaagaataaaaagaaatgaacaaagccttgaagaaatatgggactatgtgaaaagaccaaatctacgtctgattggtgtacctgaaagtgacggggagaagggaaccaagttggaaaacactctgcaggatgttatccaggagaacttccccaatctagcaaggtgggccaacattcaaattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtggggaccaatattcaacattcttaaagaaaagaattttcaaaacagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaataaccggtaccagccactgcaaaaacatgccaaattgtaaagaccatcaaggctaggaagaaactgcatcaactaacaagcaaaataaccagctaacatcataatgacaggatcaaattcacaaataaaatattaactttaaatgtaaatgggctaaatgctccaattaaaagacacagactggcaaattggataaagagtcaagacccatcagtgtgctgtattcaggaaatgcatctcacgtgcagagacacacataggctcaaaataaagggatggaggaagatctactaagcaaatggaaaacaaaaaaaggcaggggtggcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatatccaggaattgaactcagctctgcaccaagcggacctaatagacatctacagaattctccaccccaaatcaacagaatatacattcttttcagcaccacaccacacctattccaaaactgaccacacagttggaagtaaagcactccttagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtaaataatgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatctaaaattgacaccctaacatcacaattaaaagaataagagaagcaagagcaaacacattcaaaagctagcagaaggcaagaaataactaagatcagagcagaactgaaggaactagagacacaaaaaacccttcaaaaaattaatgaatccaggagctggttttttgaaaagatcaacaaaattgacagaccgctagcaagactaataaagaagaaaagagagaagaatcaaatagatgcaataaaaaatgataaaggggatatcaccaacgatcccacagaaatacaaactaccatcagagaatactataaatacctctatgcaaataaactagaaaatctagaagaaatggataaattcctcgacacatacatcctcccaagactaaaccaggaagaagttgaatctctgaatagaccaataacaggagctgaaattgaggcaataattaatagcttaccaaccaaaaaaagtccaggaccagatggattcacagccgaattctaccagaggtaaaaagaggagctggtaccattccttctgaaactactccaatcaatagaaaaagagggaatcctccctaactcattttatgaggccagcatcatcctgataccaaagcctggcagagacacaaccaaaaaagagaattttagaccaatatccttgatgaacatcgatgcaaaaatcctcaataaaatactggcaaaccgaatccagcagcacatcaaaaagcttatccaccatgatcaagtcggcttcatccctgggatgcaaggctggttccacatacacagatcaataaatgtaatccagcatataaacagaaccaaagacaaaaaacacatgattatctcaatagatgcagaaaggcctttgacaaaattcaacaacccttcatgctaaaaactctcaataaattaggtattgatgggatgtatctcaaaataataagagctatctatgacaaacccacagccaatatcatattgaatgggcaaaaactggaagcattccctttgaaaacgggcacaagacagggatgccctctcttaccactcctattcaacatagtgttggaagttctggccagggcaatcaagcagaaggaaataaagggcattcaattaggaaaagaggaagtcaaattgtccctgtttgcagatgacatgattgtatagctagaaaacccaatcgtttcagcccaaaatctcctcaagctgataagcaacttcagcaaagtctcaggatacaaaatcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactaaaaaccactgctcaatgaaataaaagaggatacaaacaaatggagaacattccatgctcatgggtaggaagaatcaatatcgtgaaaatggccatactgcccaaggtaatttatagactcaatgccatccccatcaagctaccaatgtctttcttcacaaattggaaaaaactactttaaagttcatatggaaccaaaaaagagcccacatcgccaagtcaatcctaagccaaaagaacaaacctggaggcatcacgctacctgacttcaaactacacaaggctacagtaaccaaaacagagatatagactggtaccaaaacagagatatagaccagtggaacagaacagagccctcagaaataatgccgcatatctacaactatctgatctttgacaaacctgagaaaaacaagcaatggggaaaggattccctatttaataaatggtgctgggaaaactgggtagtcatatgtagaaagctgaaactggatcccttccttataccttatacaaaaattaattcaagatggattaaagacttaaatgttagacctaaaaccataaaaaccatagaagaaaacctaggcaatagcattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaacatccagaatctacaatgaactcaaacaaatttacaagaaaaaaacaaaccccatcaaaaagtgggtgaaggatatgaacagacacttctcaaaagaagacatttatgcagccaaaggacacatgaaacaatgctcatcatcactggccatcagagaaacggaaatcaaaactacaatgagataccgtctcacaccagttagaatggcgatcattaaaaagtcaggaaacaacaggagctggagaggatgtggagaaataggaacacttttacactgttggtgggactgtaaactagttcaaccattgtggaagtcagtgtggcgattcctcagggatctagaactagaaataccatttgatgcagcaatcccattactgggtatatacccaaaggattataaatcatgctgctataaagacacatgcacatgtatgtttatagcggcactattcacaatagcaaagacttggaaccaacctaagtgtccaacaatgatagactggattaagaaaatgtggcacatacacaccatggaatactatgcagccataaaaaatgatgagttcacgtcctttgtagggacatggatgaaactggaaaccatcattctcagcaaactatcccaaagacaaaaaaccaaatgccgcatgttctcactcataggtggaaattgaacaatgagaacacatggacacaggaaggggaacatcacacaccggggactgttgtggggtagggggagcggggagggatagcattaggagatatacctaatgctaaatgagttaatgggtacagcacaccaacatggcacatgtatacatatgtaacaaacctgcacgttgtgcacatgtaccctaaacttaaaagtataataataataaaattaaaaaaatacagttaaattattgagtggagagtacagggattgaaaagacatcttttgcctgtggtcttatggaagaacacaagaagacgtatttttcactcctctgccattagggtacttttgtggtaaagtttgagaagcacaaatgctgagaagcctctagtttagccctgtgccccagagtctattatctcagagctatacactctctgaggaaatgctttccttctaagcatccaagccccgcagcaagcactggaataggtcattagagttaattagaatgatattaataatgagttacataaatagttgcaaagagagaggcagaggccttgcaataaccctcattgtcacgtgttagtaaagcgaggcttagtgaggttgaatgacatatcccacaatgtacttccatccatgttctcctctaacagcgctttgctatgcgtggctctggcctggtcttgatcatcataggatgattcggaacatactacattttttttggttgttcatttccagggcatctacctttctacattttttccttttaaatttaacccaagactagataaattacagctcatgtgcaaaacgtgtactcaatagtcaaaacccacagagctctgtcctgctctgttgctaatggcctacatttcttcaggttacctgcatgtatcccgtttcagctgtctttacagccgtgtcgactagaccttcccggccggccattgtgtggaagaaaaactcagttggtgtcaaaccggaataaaagctattagccacaaagcctttggcagctgggagctaaagagaggtagaaaaaagaaaaatcaaacaaaaaaagttcaaggcccacgattctgaaatccactcaaatcagaaaatgccccaccttgagactataaatacctggccagtatattctcactaaatggcaggctttctttgccctttccttatggagaaatactttataccagggacaaggagaatgagggcccagccagggctggtgctggtgccagtggcaggcaagtggcccaagagagggaaacctaagatctggatgctctccttaaaataggcaagcagtcaaggacctcagaggacaccctgtggatggaggctgcctgcccattccctgggaaatgacaccttcaagatatccttcctgtgggccagacctgcccacctacaaaacataaccatgcattgtcaatgtctacagggtttcattctgggcactgaaaatgttctaaaagtaggttgtagtgatggctgcacagctctgtgattaacagtcactgaactgtgtgccttacatgggtaaattatatatgaagtataattgtaataattacatatgaagtatatatgtatttaaagtttatttatttgtagagatggggtctcgctatgttggccagacgaactcctggcctcaagcaatcctcttgccttggcctcccaaagtgctagaatttcaggcatgagacactgtgcccggcctgaagtgtatcttaataaaatggcaaaaaatacatatataaaactccacatgaaattggccaacggtctttgatctgaataggtctgtgttccttggaggaaagtgtagattaagagatcttcacagttctacctgatctgctactgcttacctttgagtgtttttcaaaatgaggcaaggacctgttttcaaagccgtctggcactcgagagccactgatggcctgctgtcccacacaggcaatcatctgtgatatgttaatgaaggaacctggggacatggaccagaaatgtaacattcatttaccaaaataacactaattgaagtgcatgcagattggaagggtaaaacaggaataggcccttatgctcaatgaggtcatggtcctggaacagtagaagacagaaatacaatcaagacaacaaggagctgtcaggaacccaagaaaggcggaacgacggcgagaggagccaggagcatgtgtgggttggaggaaaggctggggaagtgacaggtgagtcttcaaggaggcttcagcaagtccaggttggactcctggaggacattatgatttggacataaagggagagggggaggaattccaaagtgggtgggaaagtaggaagcaaagacagagaaatggaaaagtgtgggctatgtcctgagggtaggaagcaggagagcaatggggtaaaaggcagcaaagttaaagagactggactttatcctgtttaaaaaaaaagtgtacagaaatagaagcacagaggttttgaatttgaatgcattatcataaaaccaaatgctttgagggcctcggtatctacaaaatagaagaattatgccacatcattaagtacattaaaaaatccctggctttcttctgcttcaacctgcctgacctgctgggctcaagtgatcctcccacctcagcctcctgattagctgggacgacaggcacaagccaccacgcccagctaatttttttttttttgtattttttgtagagatggggttttggcatattgcccaggctgatctcaaactcctgggctcaagcaatcaatcggcctcggcctcagcctcccaaagtgctgggattacaggcatgagccactgcatctggcctcatttttttttaaagaccacgttgctcaaagcaccctcaaactcagaatccagacacattaccaacaagttccttcaaagcagttaaacttcccaaaatgcaaataattaagtctctctctctgatttaaaaagatcccttaaataaatgaaatgtctgtttggagctgtgactatcacattttctggagccaaacagcctgtacggagaacacactgccagcaggtgagagaggggcatgcagacctttggagccgcacagagccatggtgagggggctgttgctcttgtccagctcccggaggcaggcactgccagcgtggtcacggatcacagacagctccttcaggatcagtgcctagtgggagaaaaggagatccttggtgggttgtcctcattgtctctgtggattacaaatgttcaatctaacatttaaagaaatttgaaaatactgaggcaagatgcccgatttccgatcagtaaatgtttcagaaccttagaggagcaaaatgccctggctatatgaacatgtacatcttctacaaggttctaaaattggtgtataaggcaaacagtttatcttttttttgtttttgttggagacaggatctcactctgttgctgaggttggtgtacaatggcataatcacagctcactgcagcctcaaactcccgggctcaagtgatcctcctgccccagacccctgagtagctaggactacaggtatatgtccctaccaggcctggctaatttttaaaattttttttgtagagatggggtcttgctatactgcccaggttggacttgaactcctggcctcaagggatcttcctgccttgattataggcataagccaccaagcctggcctaaaattgacagtaataaaaacttgaagaatcctttaaatggcccataaggtagaatgtatggctttgtgtatactaccctacacaacaaaatatctgtatataaatagctgtgtggacacacacatgcaccccatacaaatatataagataatatgtggtatgtaaaagagaattgcctgtactatttgtaaatttgtctttctactttttcttgccaagcacacatctgaatgtctgcaagctaggcatgtgatgaggtgacttcacaagaatattccggctcatgagctcatccacagttactcctcaacttacaaactaggatgctgaatcagttacaagtctggttccatgaaaaattgctgctgccgaggtctcaagtaattttctaggaggtaccggtgagggatatccttttctctctctctaagactcagtaagattaagaatgagctaatggtaaatacctcacaaaattctggtttctccctgctttagaaaatgtatttcattagaaaacttcccaatgcttaaagagcctttcttccacactcaggtgagtcaaagctcagtgccacgggtttatcggtgaggcagaagacggccaggtgaaagcctggtgcactcagactgctgagggagtttcaggttctcacaggctggtggtgattctgattctgacccatgctggttgagatcttagctaaaatagtttcaaatgaggggcagcaggctggggatgtgactattagacatgaattctccctcttccgcatccaagtctctttcaaagaccatacattcaaagagctgtggtgaggctgggcacggtggctcatgcctgtaattccagcactttgggaagccgaggtgggtggatcacctgaggtcaggagttcgagaccaggctggccaacatggcaaaaccccgcctctactaaaaatgcaaaaaaaaaattagctgggcatggtggtgggcgcctgtaatcccagctacttaggatgttgaggcagggataattgcttgcacccaggaggtagaggttgcagtgagatgagattgcaccactgcactccagcctgggcgacaaagtgagactccatcttaaaacaaaacaacaacaaaaaaactggctgggcgtagtggcttacacctgtaatcccagtactttgggaggccaaggtgggcagatcacgaggtcaggagatcgagaccgtgctggccaacatggtgaaaccctgtctctactaaaaatacaaaaattagctggtcatggtggcatgtgcctgtaatcccagctacttgggagggtgaggcaggagaattgcttgaaccagggagtcagacgttgcagtgagccaagatcgtaccactgcactccagcctggctggagtgcttcataaaactatgaaaagcgagactccgtctcaaacaaaaacaaaaacaaaaaaaaccaaacccccaaaaaccaaagagctgtggtgtcagtttctacttgaaggatgctgaaaatagaaaaggcaggagcactcgagtaccagttacagaagggacctgagtgtgccaccagaacaagagcagcctcgtgtggccgaatgaacagatggctatgttttcaccacctggatgtgaaagttaggagggacatgaggatctgatgaaaggccctaccctcaggaaacaaacaaggacacacacagtgagcccagggccccaacaggacagacgaggacatacacagtgagccctgggccccaacaggacagacgccaatgccttgacttgcccactcctttgctacctctattcatggctcagcacaaccccagagagcaccaccgtagccactgtgcacggcaagtggcgaccctgaaccaaagggccgggctcacctccagggtctcctcagcagtgcagccaggctgctgctgcagcttgcccgtgttcagggcttcgatgtactcatcacatttcttgtagccggcattcagcaactcatacttggccttcagcagtccttggccaggtgtgacatcaccgatcccaattgagaaaccacggttagctgttgagttggtagagcaggaagaaagggccataaatgagactcagcaaacctactaaatacagtttatgcctgctagatatagtttgtactatatataaactatgtatgtatagtttaaagtataaaaaagtgtatatcttcacagaattcatcacaattcaattaaataatggctttctttctcagtcattagggagttacacaaaatgactaggactcaactgacttctctcagagaccttacgatctggtggggaaacacaataccgtttccaactattatctaaagcagagtgacattaaacactaaagggtggcctgagggctgggtgcagtggctcacgcctataatcccagcactttggaaggctgaggcaggaggctcgcttgatcccagatgtttgtgatcagcctcatctctacaaaaaccttaaaaaattagccgggcatggtggcacatgccagtagtcccagctacttgggaggtggaggttgcaatgagccataatcacatcactgcgctccagcctgggcaacagagcaagaccctgtgtcacacacacaaaaaagtattctccaactttgatggaactaggtgccaccattgatcctagccacaatatactgtatgtagaaataaagagagtgaatgagtggcttctggcttagcaggataggaaggtatgacctacaagtatctgtagatgagaggactaatgggcctggaaaggctcagaaatgagatcattaggttctgcaactgctggaaatgatgaatgtgctggaaacaaggaaacctagtggaaagtctgtataaggaaggctccaggcccttattcctgtaggagatgggagttcgctcccagcgaaatggaatcagagaggctctgggtctgggaataccaggcagatgaaataactgtaaacaagagcactgagggaaagtctgtatattccttttatataaaaaaactgagaggtccatcaaccagtcagctccatttccaatcagtgtttcagtccttactcctcaaggaccaccagatatttgaggaaagattttaacatgaaagacaaaagacacaaatgcacaggaaaaagaaagtaaaaggatacagaaaattcaggaagcaaatataataaaactatgaataatattctctcagagtgatcagagaagatacattcagggatcaaaacaagaaagctttaaaaacaaaacagcctgggcatagtggctcacgcctgtaatcccagcactttgggaggccgaggtgggcagatcacttgaggtcaggagttcgagaccaccctggccaacatggtgaaaccccgtctctactaaaaacacaaaaattagccgggcatggtggcaggcacctgtagtcccagttactcgggaggctgtggcaggagaatcacttgagcctgggaggcggaggttgcagcgagctgagattgcatcactgcactccagcctggcgactgagcaagactctgtctcaaaaaaaaaaaaaaaaaaaaaaaaaagaaacaaaaacactacctgtgaataagtatattgaaaaatagtattggaaattaaatacatgacagtgataaaattttaaaaatcaacagaagtattaaaagataaagtgaatctagaataaagaaatggcaaatggaaaagaagataattagataattaatctaggagttctaatatgtaattaactgaagttccaaaaagaaagaacagagaaagtaaaagagagaaaattattaaagaaataacataaaatttcccgaatggaaggacacacagctgcagattaaatgaaattactcagtgcttagcacagtgaatgaaaaaagacccacaccaaaggtatattgttgtgaactttcacagtgagaacagagaggattctgaaagtttctaaaatgaaaaaaacaattcaagggccaggcatggtagctaatgcctgtaatcctagcactttgggaggtggaggcaggtggatcacttgagaccaggagttcaagaccaacctgggcaacatggtgagacttcatttctacaaaacttagttgggcatggtggcacatgcctgtagtcccagctgctcgagaggctgcgtgagccaagatcacaccactgcactacagcctgggtgacagagcaagaccctatcttcaaaaaacaaaaaaaaatcaaatacaaaaactggggaataagaacgacaatacctgttaacaacaactctgaaagcaagaagaaagtagagcagtaccttcaaaattctgagggaaaataattttcaatctaaaattgtatacccaggcaagtataagagtggaataaagttttgggggcatgcaaacatcacttgactcatggcccactcaaagcatgagcaaacaaacaaacaaacaaaatagaacagtgaaagcatagtaggcaaatattgagtaatcttggagaactgaatcatggatagccccaagtgttctagtgcttccacagggaccttggaagcagcccatcaaggatggtttataatctaaccctgtctagaagaccgtagggagctactgctggttttgagaagagaactgaaaagcaaattcaaatctgttgtgaaactattcagtactgagttaatttaattaataacagcacacatgatttagcctggaatgagtatctttttctgtatgtatatgtgtggtggggatgaaatggcagtaaaagaacaaaataacgtaaacccttaagactctaacaattgcagctttaactaaaagaaggatgctgagatacttacacaggtagacaggagccagcctggcgagccgtgacatggcatctgcagcttcattctgtccccagtctcgcagcaaaatgtaaaaaatattgttcttggatcctgaccctagggttcctttgtccatgctgccactcatcaactcactgttctggattgtaacatctggaagaatgattatatatttagacaacaattatttattactttgccttattccaaaatgaatttgagacagttgagaaaatatgttcccatactgacacttaaagcagaacaaacagaaattctcctcaaagcttttttttggggggagggagggggggttaaaggaaaacttgggaatttttgaaaaatatagaaactccagttagtgtgtagtcctaaccctgaaatataccagttgaccctcactctcctcatctgtgaactgtgggtaacagtatcaagcacttgtcatctttatgttatgggatattttgagcatcagatgaaataacatacagtgaagtgctctataaactataaataatttgttactcatataagatattaaatattaacaaaggtaccatcatgtacagcctatacaacaaccaaatgaaattcatatccaaaaagaaacaaaacagtctaaaacaagaagctgaagtattttgaagatcagagagcatatttccaaagaaataaatctgaggagtatcagtgcccttcaaaacatttgctcttcattagaagacagcagaaatcctgaccttcagaagaactctgcaattcagttcttcagtacagagtcctggagatccacttctagtcccaaggtctcactagcaaagcccattctaaatcagtgctactcaaactaggctgctagggaactgtttggtagtggtctgggtgagtgaacgtgctcacatcagaaagtaactcaatggatgctggctaaacagcagggctctgtggactgcacttcgggttgaactggtttagacagactcagatgacttgcatgtaaatcctttccctggctgggtgaggtggctcacacctgtaatcccagcactttgggaggatgaggtgggacgattgcttgagcctaggagttcgagaccagcctgggcaacgtagggagaacctgtttgtctttgaaaaaaaaaaaaaaaaatcaatccaggctgggtgcagtggctcatgcctataatcccagcactttgggagggcaaggcagatcacttgaggtcaggagttcaagaccagcttggccaacacggtgaaaccccgtctctactaaaaatacaaaaataagccaggcatggtggtgggcgcctgtaatccaagctactcaggaggctgaggcaggagaatcgcttgaacccagtaggtggaagttgcagtcagctgagactgcaccactgcactccagcctgggtgacagagcaagacttagtctcaaaaaaaaaaaaaaaaaaaaaaaaaattaaatgccttaaatagtaaaatccttgtttattgccccccccgccgccaaaaagatgacaaaatacagacaaactactaagtgagaaaaactagtcacttaagacaaaacacatttggagagaacattctaaccactgcgtcatgtgtctacatgatctctacttttaagagaaatggggaattacatctgagagaagaaaaaccagctacattttcctgaagaaaaaactttccacctaaggcttacagaaacaatgaatttgcttgcttcgcgaaggtaccagcaaagctgatgaccagccacttgcttttctgtcacgttcctccttctccccacccgagttccgtccactcacaggaatcattggcacagagatcttcccctttgccacagtactgcttgcccttggttcgcaggttggccctcactggattgtcatcgctaggcctgaggatgacactgaagatctgctttcccgtccacagggtgacaggctgagggggggaggaagcctgagagtcagtgggctgagcctggtctcaatcccccttcagtagacgaagccaggcggcctagggactgcactcaagcctagcaccaacacggttccactcatttcaccagtctacccccacagacacatacacacacctgtgcaccaacacacaactcccacacacacctttaggattgtaggcggtgggaggcgaactttaattttctcatccttgccaaccagtattgaagcaatgatttggcaagccttggctcgatcaaagaaagtgtccttgagagtgaggagataggcacctaagcattaggaaccaacacaaaacaaagaaaaggaatgaaattgtgagaatactgcaaggtttcaattttaaaataaatttgaaccatgaccaacagcgtgaattgaaacaaacagctgcttactggctttctcctccaactaggatctacctccacaggaacgtgactttgttttgttcactgctgtatccccaggcaaaagggacagattctaagccagacactaggtttagaaaatgcccagtccatgagaggagctcattaaagacttgctgaattaatgaataaccaaccaattaaaaaaaaaaagaaaaaaaaaaacccacggggaggttcatgatcaaacttagtaaacaaaaaaccaaattaaacacaggctattaaatagcttttcaagtcatcacatgaatcactatgaacgaggaacactgtgttccagtcagaaatctcctttcaagtgaacttcaccaacctacctgttagaaaatcctgaatagcagcaatcagcggttccccattcctcggggttacaagatttgctttagtctgtaggaaaagtaagcgcagtcagttagctgttctcggatgcatgatgcagcccaaagcctgaatcacaaggtttttgaatagttatgaacaaatacagagtagcagaaggacgaggctgagaaatgaaagccaggggtctgaatcccagctttgtcactaactcccagttcctttatctgtcaaggggagagaaaaaaataccagcaagattgacctaggagggtcctaccaacaccaaaatgaaatatcaagtgaagttgtttcagaattctatgaaaaactctacccatgtaagaagattttattgttgtttgtttttgagacagagtcttgcttatagcccaggttagagtgcagtggtgcaaatatggctcactgcagcctcaacctcatggggctcaagtgatcctcccagctcagcctcccaagcagctgggactacaggcccacatcatcatgcccagctaagtttttgcattttttttgtggagacggggtcttactttgttgcccagactggtctcgaactcctgggctcaactgatcctcccaccttggcctcccaaagtgctggtattacaggcatgagctactgcacccagccctattgttattactataggtgcttctccaaagaaaattcatttctgtgaatgatgaggagcgttgtgacctctgaagtcaaccaattccacacttgtccacaatgatgacagaactgttaaatgtcccttggttaagacattacgttctaataataatcaatccaacaacagaatttaattaaacatttaatgagggcctacgttgggcaaaaaagggtgttaggtagtaaaacataattaagtcatgtaaagaaggctctgtgtgtatgagagtacatttgctctaatcttgatatgaaaatgcacatgtgtatttgtgggttttctgggccttttcacccagaaagcagggtcctctcagacaaaggcccattaccacttacttctgagccactatccaaagcagggacccttcaaccagagtgggagacagctatttagccagatgtgcctcttcattgcacaccacctgactgctcttactcctggtttagagactctctctgaggtgggatacaggtagtctacggatagaagcagagtgcaaggggctgagattagtgtattttgaaaaggtctcctgggtaatttgggcccacatccaaattagagccctatgcactacacggagaacagcattgctaaatcagaacgataggtattttcttacttgaaattgaggaaacttgtccacatggtaactaaggattcttctaccccaaaatccttggagactttgttttattattgccatttgtaaccaatgaaatatgcagttgtaacacaatgtccacagtatggatcctcaatggcagagttgacagcaaagtctaaatggttggttgcaagctgatagctattatttcaagcagcattctaaacattactttttgttacaaaaataatatatgctcattatagaaaataaatctaaggccaggtgcaatggctcacacctgtaatcccagcatctggggaggccgaatcgggcggatcacctgaggtcgggagttcaagaccagcctgacgaatgtggtgaaaccctgtctctactaagagtacaaaattagctgggcatggtggcagacgcctgtaatcccagctactcaggaggctgaggcaggagaatcacttgaacctgggaggtagaggttgcagtgggctgagatcacatcattgcactccagcctgggcaacaagagtaaaactccgtctcaaacaaacaaacaaaaaaaaaaagaaaaagaaaaagaaaaaaaatctaaacgtatagacaacttaaaaccccaaaatgatgcatgcaatactaaaagcctaaaccaaaacaggttaaaagcatcacatcagaaatggtaataagtgattttggaggtagggacacttacaactataagacttaccagttcctaatataggaagctggaatactgaaaaaagaaagcctgaagctctaaaatactcagtagttggggatcatgaagttcaggaggagagaatcctacacagccggtgccatgtcccactgtgctattgctgggtcaggagtgaatagtacatgtagtgccaacaggttttttttttttcttcttttgagacagggtcttgctctgttgcccaggctgaactgcagtggtgcaatcacagctcactgcagcctcaacctcctgggaccaagcaatcctcccatttcagcttcctgagtagctgggactacaggcgtgcgccaccacacctggctaatttttgtagttttcgtagagatggagtttcgccatgttgtccgggctggtcttgaactcctgaactcaagtgaaccacctgcctaggcttcccatagtgctgggattacaggcctgagccacagcgccagcctgtgccaacagttaaagctcaactgtaagctccttaagagcaggcacgtgcctcactatcaccgatctcctgcagcatctactgggcactccttatgcatttgtcaaataaagtggtggtaagagttattatcattatgtataatactgcatcctctaagaagacgaagtatgtaatatagtttaggaaggtttccattcagaatgttcaataaaatgtgctggtgcttaaagaatcttcagctactggaaaatttacttaggtaggacatcttcttcccctgtgacagccaacattgatattgctatattcttttcttaccttgtcataactggccctcatgtatacattttctcccagaacccacatttataggccagaaaatcccctcaacgcatctgttacagaccctaactctcatgtatatactataatttctaagagattcttcaaaggctcaaaagaaaccaataaaaagagagatatataggcagttagtggtcggtttaagaacagaaagagcctggcttctttggcgttgttagttgtggtggtgttttcatgtaagtttcctttgcctcctttcaaggagctgttatgcaaaagctgggctgtgccaccctacatacccccatcagaacaagggcctctgctttagcttcttctgtttgaggaagatgaaggttcatttcatcaccatcaaagtcagcattatagggtgtacagacacactcattaaatctgaaggtccggtggggcttgaccctggcctgtggaacacaaaacaaaacaaaacaggaagaggacttaggcatttatccaaaagcttctctgttttgaaacattaaaaatggcttcctggaatactgggcactggcttaagaaagtagatttccagtatgttctgtcaagtgatatatatcatttaggactcattcccagtctggccaacatggtgaaaccccatctctactaaaaatacaaaaattagccaggtgtggtaacacatgcctataatcccagtaacttgggaggctgaggcaggagaatcgcttgaacccaggaggtggaggttgcagtgagccaagatcgcgccattgcaccccagcctgggtgatagagcgagactccatctcaaaaaaagaaaaaaaaaaaaagactcattcgagaagctttattagattgaaccaaagcagtgaatttcaacaaaggcgccagtgtgaaggctcccactggccaaggatgtcatggtttcaagtatcaaaaagattaacagcagaagttgattaaaataaaccaactaaataaaaacccatgtgtttataatgacactgaaaaaacagaaagtcaaaacaaacaaaaaaccccaatcaatctagttggaagttactgagcactaaccccctttttttttgagacgtagtctcactctgttgtcctggctggagtgcaatggtgcaatctcggctcactgcaacctctgtctcccgggttcaagcaattctcctgcctcagcctcctgagtagctgggactacaggcgtttactgccacaccaggctaatttttatattttagtagagatgaggtttcaccattggtctagaactcctgacctcatgatccgcccaccttggcctcccaaagtgctggcattacaggcttgagccaccgcacctggccctttctttaaaaaaaaaaaaattttttttcctaagcacacgaacacaggagagcactaagttcttacttcccaaaatcacaataaaggaaaaagacttaaccatttacacagcctttgctttatgagctgcacctctgggcaagcaaacagacctaattaacaagcgggtattttccattataagaattgtaggtaataaatgttaaaggaacgatagattcaaaaagtggggttccattttgcagcccaataaaataacacaggcaatgataacaaatgaattaattagaatgaattcattgcttgcatcttgactcaaacaaaccacaaaaagacaattttgagacaaatggggaaatctgaatatgaactaggtatggacctgggaatgccaagagatgactgttaattttgttaggtatgattacagcactgtggttatgtaagtttttcttacaaatgtaaactggatacatattgaaaaatgacacagatatgggttcatcgaagaaaaatgggaaagataaaacaagtgtggctaaaccttgaaaattattgcatatagaggatgggaatatgtaagttcattagaccattctttctactttagtgtacatttgaaaattttctttttctttttttgagacggagcttcattctgctgcctaggctggagtgcagtggcgcaatctcggctcactgcaacctctgcctcctgggttcaagcaattctcctgcctcagcctcccaagtagctgggattacaggcacgtgccaccacacccggctaattttttgtattttagtaaagatggggtttcattatgctgtccaggctggtctcgaactcctgacctcaagtgatacaccttggcctcccagagtgctgggattacaggcatgagccatcacacctggcctcaaaattttcaaacaaaaaaaatttctacttctttttttagagacagggtctcattacgttgtctaggctggagtgcagtggctatttataggcgtgatatagcacactgtagccttgaactcccaggcccacgtgatccttctgcctccgcctcctgagtagctggggctataggtgtgtgccattgccagtcaaaaaaacctaataattatattttgtaatgttccaaagccaagcaaaacattccagaaagagaaggctttagttaaccctctacattctcacaatcataatcccataatcacaaactacttcttagttatttctactattatgtaaatgactgatataatgtgttcagacgaccccaaaatgaatctatgaaaaaatattaccataagaggctgcttaaacactgtttgcaaaggctcatggattaacagctttacagataggagaatctatgaatattgaacaaattaaagctgtatttcatttccattttaaatctccagaaaaaggaactgctgctgttgcaaaactaaatcaccaaaaaaatatggtttaaggtcttagttggaggattactgcaaagaaaaaatcttttaagcattttagttgcttagttaatatgcaaagttaaatcaaaagtcaattttctggctaggcacagtgggtcatacctataatcccagcactctgggaggctaaggtgggaggatccattgagcacaggagattgcgacccatctgggcaatacaccaagacctcagctccacttattaaaaaaaaaaaaaaaaaaaaagggtgggcacagtggctcatgtctgtaatcccagcactttgggaggccaaggtgggtgaatcacctgaggtcaggagtttgagaccagccaggccaacatggtgaaatcctgcctcaactaaaaatacaaacattagctgggcgtggtggcatgcacctgtaactccagctacttgagaggctaaggcaggagactcacttgaacctgggaggcagaggctgctgtgagccaagactgcgacactgcacaccagcctgggcaatagagtgagactctgtctcaaaaaaaaaaaaaaaaagctggccatcatggcacatgcctgtagtcctagctacggtaggctgaggtgggaggatcgcttgagccgaggcggtcaaagctgcaatgagccagactgtgccactgcactccagcctgggtaacagagtgagactgtctccaaaaaaaaaaaaaaaaaatccattttctgccatacctattttatgtaagtttgtgcacacaacacatatacgtgtatatgtttttgtgaaaccatgctagtcactttcaattaaatcctctcttagtgttttgtatgaatattacgttgcaaatattaaaaatttaatattaaaaaatattaaagcttactaaaaggaagcttgaaattaaaaagtttcactcaaactaaaatgtgagagaagagggagaccaatagttatgaaaggttgggccagctgtaggggctactcacgcctataatcccagaactttgggaggctgaaggaggatcgcttgagcccaagagttccagactagcttgggcaatatagtgagacccccgtctcaaccaaaaaccaaaaacaaaaaacaaaaaaaccccaaattagccagatttggtggcacatgtccgtggtcccagctactttgggggctgaggtgggaggcttgcttgggcctgggaggtccaggttgcagtgagctgtgattgtgtcactgcactccaacctgggtgacagagcaagagcctgtctcaaaaaaaaaaaaaagttatgaaaacttgagataacaggcaattttaattttagaagtccactgtttagcactgaacagtcatggcaaatttctacgtgatggaaaatttaaaaagcagtgctactcaccagatgagccataatgctcaatttgtgcagcgagggctgccgattgaacagcaccacatctccatcgatgaggtgtctctctacgatgtcaccatacttgagctcttgagccatcttttctcgatttccgtatttcaaaaacctgaatgtgcaacaataaacatgatctgtgaaagcaaagttctctcaccaagtttctccctcttcagatcaggattcaatctttaatatattatttcatcaaatctaagatgcctccattttaatgtcatatagttttatgtgccaagaaaaaagctccctattaaactatgacagggtgggcgaggtgactcactcttgtaatctcagcactttgggaggctgagatgggcggactgcttgagcccaggagattgagaacagactgggcaacatggtgagaccttgtctctacaaaaaatacaaaaattagccaaacgtggtggggtgtgtgcctttaatcccatctactttggagcctaaggtgggaggatcacctgagcagaggaggtggagactgcagtgagccatgattgtgccattgcgctccagcctgagtgacagactgagacatcaaaaaaaaaaaaaaaaaaaccatgataaattgatcttaagatatatccagtcggatgtggtggctcatggctgtaatcctagcactttgggaggctgaggcagctggatcaccaggtcaggagttcgaaaccagcctggtcaacatggtgaaaacccgtcgctactaaaaatacaaaaattagtcaggtgtggtggcgggtgcctgtaatcccagctactcgggtgactgaggcaggaaacttgcttgaacctgggaggtggaggttgcagtgagtcaagatcgtgccactactctccagcctgggtaacacagcaagactctgtcttgaaaaaaaaaaaaaagacatatcctaattttagaaatgctaaaagccctgagagcccaggtgacacaggcaatgatccactttatatatttattgtatttctgagacagagtcttgctctgtcgcccaggctggagtgcagtggtgtgatctcagctcactgcaacctctgcctcctgggttcaagtgatttttgtgtctcaggcttctgagtagctgggactacatacgtgtgctaccgtgcccagctaatttttgtatttttagtagaaaaggggtttctttgccatattggccaggctggtcttgaactcctggcctcaagtgatttgcccaccttggcctcacaaagtgctgggattaaaggtgtgagccaccaagcccagcaataatgatcctctttagactttagtatccatggtattttgtcctcctggatccaataacattacaagcctgagaacaaaggagcacttcatgtatattcaatgactgaacagagcaaatgacataccttggctcacggaaatttaaacagatattttccacatgccaaaatgtcacgcaaactgtatttctggattgcattctgtggctgagtatgaccacagtgagctttgccatgagaaagtagttaaatccaactagattgggaaaagattaccttttcatctgcgtatgtctctgctgaatgaagtttgctcctgggtgaacctcagggccgttttgaaccagtttcctcaagaaattgatgtttgctttgtttacctgcagtacaaaaaaaccacaataagttactcccaggtaactagaaactaacaaatgatactgaaatgcgtcttaatctttactttccttgttcagattctaggagaaagagaggcatcctgggcagcctgctgcctatggtcttgagtataatgtgaacaacagactggcaaacaagcttccagcttccagtgtcaactcagctgtttgctcactgagtgacatggccaattcctttcctggtgcttggtttcctcactggtaaaacgggtaggctagactgatctataggaaccttctgtgatcctagaaacaggtggcgacttgatctgcaataacttactgggggcttgtaaggtttaaaagttgtgacaccagcaccacaagccctggtctgcattgaatgtgttctggaacctcttaaacaactgtcttgtggaacaccattttggagaagttaactcttggatcattagtaactcaactgaggacacacaacacaagctgaccaggaacatctatgatctgggctaactgtgagtctcataggtaaagctaatcaatattctcgttagcaggccctgcagttacctagacctcaatttaaaaaaaaaaaaaaaagtatgggctgggcatggtagctcacgcctgtaatcccagcactttgggaggccgaggtgggtggatcacttgaggtcaggaattcaagaccagcctggccaacgtggtgaaaccccgtccctactaagaatataaaaattagctgggtgtggtggtgggtgcctgtaatcctagctactcaggaggctgaggcaggacaatcacttgaacccaggaggtggaggttgcagtgagctgagattgtgtcactgcactctagcctgggcaatagagtgagactcagtctcaaaaaaaaaaaaaaaaaaaaagtgctagctgggcacagggccctgtaatctcagtgactttcagtgacttgggaggctaaggtgggatgatcacttgaggccaggagttcaagaccagcctgggcaacatactgagaatcccatctctaaaaaatttttttaaaaaattagttaggcatagtggtgtgcatgtgtagtcctagctactcgggaggctgaggcataagaatggcttgagcccaggagtttgaggttacagtgagccatgagcacaccactgcacttcggcctgggtgacagggcgagagtctgtctcttaaaaaaaaaaaaccaggccggatgcggtggctcatacctgtaatcccagcactttgggaggccaaggcgggcggatcacgaggtcaggagatcgagacgatcctggccaacatggtgaaactccgtctctactaaaaatacagaaaattagctgcgcatggtgatgggcgcctgtagtcccagctactcgggaggctgaggcaggagaatggcgtgaacctgggaggtggagcttgccgtaagcagagatcacgccactgcactccagcctgggcgacagagcgagactccacctcaaaaacaaaaaataaaataaaagcctttctgggtatgtagcaatagccttaaaatgttcaaatgctttgactcagtgactgtaaagttttaaaaataaaaaatctatcccaagaaaattaactatggataatgtttaccatttagttagtttaaaatatgaggcatgaaccaacatagaaaagtgtctacttttttttcttaaagatggtctcactctcacccaggctagagtgcattgacgtgatcttggctcacaacctccaccttccatgctcaagcaatccttccacctcagtctccccagtagctgggaccacaggcgcctgccaccactcctggctaattttttgtatttttggtagagacaaggtttttactgtgttgcccaggttggtcttgaactcccgggctcggatgatccacctgccttggcctccctaagtattgggattacaggcattagccaccatgctcggtcaagatgttattaattggaaaaaaagttgcaaaaaagtatagcatatatatgagtaaatacacatgaaactagaaacaactgtggctgcaaatggtttacagaatatataccaccaactatgtataaagcaaactgggaagacacatacactcatataaaccaaactgtgggttgagtgggttactggggactttctactgcctgttgtttgcaataccaaaatataacgtaaaagactgaatttaaaacaaagaattgagcagctgagtggtcacttaccttctcaggaaaagttagaattttggccacatgaactggcacagctacctcatcaatccggaggttggggtcgggcgagatgactgttctgccagaaaaatccactctctttcctgagagatttcctctaaatcgacctaaatagccaaaaacatgtcataggtccccatggcataccatgtgctcatgggaacaataagaacggagagactgaggaaagcctgtgacctccaatcagagaagctggacagacactcctgaaaaaggaaccaaagagagtgggctggcttctgcacatcttgtgggaaacctaccctgttttcccttcaggcgttggacgaagcctctggtccacttcttgggtgccatgttgaggggaatgcccgagagctcactgttaatgtagagggcacactgcagctgcaggaaatcccagtcctccatgatcatctgggtcttggctcctgagatccgatgctaaaaccagcacagcccaaacagaaacaaacctggtcagtttgatttttctcacattttcttgaccagaagtttttggatagatatactatgaaacttacaaggaaatgggaggcactgacctttttaataacatcgtttaggaaaatgatttctgtcagtttcattgtcagatcatcttcattggtgccagacttcaaatcactcacaacggagggtctgatacacaaaggaggcaccaaaagtcgtgtgagaatcaaatcagacggctttccggcttctgggttcatcagaagtagaggaacatcttcagctgggattcgtttaaataaattcagaactactaagggattcaagttttcctatggaaacgaagaaaggcagaaatggagatactatgttagttttccatagcttgggcaaggttttccttcactatgttttctaacctatctgtcactaaggataagtgacaacagagatttctatggatgatacgctatgctgcaagagccttaaaattgtgtatgtcttttattccaatttttcaagccaaaaattccacttctcattattccaaggggtgtaacttcagaaatgaacacaaagatttagctacaagaatgttcacaaaagctgttttttgttattttttatccgtgtgacagaataggaaggtaataaaagctgttcttaacagtgaaaagttggaaagagcctgacagtttattggctaaataaaatcacggtatatccctatgtggaaaagcagcaagccattggggggaaaaaaagatactagacaaacacagcaattgacataaaaaaggtccataaaatattggtagctggaggctgggcgtagtggctcatgcctgtaatctcagcactttggaaggccgaggtaggtagattacctgaggtcaggagttcgagaccagcctgacaaacatggcgaaacctcgtctctactaaaaatacaaaaattagctgggcatggtggcacacgcctgtaatcccagatacttgggaggctgaggcaggagaatcacttgaacctgggaggcagaggttgccgtgagccgatatcatgccattgcactccagcctaagcagtaagagtgaaattccatctaaaaaaaaaaaaagtgttactggctgggcatggtggctcatgtctataatcccagcacttagaggggctgaggcgggtgggtcacctgaggtcaggagttcaagaccagcctggtcaacatagtaaaaccctgtctctacaaaagtacaaaaattagccgggcatggtggcgggcacttgtagtcccagcaactcgggaggctgaggcaaaagaatcacttgaacgtgggaggtggaggttgcagtgagcctagatcgtgcaaccgcactccagcctgggtgactgagcaactctgtctctaaaaaaaaaaagtgttactgttaaaaaagaactaaggtaagccaggatgcagtggctgacacctgtaatcccagtactttggaggctgacgcaggaggattgcttgaacccaggagttcaaagcctgggcaacatagcaagaccttgtctctacaacaaattaaaaaattgttgctgggggtggtggtgtgtgcctgtagtcccagctacttgggaggctgacatgcaaggatcacttgagcctaggaggtcggggctgcaatgagcctcgatcataccactgcactccagcctgggagacagagagagaccctgcctcaaaaattaaaataaataaataaacaaatatataaaataataataaaaaaaaagaactgaggtaaaaacacaaacaaggggccaggaatggtgacctatgcctgtaatcccagcactttggaaggctgaggtgagaggatctcttgggctcaggagtttgagaccagactgggcaacacagcaagaccccatctcaattaaaaacaaaagcaaaaacaaaaacaactggtgttacaaggccagtccacattagccttagtgccagataaacactgttacggtcaaataagaattactggagagctggccgggtgtggtggctcatacctgtaatcttagcactttgggaggctgaggcgactggatcacctgtggtcaggagttcaagactggcctggccaatatggggaaaccctgtctctactaaaaatataaaaattaggtgggcatggtggcacatgcctgtaatcccagctacttgggaggctgaagcagaagaatcgttttaacctgggatgcacaggttgcagtgaaccaagatttgcaccactcactccagccagggtgaaagagcgagactctgtcttccatctcaaaaaaaaaaaaaaaaaaaggaattatcggagagctgtcgaacctaactggacctctcattttggaagaaagtgggtgtctaggggtggggcggagttgggggagagagtgtgcatgtgacgtgcggaagaggcaggcgggaggcaggcggaaggcaggcgtgcattctcaggctcacctgtgcccttcccagcagaggctccacttctttattatgttcaatggctgtttcaaaagactgaaggaaatttgatacaatgggatccaccacttttttgttggtcttgtatttctcatgaattattttcagcagtccacacttctttacggtacctataagggttagtttatttaccaagaaataaaaaattatgttctcagattggccagagattgtagtatggttaatgaaattactgaaactactatagcaatgaaagatgagaggtccgtttcccaataggacatcagttgttgggctcttaagcctaatttataaggagaaaagctgactcccgaacattatgtaaacctaataaactaaacagaagacagtgagtgaaaagggctattgcttagccttctgtgcattccactcaccattaaaagcgccacagtgatggcagatgtttttcttccggcacttgtcagagattttctttttcagtcctcgcttctgaaggtaggtcaggccgggcctctttagatagtccagaaactgcttcttctcctcttgggacagcatgatgtggcagcaggttttgcagatcatctttttcaaattaagcaagacagataaaagcataagtgagaatgaaaaattattttcttttaaaaatgccatcgccctgttttgtacccttaaccacgtgaccatatacacagatctgcaaatggctctatactatggatatgcagagaggaagcctgtgttcactagattagcagtactcacagccagtaggcagactttgttacctttatctttttctttgtgctattctgtattgtttgaattactactattgttatttttttaagaacacgtatctaccatcttctcaaggtaaataaacaaaataaataattcttgagtgatttaacgtagtgtgagatgaaaatattatgtacttagtataaaagagtcccctagatgtatcccccaccactcacagttcctaagttcattccagcatccctgaccaatcactccagaatttatgtcttggaaatcagcacctgtgtgcttacctgtaagatgcctatgactgctctgaagtaccctacatgaaaacacggcaactccaggtcgatatacccatagtggcctagacagtcagccaagtttttcccacaggtttcacatggacgatccttctcactcgtaccctttgaaaaaaagcacacccaatgatcaacacagactgctggacgggaaagagtgcccagccatcatgcctggctggtgacacagaatcatttcttttgcttcttaaatttcctttctgagatcacttcctactgtttttctttcttttctaattttcatgactcagaatcgaatcaggttgctgactaaaggccggagttcttgacctagtctaatatgtgcaggggggaattgaggagatggaaggaagcccctgctcctttcaatctggtaagtcaccagttttatcagcagggcaagacacagttaccaggaggggtgagggggccttaccatcctatggtcgagcaccccatatagcaagggggcatgttggttgtcctggctgtacaggttcttactcacaacttggatgtgcgcctgctggcgcatctcctcaggtgacttcattccaaaacagatgtggcttctggaatgggaagaaaaaggtgaaaattacagcaaaatctgtgaccaaaaatgtctattacatacatagcccaccataaccaacctatccttccaactgtctccactggcttttcctaccagtattaaatatatttaaccctctctcatttttccttcacaaacatcccttcatcttactggaatccagtttctactctcaccatcaaaggaacagtgctcaccaaggccacctagacaacctgcctgctgctgaatccaataagaacttcctcattttacctctgcagcactggcagcaccctgcccaatcctgaagtgcttttctctcggctttggtgacaccatacactctgagttttcttcttcccttctctggctgctccttgtacagtctcttttgaggtcttttcttctactgctatcccttaaatattggtgcactgtaccacctagcattacaaccttcatcctcttatcttctcatcctacacattctcctgagtgatcatgccactcacatacatgttgatgtctatcaaatctatctctataggccagctactgctacccaactggacatctgtatagacacctcctcctggacagttccacctagatatctcataggcacttcaaaccccacacattgaaaacagacctcaatactttttctcccatgtctgtcccttcattcattcttccaacaaattgactatttcctatgtgccaggcaccatcctacaggctgaggatacagattagctaagacagacaaggtccttgccaacaaagagctcacaggtcagggtgggaaagacagaccacaaacaaacgaatatacaaatgtgaacagatgcagaagtgatgtaagcagtggagtctgaggaattactttacgttgcatggtcagaaagcctcactgtaaaactgacaatcagaaggaagagcatctgaagtggagagaatgactagggccagggtcctgggactggcacaagcttggcattttcaaggaaccaaatgaaatcagtatatactggagcatagaaagctaatagtacaagataaagtcagtgaagcatgcaggagctaaagcatgagggcttgggaactttggtagggaatttatttaaataacataaatgcagccgggtgcggtggctcatgcctgtaatcccagcactttgggaggccaaggtgggtggatcacgaggcaaggagattgagaccatcctggctaacatggtgaaaccctgtctctactaaaaatacaaaaaatttgctaggcgtgatggcccacacaatggaaagctgctagaggatttttttttttccctgagacagagtcttgctctgtcacccaggctggagtgcagtggtgcgatctcagctcactgcaacctctgcctcctgggttcaagcgattctcctgcctcagactcccaagtagctggggttacaggcatacaggcatgcgccaccgcacccagctaatttttgtatttttagtagagatgaggttttaccatattggccagtctggtcttgaacttctgacctcatgatctgcctgccatggcctcccaaagtgctgggattacagacgtgagccaccactcctggcctctgctagaggattttaattgacaatacccttaatttgcactttgacagaagcactttctctgttttgtgagaatgtattatatctgactgggcgcaggtgtacaggtgggtgtgaagggccagtgtcgatgtagagctaccacatgggagaatgctgcattcacctaggtaagacacctgttctagtgaatggcaaccatccacacagctgcccaagcaaggcattctgtatatccgtctcaaggtctctcgacctctaattctttccaccatgaatcaagagattttccagaaggagaactcttatcaagatactctcctgttgaaaatccttcaaaggttcctcactgcctacaagatgacttcttaacacagcttcaagtcttctgcttccttctgatcacctgtgttctctccctcaggtctgctccttgaaaaaagcagtttggtctgctttcttttgcctggacccattatgtgctctcaaaaccccctggacctacccttgtcattgcacttgtcgtacccagtgttgacttgtgtaccttctccaactagattaggcagtaaaagttttattcagaccgtatctttaacgtccaacactgggaataacgcgcagtatcctcctcagtgtctgctgtaagaatgatgaattcacttttttttttgagacaccgtctcactctgtcactcagggtggaatgcaggaggttgcccactgcaacctctgcctcccaggctcaagtgatttttcggcctcagcctcccgagtagctgggaccacaagggcgcgccaccacgcctgctaatttttgtatttttgatagagacggggtttcgccacgttgcccaggctagtctcaaactcctgagctcaggagattcacccgcttcggcctcctaaagtgctgggattacaggagtaagccaccgcgcccggctggattcactttcttaccgagaactctaagaaggagccaccgcctaataacgtatttctgaaggcaaaagtccggatagcagctttatttctgacactgccatccgtcggcctgtggtacagctttctagtgggcaaccccatccttttggtaagcaactactgcctccgtgtcagacgctctgcggctgacagaattagagacagtccccgccccagattgctcccctcgctgcagcaggggatagttcgctgaagaacagggatcattgtatgacttcaggagaatgcgagctttggcccagggtgcacaaatcattaaggctcaggccactccgacttctccgcccaagtccagggacctctcgaggtgctgaaatcccctcagcctgaccaatgctctttgaccaacgctggtagttctgggcgctggtcacacctatggactactggccctccccttcccattgcaccccatctctgaccctgcaagacccgggaccgctgacctcggaccccttgccctatttctcagccctttggccactcttactccgtcttacattttcttggccacatccgtctcccggaactgctccttcaccatgatgaccgctgccgggacgcctccttggcactcgggaggccagattagagaaacgatgcccccagcacctcctggggctgcttctggactcgccgctaacacatctgcggcatcctctcggccaccgtagagtgtcccacgtgtccgcttcctcttccgctactcgcccgcgcgtctgtctgtcaagagagacttccggcatgccttttttttttttttttttccctttccccgcaccgtcacctggtggcgcttactggaagccgcaccgaggcgtgtgctgtattttaaaaatcccatttctggtcaatttctccacgtaatcagacacccgcagagaaactgcatataactctttgcctcaaggcttttagacaagcagagggccaaaacttgcataaaatggaaaatcatcatcattaacatcagtaccatctaaattaagagcttctaattgttttaagggaaggtggaagctaaaatgaaccggcccatccaacagagggcactatctgtggaggaccaacaaaggaaaacagagcggaaaatatgggcgcacatgtgcctccagttcatgaagttatttggagggaggggggaagaattaaacttacattattgattacaaaaacagttgaaaatctgttagagtgaaaacagccatggtaatctacagaagaaaagggagaatggaaagtaaagatcattcatgtcttgaaataagttgtctacagtctgtgagaacttgtgggaggtgatcctagtgtgatatattagtgcatgagcctagcaaggaaatcacatcaccacagggcttagcgcttagaattagaactaagtcctcattatttgtgagaaactcaaaacagaacttaacaaaagtgtttaacaactttcaatttttaagaagggacgctatctcattttcagacgccatggatcctcactagcaaaacacaatgtcacagacaaacgaggcatatcaggtttttctaactcatttcggtactccatcacttaatcatgaaataatgttgactatatatatatatatatatatatatatatagtcaacattatgggttttttttgttttttttttttttttttttttgagacggagtctcgctctgtcgcctagactggagtgcagtggcgaaatctcggctcaccgcaacctccgcctcccgggttcaagcgattctcctggctcagcctcccgagtagctgggactacaagcgcccgccaccacgcccagctaatttttgtatttttagtagagacggggttttactatgttggccaggctggtctcgaatccctgacctcgtgatccgcccgcctcagtctcccaaagtgataggattacaggtgtgagccaccacacccggctctgatgtttacaatattataccaacaagggttggatcgtgtgtgacttatctagaggttaagagcaaaagttatgaaatcacagtgccatcatgggagtctagctttcaccatttaaagttgtgtaggcagccaggcgtggtggctcacgcctgtaatcctagcactttgggaggccaaggtgggcggatcacctgaggtcaggagttcgggaccagcctggtcaacatggtgaaaccccatctctactaaaaatacaaaaattagctggggttggtggtgtgcgcctgtaatcccaggtactcgggaggctgaggcaggagaatcgcttgaagctgggaggtggaggttgcagtgagccgagaccatgccattgcactgcagcctgggcgacaagagtgaaactccatctcaaaaataaaaaaaaataaaaaataaagttgtgcaggccgggcgcggtggctcacgcctgtaatctcagcactttgggaggccgaggtgggcagatcatgaggtcaggaatttgagaccagcctgaccaatatggtgaaactccgtctctactaaaaaatacaaaaattagcctggtgtggtggcgcattcctgtaattccagcaactcaggaggctaaggcaggagaatcgcttaaatccgggaggcggaggttgcagtgagccaagattgtgccactgcactccagcctgggcaacagagcaagactctgcctcaaaaaaaaaaaaaaaaaaaatatatatatatatatatatagatatagatatagatatatgtgtatatatacacatacgtgtatatatacacgtatataaagtgtgaacttgggaaagttatttaatcttattgtgtgttagtttccccatttataacatgggtgagtaatatgtatcctatttcttagagtcaatgggaaggttaaatagcaaaatgaaggtaaaagtaattagaatgtaacaggcacattacaatcactcaataaatattcttctgcctcagcctcccgagtagctgggactacaggtgcgcaccaccatgcctggctaatttttgtatttttagtagagacggggtttcaccatattggctaggctggtcttgaactcctgacctcgtgatctgcctgcctcggccttccagagtgctgggattacaggcatgagccaccgtgcccagccggctgactattttcttaagaataaggatagttggtcacctcgggaggctgaggcagaagaatcgcttgaacttgggaggcggatgttgcagtgacccgagatcccgccactgcactccagcctgggtgacagagcgagatgcggtctcaaaaaaaaaaaaaaaaacaaaaaacgaaaaaaaagaaaaatagtcggccggggacggtggctcacgcctataatcccagcactttgagaggccgaggcgggggcggatcacttgcggtcaggagttggagaccagcctggccaacatggtgaaaccccgtctctcctaaaaatacaaaaattagctgggcattgtggcgcaggcctgtaattttagttactctggaagctgagccaggagaatcgcttgaatccgggaggtcgaggttgcagtgagccgcgatgaagccattgctctccaacctgggtgacaagagctagactctgtctcaggaaaaaaaaaaaaagaaaataggaaagctgcccgcaaagcctgcaccttggacacctcgtctgcactaacatttgggaaattcttcttattatttctccggaacatatatatttacattctttacatgtctgtttcacgttaaagaaaatatttctggagcaatcaatttttttttcctttttttttttttttttctgagacggagtttcgctcttattgcccaggcggagtgcaatggtgcgatctcggcccactgcaacctccgcctcccgggttcaagcgattctcctgtctcagcctcccagatagctgggattagaggcatgcaccaccacgcccggccaatttttttttttttgtagtagagacggggtttcgccattttgcccaggctggtatcgaacttctgacctcaggtcatctacctgcttcggcctcccaaagtgttgggattataggcgtgagccactgcccctggcttccaatttttttttccttttttttcttttcttttttttttttttctgagacggattttcgctcctgttgcccaggctggagtgcaatggtgtgatctcggcccactgcaacctttgcttcccgggttctggcgattctcctgcctcagcctcccgagtagctgggattacaggcatgagccaccacgccccgctaattttgtattttgtatttatttatttatttattttcgtagatacgtggtttcgccatgttggccaggctggtatcgaactcctgacctcaggtgatccgcccgccttgccctcccaaagtgctgggattacaggcgtggccatcgcgcccggccaaatatttttcaaaatctaattttgcataatgaccaagatttgcagaaaaatacaaattaaagagatcttttaaagtaaagattcgtcataaaagtcacagaaataatactcatgaataataaattagaatgggcaatgttaagtacttgaaataacaaaggttttagagtcagggtttctgcagtttccctagccatataacgaggagactgttagagaggatatcctaaaatgctttccaagtttacccacctctaactcggaagaaggcaatttaaactaatttggtttaccggaattcaaatacgtacaattcaacataatgaattgaactgaaattgaacacctgcttgcgtaaacctagtcggctcgagttgttctggttctggattggtcagtctagagttccaggggtgtggccaaaagtctgtgaggcggggccgtaggcagcctaaatcaggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatggtgagtctccctgggcccgtgcagtcatctgccgcgtatccgagccatccgtggtccctgggtcccagtacttgagctataggcacgcgaagcccggttgctcttctctggccgtttctgtcagaggatggttgtcgaggggctcggggctgttggcagggcgtccgggctggcgggctgcgctgtagacccggacacgctgggcttcgggctccagcgcctgggcagtgcaggagctgttgcgcttgttgacttcgtggagcacggtggatgggggtagggggcgggcgggatagatggacactgggaggcacatctcgtctgcagttcctcattgggctaggtaggcggcttgcaggtgatggcagtacaagaggtgaagaaggtgcgggcagcgcctgggcgagttgcggcaagtgaaaccattcccacgtgtaagctagaaaacttgtcagctggatggatcttcatgtttcatagtggggaaacaggccctggaaagagatgttataaaaaggtagtcctgccctaagtcatgcgttattagctcctccagcatccgtttttaactttaccagcaatcttttttttttctccttacctttgatccgttactttcaagaattgagtaccactgacgtggatttaatttggtgtggtttctcaaagtaaaatggagaaagtctaggaagttatttgctgccatgaaagtctcttgcgcctcctttttggtaaaattgttagcataaattgcttaatgcccacattttttgttaggtattaagtaaaggtgcagttcagtccttcagaagggaatatcgttttctctgatctctgctatggccattctagaaggatagattacatgtaggtagtgagtacaaggtttggggcacatttgtgcaagacatgataaacacagttcattgagtgacctttatatgagccacagcagtttttaccccagagaagtgattctcaacccggagtgatttttctcctaagggaacagttggctaagtctggagacatttttgattgtcacaactgggaaaggtgggaagtgcttccggcatctagtggttagagggctgggatttttatagttattctaaaacatacagtccccacaacatatccatatggaattatccatatggaaatatcagtagtgctgaggttgagaaaccctgccccagagatacacataacctagtgaagtaagttgtacagattcatgtgtaaaaccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtgaactacagcagtgatctgggcaagctccccagcttacattctagtaaacaagtaagcatcatcacctcgaagtgcttgttttgtttgttcctttaactcactttatcctatcctgttagataaaccttcccatacgatagctgtgagggaaaatcctggtgatgtcataggtagaggctgcacttttttttttagagagagagtttagctctgtcgcccaggctggagtgcagtggtacaatctccttggctcactgcaacctccgcctgccaggttcacgcaactcttctgcctgagcttcctgagtagctgggattacaggtgcgcaccatcatgcctgggtaatttttgtatttttagtagagactgggtttcaccatgttggtcagcctggtcttgaactcctgacctcgtaatccgcccacctcggcctcccaaaatgttgggattacaggtgtgagccaccgtgcccagctgaggctgcactatttttaactgacgttcggtcatgttaaaggccttgctgaggtggtgacattgaagctgagatccttgtaaagatttggaagtagtctttgtaaagatacagaaacagtcttgtaggccccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaagtgattttagcgataagcagctttttaccagctttgctagctgtaaatagttggacattgtaaatcattgaatagaattaaggtgttgggttgttaaattaacaaataatcaagtgttctgtgaactttttttttttttttttttttttgcttttcctctctactttcttggatttcttgttcatcagaaatgaagtgtctagcaggtactgagattgtaagcacggtgtggggatgcatcaccttcactgagtttgctttgatgatgctttgcatgttggcctttggacgacagttttatagtatggtcgattataatgccagtgctatttaggctggtgcaaaagtaattgcagtggcaaaaaccacaattacttttgcaccaacctaatatgttttaagatagtatattatgagcaaaggagaaaacgtttaaaatcatgtttattttgtaaactccaaaatgcatgttacatgtgaagtgactcactggaggaaggtgagtactttaccaagtaggcacttgggaaatgctgtgtccacatacttaggaaatggcttcagttaacactgggcttgggaagggctctcttatccaaggagcagtcttctctggagccatgaaaccagcctggcagcactggtaataaactagtctgtgaaatctggcaaagcctctgtcctgtttggatatacgcaaaactgccttttaccatttccattgctttttattacttaatctcccaactttgtgcctggtgtctttttttttttttttaaaatagaaaatttttgaggtaattatgtattcatataaaagtctttggtggatatgctttttcccacaagcacttggttagaatggcccattacctcatttgtttattttttgagacagggtctcttgtcacccaggctggagtacagtggcatgatcatgggttactgtacctcccgggcttgggtgattctcccacctcagcctcccttgtagctgcgactacaggcatgtgccaccgtgccctgccaattttttgtagagacaggatttagccgtgttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtgattccctgccaggcaaggcagtaaacctgggattgcctgcccaggactgtaatcacattgatgtcccagcgccatggagtatgtaatgaatgaactgccagcagaactactcactaagaactactccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcacagccgaaggagtaaaggtgctgcaatgatgttagctgtggccactgtggatttttcgcaagaacattaataaactaaaaacttcatgtgtctggttgtttgaaatgtatttgcagtttcctgggactgctaggaggttagtctgctgatttcagttgctgtccaagttcacatgctccatgaagcattcagtgaaaacttaatgtcatggggtggtgtttgtttgctgcttggtttatagcttaggtgggttcatctgggagtcaagcttgtaaatgctgtgttaagaaccatgtccgcggtggacgcagtgtagtggctcacagtcatcagcacttttgggaggtttgggtgggatgattacacttaagcccaggagctcgaggctacagtgaggtgttttttttttcgagacagggtctagctttgttacctaggctggtcttgattgaactcgggctcaagcgatcctcctaccttggccacataaagtactggcatgagcgaccacgtctggcttagagtctaaaaagtaccatgtctggataaactggagaaatctcaggaagcagtagagagctgaaagacttggttgggcatgaaggggactcaggaaaagcaataccgtgaaggcagaagggttgaggttgcaggaaggaagggtagtggaatgttttggagaaaagatggtcacagcccctgcatggagcacctacagacaggagggcagggctgagaagagttaagtcatggggctgggcctgctggccagggggtggttggagttctgttttcatatctacagaggctgtgtacttcggtttgtggggcctctggccctgtaggttctcttgctaaggaatctgctactactttgctaggaccaggaaatggcttactagtacagaacgtgtggaagaatggggtctttgatgtgatttgacattttttgatgaacagtgcataccaggctgaaggtaatgctaggggcagcaaaggttggggtttgagatgcagtttcctgtgactgagctggagtgtggaagcagagaaggcaccctgtgagcagcttgcagaggcaaggtggtgaggatcctgacagtgctgcagggatgggatgggatgggatgggacaggacgtggagctgggggtggttgctaagttgatgcagggagagtggaaggaagcaattgagaactgaagggtaggaaatagtttctgatgtgaagaaaaagggcatagctgcagagagcctgaatgattgaaggttggcatcaaagtcacgaagtggggaggcttttctgttcagctgtgctcagggcagaagttgtagtctttcagccagtagccttgggaagggaggtgggatgaaactcaggcttggcctatttttccagaggatccacttgggttgtgatattatagaaaatgtggcagtcttgctgtgagccttgttaggcataacatttggaaacttggcaaattttacgtaaaggtctggatttccagcctcttgaaataccagaagcagcagtagtagcccaccttcctgtttgataacaattggcagggctccaggctggctgcatctgttgggacaggtattctctggtctccacagcctttgctcctacggccagctaacaccctcctctacctgccctctggtcttctgtccctgctgcctgcttctcttccatctagtccatccaagtgttttttggggaagtcacctggtaccttgttagggttaatttgtcttttaaattgggctcccaagggtatctgctagctaccctggctcacaaggctattttgaggctgaggatgtaacaactgtgaaaacagtttggaaactagtgctaagcaattgtttgtcaggaagcagggacttgtgggaactcaaactgtggacagattcagcacattgtaggccctcacagtaaccaggctaccctgtgctgtcagcaggctttggaagagcctccataaaatgcaaacttgactttactaagctgaatcaatattgagggagcacatcccttccttcagcttgtcactgatgggaagctgtggcttagagagagcagggatctttgaagagtgatgagaaactcagctagaggtggttctgggaaggtacctgcagtgaatatttggggtgctgctttttagcttttcctagcaccacaaccatgagttctgtttgtagctggatgtgcctatgtaatcaggcagctttcaactctgcactcttcctttcttccctggcaagttgcttattttaggctgcccttaaagacagcatcttacatggtgctctcatggagccgaaacaggtgctgtcctaaactctgaacaacgatctccattaatctgcgcgcgcacacacatacacacatattttttttgagatggagtctcactgtcacccaggctggagtgcagtggcagaatcttggctcactgcaagctctgcctcacgggttcacgccattctcctgcctcagcctcccaagtagctgggactacaggtgcccgccaccatgcccgggtaattttttgtatttttagtagagatggggtttcaccatgttagccaggatggtctcgatctcctgaccttgtgatccgcctgccttggcctcccaaagtgctgggattacaggtgtgagccaccgtgcccggcctaatctgcatgttaactccaagaagcatgtcttcctggacccacgctggaaagggtgtagagcagttaagcatcttaccagtgtctcacccatgaagtggtggggatgggattggaatgcagtcatctgactccaaaacactgcattttttcaggcactccagtattaagctactttgcactgtgcatataatggtatataaaactcatgactgccagcagggtgccagttgccatgggtttattgaacaagtgttagatggctagccaaattcccaatttactgaccacctgctgtgtccctgttctgcaagttggggataaagaagctgttctgtcttgaaagctctgaggtagttaatgacgatcccatgatctggcttctgttcctttctgtgaagtagcagatagtgtatgactgtgacgtgatagaaattgagagccaagaagatcagtgcagggaggctgggtcttggaaggcttccaggagacatacagcagtccccacctatctagtttcagttgctgtcggtcaactgcagtctggaaaattatcatggctaaatggtctgggatcacccaaaagtgatgatcctcttgaagtgtcatcagaaggtcaatagtagcctaacacgtcaccatgcctacgtcatttacctccctctcccttccacataggcattttatctcccatcaagaatgtgaatacatgtacgtattcagaggaaaagagttcatgcagcctactacagtataattattaatatcttactccctaaattatgaactttaattatgtatatatagcaacaaacttggtgtagatagggtttgcggtttcaggcatccactgggggtctaagaacgtttgccccatggataagggaggattactgtaacaccagcagtggcaagagacatgatctgatttggatgcacaggagaaagttctcatttgaggccatgaaaaataggaaagaaagcagggagatgggagcaggcagtgtgggacaaggtgagaccagtcattctgcaaggggaagagaggatgacactggggaggtgggagcagagtgggtaggtaggcattctcttgaatcaacaagatggaaggccctacatgactgatgcctttgagcagagttttgcacaatgcatttctggtgggagatactccatttcaaaaatagtcttcaggttggctgctagagcacagaagtatgacacctgactcatttgtgctggcagagaggctctcctgggttttagagctttgtgaacacacctccatacattaatccaactgtccttccccatccactcacccttgaacttcccgcatgccagatgttgaggggaggcagaaatgagacctgcctcccagtgcccacagtctggatgagagggtacaggtgaggtcctggtaagaaacgaagctggagaggtcagcggagaataaatcagggaggatcttgtatgccaagctaaggatttcacttgttcagtgttttggttaaagaaaataaaacgttggagaattagatgttctgcagtggattgtgtgttcttttcacatgccgagttcctccacacaggaaatactttggcaacgctctggctgctcatcatgcatattggagagggaatttatgtagaaggttatgggtcgatgagatggcatccaagtatttatcgtatttttttgagatggagtttcactcttgttgccccggctggagtgcaatggcacgacctcagctcactgcaacctccgcctcctgggttcaagcaattctctgcctcagcttcccgagtagctgggattacaggcatgtgccaccatacctggctaattttgtattttgtagtagagacggagtttttccatgttggtcaggctggtcttgaactcctgacctcaggtgatctgcccaccccgcctcccaaagtgctgggattaccgtcgtgaggcaccgcgcctggccccaagtattaataactcggaaaaagggaccagatcaggaatcaggagtcacagttcctgatctccactcagcttacaatcagctggggccatggatgggcaaaagacttcccttttctgggcttctatttccctccctgtgtctgtctgctatccgggctagatgagtaattccgaaacctggcaggtgggggctttctttttttctttttgtgagatggagtgttgctttgtcacccaggctggggtgcagtggcactgttttggctcactgcaacctctgcctcctgagttcaagcgattctcctgcctcagtcttctgagtagctggaactacaggcgcctgccaccatgcttgggtaattttttgtatttttagtagagatggggtttcaccatgttggccaggctgggggcttgttaaaaatacaaatgctggctgggtgtggtggcttatacctgtaatcccggcactttgggaggctgaggcgggtggatcacttgacgtcaggagttcgagaccagcctggccaacatggtgaaacatctctactaaaaatacaaaaattagctgggcgtggtggtgcgtgcctgtaatctcaattactcaggaggtggaggcacgagaattgcttgaacccaggaggcggaggttgcagtgagccgagaccatgccactgcactccagcctgggtgacagagcgaggctctgtctcaaaaacaacaaatgcccagcctcttgccccagttttcagagttagtagatctgggtagcgcccaagcacctgatgttttaatagcttcccaggtgaggctgcttcaggaaactggactgaagcttcccaggtgagctcaggcttgggaagctggactgaagtttctctaagatccgttctgcctctgagaattctgtctctaatgggaatactgtctctgccctcaagaagctggcagatgaacagtaatactattgctaattaatgaccacagaatagctaacatttattgtttaccatgtgccaggtactgagctaagtcttgcacaaattatctcatttacctttttttttttttttttttgagaatgagtctcgctctgtcacccaggctggagctctggattgcaccagtggcgcaatctcagctcactgcaacctccaccttctgggttcaagtgattctcctgcctcagcctccatagtagctgggattacaggtgtgtaccaccacacctggctaatttttgtatagtagagacagggtttctccatgttggccaggctggtcttgaactccagacctcaggtgacccacctgcctcagcctcccaaagtgctgggattacaggcatgatccactgcacctggcctcatttacctgcactcggagggaagtactattacccccattttatagatgaggaaattgaggctcaaagaggttaaggaacttggttaaagttacacaactatggcatcctatgataagcctgggggcatttgtggaacatcttgccaaggagctagaaatggtcctgagccttaaatgggtggaggtgattagctgaggcagcgattctccaggtgtggtcctggacagcagcagcagtgtcaccagggaacttgctagaaattcaatttcttgggctccaccctagaattactgaatcagaagctgtgggtggggccaggtaacctgtttttttttttgagttgcccaggctggagtgcagtggcgtgatcttgcttcactgcaacctccgcctcctgggtgcgattctccacctcagcttcctgagtagctgggactactggtgcctgccaccacgcctggctaattttttttttttttgtactttttagtagagatgggatttcaccatgttggtctggctggtcttgaactcctgacgtcaggtgatccgctggcctcggcctccaaaagtgctgggattataggtgtgagccaccgcgtccagccagaacctgtgttttgataagctctccaggtgattcagatgcatgctaaagtttgagaaccactgagcttagggaaggggaggatattccagagggggacagctgtggagacccggtaggacagtgctgtagactgccccatccctgccttttcacttggtgaaataaagacgtgtgatgcactatgcagactcccacaagggggcactgtgggcacagacgtggaagcggtctgctttgttgtcaagaccgctacccttgtggaagcatgaaaaaagcttgatgccagatcaactggagaggtcactctttcttctcagagaaggtctaatgggggtggtaatcttgtttataggattcggccctcgtagggaagctgaacctggagggctttctgctgttcatatgtgcatggtgatgtctacccatccgtgctgcgaggtctctgcagatcctgtgcaaacagcattcccccttttgtagctgcccagccaggcagcttgcggtttctattgggggaggtgggggccgaaggctgggaaccccagcagcccgattctgcttcagccttctgcctacagtgctatgcctctgtcctattctttgacaagcatgggtccggggccacagtgctgggtccaagacctgttttcaagccttagctctgccccaccacactttaagatctctggcaagacccctttctcctctgggtctcagtttcctacactgtaggatgagagagtggtgctgagaaagtggctgtcaacatctctttccactataaaattctgccctgggagttgaggaagagactgccttgtgcttttcaaggacctcggattgcaggggatctgtaaaccctgctacatgacatccatctccagtagccacttaaggaagcatttccagggatatggtgcaagtcagtaaggtggaatctctcaaacaagattttttaaaaagtccatatcttcagacatccagaatttgcttttataggtttctattctgcactgtttggaagaaggaaaatttataccatgttctcttttctgctgcagtgtgtatttcttccaaaaatacattgcctcggagggtctttggcattcacctcgttaatccagggattggcatcctatactctcggtgactgctcacccagctgagccactgctctgcctgggcaggaaatctccagaactgccttttcagagcgctatagatgtgctcatccctgggttataaggggattcaaaagagtggtccagccctctgctggctcccaccgtcgatgatgatattcagagagtctggttagaaattgcccaacccagccgcgtgcggtggctcacgcctgtaatcacgttgggaggccaagatgggcagatcacaaggtcaggagttcgagaccagcttggtcaatatggtgaaaccccgtctctactaaaaacacaaaaattagccgggcatgggggcatgcacctgtggtcccagctgctcaggaggctgaggcagaagaatcgcttgaacctgggagagggaggttgcagtgagccgcgattgcaccactgcactccagcctgggcgacagagcgagagtccatctcaaaaaaaaaaaaaaaaaaaaaattgcccaacccataggcaaacattgttaactgcagctgtccttggtggaggaaacaagttaaacatgatgtctctttccatcaggcctccttggagcggggaaggagagctcttcagttcctttggcaccttcacgcagcatgcaagacgggctgctttttcttctgtttatggatgaggcacagagggtagatgacttgccccaagtccttcagctcattcatgctggggaaaggagtaagcttcaggcgtcttcccctggagttcacgccacctctgacagcaagtgagccgtttgctactcaagtgctgtttcttgcttttttaaggtaacaaaacactgcatgctgtctggggtaccttttccctgctgttcagttcattgccctgtgtcgtctcacagagcgtgtcactggtacagaaatgttccctgggaagctagagttgaaacatcgcccactggtgctcctgagctggctttgtcatgggtttagagggtatgttagggaggaggccttctgctgcaagtctctgagaagtcagcttacactgccttgaacagtgaggttgcttattagctcctgtaagaaccccctggatgcccaggagccttcagggttggtggacactgcagtttaacagcgtcttcgagggcctagacgttttctctctccactttgctgccaatgctggtgccattctgagggatagttgcccatcacagtggggctgggactgggtgaggcaatgaagcgcttagcatgtgaaatccaaggaggtcttcacccacagtggtgctagtgcaaggtcagcatctccttgaccctaagagcaccttgccctagtactggggcctgtgggaggccacccactctccacaaaggccagaccagaagtcacctgtgttttttctgctcctcttccatcggctgggacttagtctcctgcaacacctaataactgtgaggtgggctgggaaatataggcttgttccagctcaggcagatgtgggagcacagttttgggggacaatgaccagtctttgccacagcaggaagaaaatggttgcttcatagggatcctttcagcagaaacctcccagcaaaagggggaagtttactgggaagctgtgggtgatctaacaaagccaaaaggtaggcggtgctggcagcctccctggatttgggtctggaaaatcatttcagaacaaatcagctcttccttctcccctccttcctccttccccctctttgagtctatgcctctctctctctctctacaggctggcttttctttgttcccctttctgccccatggctgccacaaccaggattttattgctccccattccaaacttccggccagattagttagacctgcatcctccttgccacttcccagggacaagatgctgactggtctgtcagctcatggagcccactcccacttacctggggctgaggagcacctgctgggaaggtttgagggcaggagggctgctgatgtatccaatgcagccaccactcccaccgctgagacatctgtctttctttccttcttgtcactcccagacctcagcaagtggccgctttaaaaagagaataagagctttattgaggtttaattcacagaccatatattcacccttgtaaagtgtgcaattcaatgggtttcaatgtatttgcagagtggtgcaaccaccaccaccacctaatttttaaacattttgatttttatttggtctcactctgtcacccagcctggagtgcagtgatgtgatcatagctcgttgcatcctcgaactcctaggctaaagtaattcttccacttcagcctcccacataactaggactacaggtgcacagcaccaggcccagctactttttttttctttttttttagtttttgtagagacagagtctctacattatgttgcgcctcctggcctcaagctatcctcccaccacacctattcatttttgatcatttttattatgccaaaaagaaacccttagcccggcaggtgtctcatgcttataatccctgcactttgggaggctgaggcgagcagatcacctgaggtcaggcgttcgagaccagcatggccaacctggcaaaaccctgtctctactaaaaataaaaaattagacgggcatggtggtgagcacctgtaatcccagctacttgggaggctaaggcaggagaatcccttgaacctggaaggcagaggttgcagcgagctgagattgcgccactgcactccagcctgggcaacagagtgggtgagactctgtctcaaacaacaacaaaaagaaaccctgtagacattagcagtctctccctatttccctcaacctctgccccagcccctggcaaccacaaatctgttttctgtttttataaatttgtctattctggaaacttcatataaatgaaatcatatagtgtatataggtttttatgaccggattctttcactcagcctaatgtttccgtgctatgtccacaccgtagcatgtatcagtaatttattccttttaattaccaagtaacattcccttgtgtggatttaccacgtcaacatcagttgatggatatttgtgttgtttctgctttttggctattctgaataattttgcagctatgaaaattcatgtgcaagtttttgtgtggatgttttcacttctcttgggtatatacctcggggtggaattgctgggccttatggtgactctctggttaactgttttccacagaggcagcaccattttatgttcccaccagcaatgtacgaaggttctaatttctccacatccttcctgacacttgttattatctgtacttgattttagccatgcaagtaggtatgaagtggtatctcattatggttttgatttgcatttcataataactaatggtgttgagcatcatttcatctgcttattggctgtttatatgtcttctttagaaaaatgcctgtttgaatcctttgcttattttcaaatggggtgatttgtctttttattgtgttgtgttagtttatatatcctggatgcaaatctcttatcagatatatggtttgcaaatattttctcctattctgtggattgtccatttttaaaatttatttatttatttatttattttgagacagggccttgccctgtcgcccaggctggagtacagtggcttgatctcggctcactgcaacctctgcctcccaggttcaagcaattctcgtgtctcagcctcctgagtagctgggattataggcatgcaccaccatgcctggctaatttttgtatttttagtagagacggggtttcaccatgttggccaggctggtctcggactcctggcctcaagtgatccacctgcctaggcctcccaaagtgctgggattacaggtgaccgccaccacccccggcttagttcttggtttttctgtccttggaaactgctgtcagggttcccgagagactttgaatgtaacaataataccttccttttattgagtgcctactattcactgtgttgggcacattgtatatattaccttttgtcctggaaatagttttacaaggtggggattattgtccccatttcatagtgtgatgaggatgctaaaaaaaagcaaatgttgcctctagctgccgccatgggaggtaggcacctggagcgaaggcacggcaggttctgctctgccctatctccctttggaccccttctaggggttatgttggatttggaagccacgaggaggagtctactcagacaagagcatcctgatgggggctgccttgagatgatggggtgtaagccctgtttagctggaaatgaggagagagagacgtacccttggtcaagggctatcatgtgaaagaagggtaacatttgtcctggagtgtggagtgtgaagcatatggggaaatggtttgggctggatagcaggcagtttttaaaacttggagcaagccgggcgcagtggctcatgcctataatcccagcactttgggaggccgaagtgggtggatcacctgaggtcaggagttcgagactgtccttaccaatatggtgaaatcccacctctactaaaatacagaagattagccagatgtggtggagggcgccttgtaatcccagctgcttgggagcctgaggcaggagaatcgcttgaacctgggaggtggaggttacagtgagctgagattgtgccattgcgcttcaggctgggcaacaagagtgaaattccgtctcaaaaaaacaaacaaaaacaacaacaacaacaacaaaaaaaaaaaaagaaaagaaaaaaacctcggagctaatggaaggggcctgccccctgggaagcagcaagcttcctgttgctggtggtacacaagcagagcctggctgctttctaggtgaggtggttgtagaagctctttgggttcagagtcctgggggggttttagggtttccttgaatgcccagagcctgtatgtcatagcttctgatttcacagggacttcctgtccacgcagctgggatctctcccagcccagattcatcatgtctcacccatcctgagggctaaatttggaatttaataacaacactttggatttatgtggcccgtttccttggaggcattacatctgttatcccattaattctcctaatatctttgggtggaaggtgagggaaggtgagggagcctgagaggggagaaggaacctctttggcttcttcagctcctgaaggggagaggaaatggcagagcaggagcgggccggggatgggggaacgtctgcaccacagcccctctggctttcccctctcataaaaagcaggttgctcaccggatgaaggggtgtctcccagcaggaagctcctgtgttgggcacagtatattggtgcataagtctccaggtggactctttgagggctggaagtgggtagacatcaaggtgggcaagatgaagcctgagccctaagcttgggaggagaccaacatgtctaccacgaaccaatttgcagagctggatggtctggaggaagcagtatggcttcctggggaagggggatttgagctgagtttggaaagagtcctggagcaccctggagtccagtttcctacctcctagtcacgtggtgtgggtgaaggccataccttggtgagctttcccagggtatgggggtgcctagggtgctcctcaagatcctaaggcttggcctggagtgctgttgggcgaatggccagagagtctgggcaggcagaggagggctggggactagtgcagggaaggagccgctggcactggccatgaagaaggagtgggaagggaagggaagggtggcccaggtggagggctctgtggggcagaggcagattggtgtgggggttcttgtctactccagactatgctgttttcattcctgcctctgttctgaggcttgaactcctgcaggtacctggcttttacagccctcccaagtgcccttccttcaagctttggctctgactgctgctgatcttccctggtaccaagtgagggaggtgcagaatcccaggccacaggcgcagaacagggcggctggaaggcacctggacaatcctctgagactattctctccttcccgcttttgcagatgagggaattggggcttggagtgcaagcattgggaagaatttcccaggaagagagatgcacagatgtgaagaactcgaaggcaagagaaagccggggggttgtgtggcaggtagaagtgccaggaccgtggagcgtgtggacatgtggcagattgcggaggggctgtggcaagtatttacaggtggccgttacctggaggaagactgaaaacagagaacagtgctgccaggcgtgccttttggagagggcactggtcagaaacggagccttcatgtcgcctgcctcacctgctcctgctggttctccccaccctgtggacggtgacttggtcctccacttgccagaagccttgtcagcaaccttgactctgtcaccccacatccaggccatcaacaagtcttttggccctttctttgaaatccaccaggaatccagctgcttctccccaccttcctgcctctctggtctgggccactaatgtcactgccatggccgccttgctgcatttctgaggatgcttcatctctccaccttcttctccactcagcagccagcagggcactgtggaaatcggagtcacatgagctggcacctctgttcagaaccctccagggctccacatctctctcacccaaatgccaaagacctccccacgcccccacaatcccccacgacctggccactggcctcccaccaccttccagctccagcggctcctaccacatttaaggctttccttcctagttttaatttttcctcgtcagcagttgattttattattttcttgtttattggtattttcccactagaaatgaagctgcgtgaagttagagatttttttttttggtctgtgttcctaattagctcattgctatacccctggcgcccagaacaatgccttggacacagtacgcagtagactaaataaatacttgttgaatgactgactgacggaatgacggctgtgtggggagtggattgggtcgtgaggcagaggctgcggtggaaactcaggcaggaggtgatggtggttcttggggctgcggaatgccaagtttagaagctcttcctctgctgtggcacatgaaccggtcactcgagaaggcttttagatttactttgcctaatcccctcttagtgcatgtggggaaactgaggtacacaaaaggaattccccaccaagttaggggcagaacctagcccccttgtctcccagatggatatcttcttttttttttgagacggagtcttgctctgttgcccaggctggagtgcagtggtaccatcttggctcactgcaacctctgcttcccaggttcaagcgattctcctgcctcagcctcctgagtgtctgcgattacaggtgcacacaaccacgcctggctaatttttgtatttttagtagagacggggtttcaccgtgttggtcagggtgacctcaaactcctgacctcatgatccacccagctcagcctcccaacgtgctgggattacaggcatgagccaccgtgcctggctggacatcttgttattaaagcttcttctctctttgtaggggagggggagatgcctctggtggagaagaccagtgtggcagtgactgtgtctgttagtgaacctggtggctggttgagggtctgtcgtggtgactgaggacacatacaaagtgcttttctcagtggtcaccttggtgttggtgaataagggtcagaagatggctcctgtcctagggcactgccagtcggtttggaagctgaaatgcctgcttagcagtttgaggaaacacagaccttggaggatcttctggttgcctcttcaagaattcattctattccccttctgctccccaaatttgcttttcttggggtgggtcttggttggcctaagccaagaaagtatggcatctactccttccatagcaatagctcaggaataggcagtgacccagacctgaaccaatcagtgcatggaattacccctggccaaagtggttgattgaggctgggtgcaagcagagttgtgagaaggctcccatttggtggttggagagatcgcacttgctccagaggtcataatgtgcagatctgaggcttggaactgctgcagacattttgctaccacaagtgaagccaccctgacgacacagttgacaatttggagcagggcagagctgagagaacagcagggaaacagccagagtcttgctcaagcctccctgaagtatctatacccctggactctagttatgggggctaataaatgttatatactgtttaaggtagtttgagttggtttatctgtcattcgttattgaaaaaacatttttttttcggctgggtgtggtgacacacacctgtagtcccagctgcttgggaggctgaggcaggaggaccgcttgagcccaggaggcagaggttgcagtgagctgagatagtgccactgcactcactctggcaacagagcaagactgtctcaaaaagaaaagaaaaaaaaatttccattttcatcaaaaattgtattaaagattttctatgtggtgggttctataatatattcttatagggaataagacctatattatccttcccctccgagagcaatgaaaaaaacacaaatactgaggtgggcagatcacttgagctcaggagttcgagaccagcctgggcaacatagtgaggcctgtctctattaaaaaacaaaaagaaaagaaacacaaatatcacacataattatagacaaacacatagccaagttgaggaagaacagaaacaaaaccaaaacagtttttctgggctgatcactgatcagatagagatcatttacttgcctggcctttgctctaaagatctggtttcatgttggttttctccatgttactcatgaaccccaggaattctggaaaattcttacctttctaagatcaagagtaggtgtagcagtaggagcactttgagtgtcagggtgacagagcccagaggcaaggcccatctgcaggaagcgaagtgacaagttgctgggtggccccttgtgtgatcctagcattgtcaaggaagaaatcttaactgatatttgggtgatagggaatcatggggaagtgtgggtgtggatggggacagccagagacagatgtgactatttttttctttttctttctttttttttggaggcaaggactcactctgttgcccaggtgggagtgcagtggcttgatcaaagctcactgcagccttgacctcctgggcccaagtgatcctcctacctcaggctcctaggtagctgggaccacaggcgtgtgccaccatgcctggctaaaatacatatatatatgtgtgtgcgtatatatataaaatatatatgtgtaaatatataaaatacatatgtacatatattttatatacttatatataaatatatacaatatatatgtactatatatattttatatatatatatatatatttctttttgagtcaaggtcttgctctgtcacccaggctggagtgtagtggtgtgatgatggctcactgcagcttcaacctcctgggttcaagaggtactcctgccttgcctcctgagttgctgggaccacaggcacacactaccacacttggctaatttgtttttcctattttttgtagtgacagggtctccctgtgttgtccaggctggtctcgaactcctggactgaagcaatcttcccacctcggcctcccaaagtgctgggattacagccgtgagccaccacatccagccagctaattgttttttatttttgtagagaggtgatctccctttgttgctcaggctggtctcgaactcctgagctcaagtgatcctccctccttggcctctcaaagtgctgggattacaggtgtgaaccactatgcctggccagatgtgacttttgcttgaaatgtgctccagagccctgcctaagtcccgctcctctgagaagccttctgtcccaccaggtctggagggcaagtgccaagaaatgctctgagctgtttcttcctgaaagtggggcagcttgggctgtcagcatggtttctagcaccgttggggccatggaaagaaatctgtcttcctacagagtcactggctttttatccttccccttctgtccgtggacatgtaccctcttgggagagtattgatcagaggggacagcactgatcatgcctttgccggaggtctgtgcacacatccgcatgggcacctgttagcatgtgcttgctagagctacagatggcttcctgctgccccacaggtggggttctttaccttactttgccccttggtgggtggtgaccagtgggctccttcctggaatatttatgcatgcggaaaaaacatgaacttacaaagaaaaccaagtctattcaagtacacttagcaaaattaacatttgtgatgaagtaacaaatgtttccttattaatgcaataataactatcttgtggcaggtctaattactactataattcaaagtagggatggaggccctagtgacatttgaaatatctgtaacagctgtgatgttatatgaaaatatctgtgatttctactggccacaaagtctctggaagtgctcaaagtacagggatttattatctacattcatgatggaaaaatcttagaaaagaaccaaaaaaacacacaaaaaagaaaaaaaacaaaaatcttggaggtcagggctgggcgcggtggctcatgcctgtaatcccagcactttgggaggctgaggcgggtggatcatctgaggtagggagttcaagaccagcctgaccaacatggagaaacccttgtctctgctaaaaatacaaaattatccagggtggggtggcacatgcctgtaatcccagctactcaggaggcagaggcaggagaatcacttgaacccgggaggcggaggttgcggtgagccgagatcgcaccattgctctccagcctgggcaagaaaagtctcaaaaaaaaaaaaaaaaaaatcttggaggtcagtgaaaataaagatgtaacttttttcttatccaagttcatgggacccctgcattctatccgtggaccccatggggagtggctgtgctccccaagttaagaacccctgggtgacaggtactttaagaaatgcttgtgtgtgtgtgtgtgtgtgtgtgtgtgtattacattctgtagatatatgcacctatgcatctaccaggattctcctacccacagagaaagctacaggggacacctcttaccactccaggtggacctgctatgcacacacacacacacagccacaggcatgtcagagacacactgcatgtgtacatgcacatgctcgtatgcagcacatggggtcatgtgcacacacacccccggagaagtgtacacacaacttacacttatacctgcccacagagctgcagggacacatgctcacacacacaagcatgtggacacatactcctggctctgtacccagcgcttcctgtacacatgtgcacacaattctaagtcctaggcaggatggacagaggaggtcagattcatgccatctggatactgtccccaggcactaaggaggcctaatccaagaggatcagaatcctacccaatccactctccccaagtgcaaaccaaggagccagtgaaactctaatctgtaccctaatgggatttgatcaacgtcgctgtgccaccatgagtggggctgccacagagccctcgatttgagcttgtctgaccccgtggtgagggagtagggcagtgggcccagtacagtgcgggcgccccctcaaaggaaagcattcttcattggtaatgaacattatgtctgcagaaactaatggcccaacctcctattcagtttatgtaaaataaaacaggccatatgctgctgctttcagagtttgggtgtttaaattaaatgttgttcaatgaatattcaagcccatttgctccaaagttgtgctcaatgtggtggtggctctcatccccctccttcctcgcagcccctccctgctccagtacccagggtattaagccattagaacggggtgtgaacatccaggcatctgtcttccaacggaaagttggatattaaaatgccggagcagatgacagtataaataaagacatacagtgagaggctcgtctggttatttttttgtttggtaattaagactgaggaggttttgacttaagttctgtcttattgagaaacagagatagggggctgagatcattccacctcttccctctttactttgcccatctgcccagagagcggcttctgtgttggcctccatgtaactggcttattgacgagtgtcatgttggtggcatagagatgtgaaatgattttatttttatttttattttttttgagatagagtctcgctctgtcgcccaggctggagtgcagtggcgcgatctctgctcactgcaagctacgcctcctgggttcacgtcattctcctgccgtggcctcccgagtagctgggactacaggcgcctgccaccacacctggctaaatttttgtatttttagtagagacggggtttcaccatgttagccaggatggtctcgatctcctgacctcgtgatccgcccacctcggcctcccaaagtgctgggataacaggcatgagccaccacgcccggccgattttatttttctccagctaacttctctctgctgaactctgtcagattatccttaacatgagctggagcagagtccagagttttatggtcagttataactgagcctggttcaaaactggctcatctctgttggaactcccaccttccccatcggaggcccgaccggtgcttgggtgagggaagtggggaggggtagtgtctcttctctcatgcctctgcccactccagagccttgggtcttcctgtctggggttggaggcagggcttcctgtgggtggtggaaggtgactctactctgaccctcctctatcagggtttgcttccctggctgatgtggtggtttccatgtagatggtggggcaggtgtccttgggacagagttcagctcatgccagcaccatccatcactgaatatcccctctgagagaagctggggctctcttcagccccatgagtggtgcactcctccagccctctttctgagtgcggcattgtgtctcctggactgtcctgggattccggcgcatcctctgacctccacatctccatgtggctccacaggaggggctgtgaaatgggggtgcagaggcccacactctttttttcctgagcagtctaccctgtgccatccatactctgctgctggtgtggggtcttccacaagccctccaccttctgagatctctaggggcacgtgggcaacgtgctccatgctcacatctattcccaagctcccggtgtcctgagttaggctcacgggagcactccctccctagattttgttcctctcccacggcagccacagagtggggctgcagatcctgcaggtcggcaggcacccggctcgggagggaaacaccagcttccatctttcgggcacccccatttcttttttttgtggtaaggaagattggggactctttttatatttaatttttgaataaataatatatttacatgattcaaaaaccaaaagaatatgaaaaggcaaatattatctttttttattatactttaagttctgggatacatatgcagtacgtgcaagtttgttacataggtatacatgtgccatggtggtttgctgcacccatcaacctgtcatctacattaggtatttctgctaatgatatccctcccctatcccctaccttccgacaggccccggtgtgtgatgttcccctccctggggcacccccatttctatgagggattctcttggagctcctctcatcacaatgacggctctctacgtgaccacttcccccaccatcctcttctttctcttccctccccagtctttcctatagatggtgtgtgttggtggtttggggtggagcctggtgttagaggggctggttgtgtttctttttgatgaagaccttggggacatgtctgctgctggtgggtctctttagatgtgtgatagtgagcacgtctttgcccttagttttgtttccagtgtcttggggcaacagtaaaaaaaaaaaaaaaaaaaaaaaaaaatcccatttgagatcctgttgcacacatttagactgagagtttgtttaggactagaaaaattttagaaacatcatgagggtcttcctgcttttccccttcactcctatccctaagtcacctcccaacccaaattgctcccatgcctctaattatcccctctgtgcaggagacccccaagcctcctccaccagccctgagctttctctgcaggagtcctcttagctatcccaccactttcagtctgctcagacccaccctcatcatctttccttcccttccgtctcccacaatccaggccagtgttttctctacagtaagaatttgccccacaagcattcaattgagcagctactgtacaccaagtcctgtgataggtgctggggatacagggacaaccaaaaatggttgttgccctcaaagaactcttggcatagtggtagccattgacccaagaagaggtcctcagtatgaaatgggaagagctaaggtaagcacaaggcatgaatatgccacctttcctgggcacacaggaatggcttccgggagggatgatctctgggctcagtcttgaattgcaataagtagcaaagtaagaaataggaaggcattgcagggaaaggaaacagcaagaacaaaggcgtggaggcatggactagcatgtgctgagaacttggagcagttccatgttcctggggtctaaagtgcagggtggggagtgggaaaagataagctggtttcctgactctgttcctagcacctccctcctttcaatcatccatgggcaagttgtggtcgactcctctgcagtaaaccttcacccctgctgttcaccccaccacagagttaaagatggggtggggtggctgaccacatggtatcttctcacttggatgccatgttgccagtaggtgaggatggtgaagtctcccctgtgggaggtggcctggagggaccatttggggtaagacagctaccccaaggccagcccctctgccctcaccctgatccttcctctaggctccgcttttggtctgaattcttaatctcctcgatctttgacttccctttgctttcttaatccttgagtttgctgcagaatttggcccacagatttcatctggtcccttgaataggcagttcagttggatccatctccgttggcattgacattttacacatggcaggatggttttcaggaaaaggacctgtgttgtgtggaccctgaggtatctttatgagttcctgcctggccagctccccaaaactcctggccactactcaactgtcctagagaattgggatcccctaggtgaggtcagttggtagccttcttccttggtgtgtgtgggttgagagagattggcagggagccagtgtcccagctgagaatctgttcctgggctcagaagaagcggagtgtctctgcctagtgaccccgggacattcacagatacgtgatccgtggtgggtgtgctccatcccagtttgatgggatccctggtccaaagcacgtacctaggctcctggctcttccaggcaactggcgagaactcacagaatgcattttctttttttttgagacagggtcttgctctgtctcccaggctggagtgtggtagtgtgatcatggcttgctgcagccttgacctccccagctcaagtgatcctcccacctcagactcctgagtagctgggactacaggcatgtaccactataccgggctaatttttttattttttggcagaaacagggttttgccatgttgcccaggctggtcttgaactcctgagctcaagcaatccacccgcctctgcctcccaaagtgctgggactacaggtgtgagccacagttcccggcctaaatgcattttcttttccttttttttttttgttgagatagagtatcgctctgtcgcccaggctggagtgcagtggcacgatctcggctcactgcacactctgcctcctgggttcatgccattctcctgcctcagcctcctgagtagctgggactacaggtgcctgccaccacatctggctaatttttttttttggtgggttttttttttattatactttaagttttagggtatatgtgcacaacatgcaggttagttacatatgtatacatgtgtcatgttggtgtgctgcacccattaactcgtcatttagcattaggtatatctcctaatgctatccctcccccctccccccaccccacaacaggccctggtgtgtgatgttccccttcctgtgtccatgtgttctcattgttcaattcccatctatgagtgagaacatgcggtgtttggttttttgtccttgtgatagtttgctgagagtgatggtttccagcttcatccatgtccctacaaaggacatgaactcatcattttttatggttgcatagtattccatggtatatatgtgccacattttcttaatctagtctatcattgttggacatttggcttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactgcacatgcggctaattttttgtatttttattttttatttttttttagtagagacgtggtttcactgtgttagccaggatggtcttgatctcctgaccttgtgatctgcccacctcggcctcccaaagtgctgggattacaggtgtaagccaccgcgtccggcccctaaatgcattttcttgataactagagccaagcaattctggaggggaacatgctataaggaaaccgttcattgatttcttcattctttcactctggcagaggctgcactgggaattggaggatagcagaatgaagaagatacagctccttttctcaaggggtttgtggtttagtgggagctgtgagcaggctctgtgatgtgtgtgtttaatggcagtgggcagcacagccagccacctgcagagggggaggggtgcttcttaattcctggatgcttttaatctgcgtgtggtggcaggcccacctacaggaacaaactgcagtgcatcagactatggggtatagttctgggacatattgtgtgatacagagagggtgaggtgccccccaggagaggaaggctctgaactgtgtccatcaagagtggctctggggttggcagaagtgatctgttgtttcactgggcagaggcagccctcctggctttctgagatctaagagtcaggtcgtgctaataatcctggacctattccaggggcccctcccaccacccagtgacaaaaggaagcagctccaaggcttgggacttccttatggccctgaagctaggaaagggagtgcccaggacaggaacaactggtacacccgagcggggctccctcctggtgtctctgcaaaggggagtcatatcatcccagtgagaggcgggaagggcaggcgggagtcagatgctttttctgtgagttgggattgcagttctgcctcccccagagtgtttgttatgagcaaacacataatttgtgaaagtgttgggaaaagatcagctcctgtgaaaaaataaaacactattcacacttctacctgattttttctcattctggtggaattccccccaccacaaatgagtttcttaaaaccaaacaacaaaccaaccagctcacccccacccaccccatcacaacacatttatttagtgcctacttgttgttggttacttacaatgaaagaaaggcaggcagatggataacctagttcaatattttacgtgagatgcattattttactaagtcctttccaaaccatacccatcagatcctatctccatgggagtggagaaatttgagcaacagagaggttaggaaattttcctgaggtcacagggttaggcagtagcagagccggaatttaaaccccagtcttctgtctccaaatgacctgcttggctaatgctagattggccttgaaaggttatatttttatttggttgaggagactctttcagttccaggcgaccaaaacaaacaattctttatgccatggctgggctgaaaattcctcagtgaagggcagtggctctgggaatattttacacatctcttctcatcttcaaaggcagctgagccgtggtgtcctgggttctgtggtggcctcatctgcagactcccacaagaatttggggaaatctttgcaggcatgtgggggttggccccttgggaagaacattcagacagtgtggagtcatagctggtacccagggcccagaagatgccccactgctccttcgggatgccccacgggaagtgccgttccattgttgtgggcggaattttgtggaacacaaccccttggagccagctcaggcacgagggttgcatgtgggggggcccgggcagggcatggttattggagtgggacagggatggatctctagatggaaagtgaggccagcggctggtgggaactggatcttggaagccccagagagggagcagctgctctctcttgggctgcgtggcttagctctttgcctatttctgagcctctgccccattttccaatttgagccaggcttcccctgcttgctttgacttctctgctctgtgtgccccctccagcttcagtttgcaggtagcttggttttctagagggcctcttgtggctgtgaccacacacaaccctaaatgccatcaccatcttacctacattatgttttttctttctacattttgtaattttaaactagatgaagaattccataaaacatgcaaaaaaagcaaggatgtgcccagtgctgaaagcctgggcctggagtgagagtgtggaggcaggaggtagcagtggctcccgggttagcgctgaggagctgcatttaggttaatggggactgggccagggcaggggtgggcctaatggtgacattggcagttgtctggagcagccctgggaacctagctctgtggaaggcagggcaggggtggtgtccccaggggaagggtggtatcaacccacagacacactcaaggctcagaatcattggaagggggtgggtggatgctggtcagtgggtgcccaggctggacaagtgagtgcccctccagacacaggcattgggagactcagcatgtgttcccctccccatcacagagcaaggcaatgtttaaaaactagaatagatgcctaggaagcgggtactgtggccattccaggcacctagaacaagggcaggcttcaaacagggagccctgtggtaacccctcccatctctggagctgagggaggggacaggggaagccaagaacagagacaggaaaaggggaaaagtggccagggggacagacagaaggaggatggtcttcttgaccccatcaccctcagggctgggggcacagagttggcccatcctgccagcctcaccacccctcagaagaggccacagttcttctggctatgattttttattttgagacagggtcttgctctgtcatccaggctggagtgcagtggtgtgatcatagctcgctgcagcctctaactcctgggctcaagcgatcctcctgcctcaggatcctagtcccgagtagctgggactacaggtgcatgccactgtgcctggcttttttttcttttttggtagagatggggttgcactctgttgtccaggctaattttgaactcctggcttcaagatatcctcctgcctcggcctctcacagtgttggaataataggcataagccaccacacccagcccttctggctgttcttgatggtgatgtcagtcgtgctctgcacattctgtttttcatgtcggtgacagcataggtgacttgtgcatggatctccctggtgttcttgcgctattcaggccctctcacttactctgatgtagctggcagcctcgtcagacttgctgacccctgtgtacttgtggaagcagatggtgggggctgcgtgtgatcttctcctcacctaggtccttcttcttgatgaagaggatgacagacgtttccatgaccacttgacatagatgctgccaaacagcttcatgttctggtgtgtgtgattcagcttgtcctcagctcaggccacagatgctcaagcctgcacagaagatggtggctgtgatgccctcaaagcagtgggtccactgctgcccagactgctgactgccacatcagccatcttgaagagagtaggtccctggaggtgaagggcgtctttaagcagctctgcagctccaccttctgtgtgggggcatggtcactctgtgtcctgtggctccaggtcgttcaggtggaaggcggctaaactgtggagctggtgtcctgtgggtaaccaaagcaggatgaaacaggcatcccatggagcaaatccaatgggcagcccagagattccggatgacgctggacagcttcagtttgcaggtggcatctggacaggtcctcagggagtgcaccctggcccacaactgtgtaagacattgcaaactgttgcctggcatcatccgtatggaaggggttggcaaagtcagtctgtaggttgcctgtggccttgacgatggccatgatggcctggagggtgtggctgtagatgactgccctgcacagccaaccttcctcctctgagtaaccatcctcttggatgatctgctttgaggtccttagggcaggtatctatctctagtctaatcaagggagagcgtgtggtacaaccatggcttcctacttcctagagctgcacctaagacaaagatgctttaacacatctgcctggaccaggggctagctgaggacatttgcttcactccagaccatcagcgggagggcagaacctggagcatggcttcccgggctcagtgtctcgtgctctgatcttttcagagtgggcagctgcctctgaaggctctgagccgggagactgtgcttttggggaggaccacgaaacagccattggctggtgggtttccatttgaagtcaagtcattgggagcccatgaagaagacagagtgctgtgggagacccacgtccacaaactcaggagtctaataataccctgctctgagcatctcccacatgccaggcactgtgctcaacattttacgcagggaatctcctttcattctcataagcctgccagtagaaaaggacctgattactgcctttacccaaatggagtcacatccattcgttcatcaagtacttactgagtgcttcctgggtaccacggctgtactgggatatgatggtgtacaacggataatgctactacaagctaactgtggaccagagaccatgccaactaagggttttacatatatgtatcctccccgccttttttttttttgagacggaatttcgttcttgttgcccaggctggagtgcgatggcgcaatctcggctcactgcaacctctgcctcccaggttcaagtgattctcctgccttagcctgccaagtagctgggattacaggcacccgccaacacgcccagctaatttttgtacttttttaatagaacggggtttcaccatgttggccaggctggtctcaacctcctgacctcaggagatccacccgctctggcctcccaaagtgctgggattacaggcgtgagccatggcgtccagcccgtatccattttagttcttagaacaaccctatgaaagaatttccattaaaaaagtcatatccccatttaattaaagagacttcccttttaaacccattttacaaataagaaaactgaagtccagggaggttaagttccttacagaaggtcacacagctagtaagtgtaacaatgtgaattggagcccaggcctgatggcctcttatcacgcaatacaaaaattctgggcaaagatgaatctctgctggccaaggggcagcctggggaagaatgttgtcatggccttggcctaagctggttactgtgtgtgttgaagtggggatggggagcggggttcttgcgtgtgcccctcccaccttcctccttaatttctgcctcctgtcctcgattctgctcctcctgcccggtgctccccatcttggggtcacagggatgcttggcctccacactgtggcactgtttgtgtctgggagctctgcaggcccagctggctgagcagggccatgtttgtcagagctgcccctgccagccatgtcccctgtgcccctgtggactctcctgatgttggaatcatgtctttactgaataacaaactgtgtgtgtgtgtgtgtgtgtgtgtgtgtgtgtgtgtgtgtgtatgtgtgtgtgagagagagagagttagacaaaaggaggccttggcattaggccttttaatgagcaaagtgacaaggtgactgtccttaattggctatcacaacagccaaccaggtcctgctccctccatacaggcctcctgcctccttgaagtggcagccaccactcgatgctcggaaggctggggagcaagcagcagcttttctctcactctctggatccgagacagcttctccccagcaggcaccaactggcttggctggctttctggaacctgggtgacagccttctcccctctgcctggttgccttcattgcctagagagggagcttttggctgttcgtttgaagctcccaggtcattatgataaacttcttgtgttagagctactgcagaagccaccactgagagtatgtggtgaagaggccagtcctattttggagaagttgggagaatgagagaagaccttgggttcctgttgcttcaggatttccattttagctgatgagagaaaacacttaccaatgtcagagccctaacctggcaagaggtggctttgatgtcatggaaagagcactaatgtggcagtcaagggacttggagccaagttctactaagatagtaagtagctgctaatagtatatagtgcttactatgggtgagcactcttctaaacaccttacatattttaattcacaacaaccctgtgaaataggaacattacttcctctattttatagttgatggaattgaagcacagagagggtggtgactggctcaaggtcacagagccattagaggcagagcagacagtcacgagccacttccctgcactcgaggccactgtgttgccactgtcctgctgccagaggcagggccgtgggcctcatgaccacaggggtagctggtcgcctggcccacctgcctgttccacccactgcagctaggctatggatgtgactgtccaaagagtgtgaggcagcaagggatggagcttcttttcccagggacaaaaggaactgcacggagggtgtcagcacaaagctgccctagccagcctttcctagttgatcacaccagtcattaatccacatgcagaacgcagtttgggtccgggctccaggctccacagtcattgccatgttttcacgggcctgataaatgattctgctataaagacttgaagggcaactgtgcaaagtggttctgagcaagattctttaagacctttgtacacattcccattgagtctgaggtcaccttgggaccaggggaaggagaagctggcagtgttgggaagccagaggtctttggtctggagtcacaggaagcctgtaaggtcttgttcccaaaagtcagaggagcagggccttggagagcatttagtccatgtttttcacagtatatgagaggaggcttgggtccagacagaagaaggcagtagctcaaggttgaccaggattagtcttgttctggggctcttaagactgcctggccttttggaaccctgttacaacacattgcatcacatgcattatctcattttaatctccacaccaacccaaggaggtgggtgttattaaggccattttacagatgaggaaatcaaggcccaagtggcagaactgggatttggccccagatacttccatattatttcatgagcttccctttaatattaagaccatctttatatcttccagagcaccttctcttccatgtatagtttgtttgtctggtggccataattcctgagccagcaattcctgactggatggtcagtctaacctcagataggcgaggttcaaatccaactccaccatttagtaagtctgacgtggagcaagtcatgcaattgttgaaaccttagtttctactttgtaaattagggataataatgcctaattacaggacattttttaaggatgaaatgatacagtccttggaagacacttattatattaacaaggatgtaagtggtagctctaattttttattattattgataaggagtgccagtatttgatactgagtcttaccctgaaaacctggaattatgtttgttgcaacttagtgcagtctgattaatgcaataatttttggctgagatctaaagaaggcatggctattattataatcttaataggttttatttttattttttatttttatttccataggtttttgggaaacaggtggtgtttggtttcatgaataagttctttagttgttaccataataggttcattgcccgatgcacacagcaagtcaacatgccaagacatgggagacacgggttgcagcagataaagagatttgatcatagggtcaaggaatcaagatatgggaggggacctcaaatccatctcctcaaggaagttggggtaggagttttaagggttttggagtggaccaaagtgtggaggtggaagagtgaaaggtgaagtcactgggcaggtagaagcagcagctgtattctcatgctaatccccttcctctctcagggtcttcaaactggttgctggaattggggcctgaaaaacatcttaagtgatccttcaacaaaagccttatgattctaatgatagagatcctgtatgtgggaacaatggggatgcaagtcaattctttttttttttgagatggagtcttgctctgttgcccaggctggagggcagtggcttgatcttgtctgactgcaacctctgcctctgggttcaagagattctcctgcctcagcctcctgagtagctgggattacaggtgtgcaccaccacacccagctaatttttgtatttttagtagagacggggtttcaccgtgatggccaggctggtctcgaactcctgatctcaggtgatctgcctgccttggcctcccaaagtgctgggattataggtatgagccaccgcgcctggctgcaagtcaattcttaaacagtcttatgatcctaatgtcagaaatctcgtctacaggaacaaggggatacaattggtcaggatctagtgctgcatgactttcagcaacaaggaagtgagccaaagtgcagcctgattaatgcttaattctaagtatatttctgtccagaactcagcatgcaattcttgtcaactctataggaatggtttcattatcatttcatttattaaggtctgtggttgaataatggctccccaaaatatcctagtcttagttctggaccctgtgaatatgttaacttacgtggcaaaagggatttgcagatgtggttcaactgagaatcttgagatggagaaattgtggtagattatctgggtgggcccaatataaccacaaaggtccttataagaaggaggcaggagggtctgagttggagaagataggatgatggaagcaaaggtcagacacagagaaagatgaggatagtttgttgctggctttgaagatggaagagggggccatgagccaaggaatataggcagcctctagaagctgggagcagcttctcctctagagcttctgtgaggagtgcacccttgcccacttattttggacttctgacctccagaactgtaaggtcataattttttttttttttttttttttgagacgagtcttgccctgtcgcccaggctggagtgcagtggtgtgatctcagctcacttcaacctctgcctcccgggttcaaacgattctcctgcctcagactcctgagtagttgggcctacaggtgcatgccaccacgcccagctaatttttgtatttttactagagatggggttttaacatgttggccaggctggtctcgaactcctgacctcgtgatccgccctttttggcttcccaaagtgctgggattacaggcgtgagccactgcacctggctaaatttgtttttttttttttttaagccactaaatttgtagtaatttgttactaaagcagtaggaaattaatacaagatccttatttaatactttctactcaaattgcccaggctttttttttttttttttgagacagagtcttgctctgtcgtccaggctggagtgcagtggtccaatcttagctcactgcaacctctgcctcccgggttcaagcgattcttgtgcctcagcctccccagtagctgggattacaggcacgcacccccacacctggctaattttttttttttttttttagtatttattgatcatttattgtttctcgcggagggggatttggcagggtcataggacaatagtggagggaaggtcagcagacaaacaagtgaacaagggtctctggttttcctaggcagaggaccctgcggccctccgcagtgtttgtgtccctgggtacttgagattagggagtggtgatgactcttaatgagcatgctgccttcaagcatctgtttaacaaagcatatcttgcaccgcccttactccattcaaccctgagtggacacagcacatgtttcagagagcacggggttgggggtaagtttatagattaacagcatcccaaggcagaagaatttttcttagtgcagaacaaaatggaatctcctatgtctatttctttctacacagacacagcaacaatctgacttctctatcctttcgccacatttcccccttttctattcgacaaaaccgccatcgtcatcatggcccgttctcaatgagctgttgggtacacctcccagatggggtggcggccgggcagaggggctcctcacttcccagaaggggcggccgggcagaggcgccccccacctcctggacggggcggctggccgggcgggggctgccccccacctcccggatggggcggctgctgggtggagaggctcctcacttcccagacggggcggctgccgggcggaggggttcctcacttctcagacggggcagccgggcagagacgctcctcacctcccagacggggtcgcggctgggcagaggcgctccccacatctcagacgatgggtggccgggcagagacgctcctcacttcctagacgggatggcggccgggaagaggcactcctcacttcccagactgggcagccgggcagaggggctcctcacatcccagacgatgggcggccaggcagagacgctcctcactttccagacggggtggcggccgggcagaggctgcaatctcggtactttgggaggccaaggcaggcggctgggaggtggaggttgtagggagccaagatcacgccactgcactccagcctgggcaacattgagcactgagtgaaggagactccgtctgcaatcccggcacctcgggaggccgaggctggcagatcactcgcggttaggagtggagaccagtccggccaacacagcgaaaccccaaaaaatacgaaagaccagtcaggcgtggcggtgcgcgcctgcaatcccaggcagtcggcaggctgaggcaggagaatcaggcagggaggttgcagtgagccgagatggcggcagaacagtccagcttccgctgggcatcagagggagaccgtggagagagagggagaggggagaggggagaggggagggggagggggagagggagagggagaggttttttgtatttttagtagagacagggtttcgccatgtttgccaggctggtctcgaactcctgacctcaagtgatctgcccaactcaacctcccaacatgttgggattacaggcgtgagccaccatgcctggcctgcacaggcatttaatagcgactctgctattaggccaggtgctgctgggcactttcacctcaatgtgtttctctaagcattgtgatgagtggatgcagaatgggctttttttgttgttgttagagatgggggtctctctctgtcacccaggctggagtgcagtagcaggatcacggctcactacagccctgcagccttgaactcctgggctcaaagtatcctcccatctcagcctcctgaatagctggaactataggtgtgcaccaccacacccacctaatttttaaattttgtgtagagatgggatctcacatatattacctaggctggtctcgaaatcctggacctcaagctatcctcccactttggcctcccaaaatgttgggattacagtcatgagccaccgcacctggcctgagtgggctttgatgtagaagatcttagcaggaatcccagctccactctcatttgtggtgtgatcttgggccaggcacctgatctctctgagcctcagtttccttatctacaaagtagagagtataacagtaaaagtacttgacgtggtgggcttggcacttggcagattctaacccaatccatcttgctgcctccttctcccaggcttggatgcatctggagattctcttccctaggatagcccctttgactctggggggtaatgttgagtgtttcctgtcttaggggtcccctcagggacagaatcaggactaggcagtacaaagagctcacattcagccagggctttcctgaggttgaaccagctccttgatacctaccctgttttgggggacccagatgttataactctcctcacctggggccggtctcacttgggcatggatgggacattcagctcagggctcacattatcaaagacttcagatatggacttttgaggtcattgccccatgaggttatacttgcagccccagagctggctggtgggcctgaaagaagatgtatgtgttggggttttgaactcatacctcagtcctgcccctcattaccagccatgctcttgacttcgacttcatacttgtcaggaatacaggatttatttttatgatcagcaaaatcacattgcattgcactttattttgggttggtgggttaaaacaatatattggtaaatgcacacattgaaaattcttcacttttttttggtttgcattctggctttggcagttcttcatttttcactctactctgagcttctggaaggggaagtagcctgagttgatcttaatcacatgaaagctttgcccctaaccttcctttttatctgggtctcctgtatttgaatagaggcttttccctgttgaagccccgtcccgttcattacctcctgcaatgctctcaacagatctctgagtgaggtattattattctgctctgattcaaccaggatgcatgggcgagcaggttattgccaccatccactccaattggtcagggcccgtgctgtactgatggttacctatttaaatagtaaacctgattatccccattttacagatgagacaactcagataggggaagaatgtgtgtgaagccaggcagctgaaaccagggcctctaactctgagaacctgtgagcttttccctctgtccaagctccccctctttatggaaggtttagtcacactggctttaaagaccccattacaatatctcagtttcttttctttttaccacctcggaagtggctgtaaaaatattaaaaccaattgccatcatctttcagactgctgcatttataagatgtagctttcaaatgaatggaaataatcgaaactccctccctgttccattctgtggggccatttcagatttatacaatatttctgaaagctcttataatagagcatatgcacttagggcattaatgaagtcggctcagtgcttgctggtctcatttcatggagctaattgttaagtgttttgcatacttacaattgaactaaattattccaagctagctggtttcaggaagtgttaattatatttcagtaaaggaaaatcaaggctaaaaaatcatccacttagagcttatctatttatgaacatctcattctggagatctcaaacatatattttaacgccatgtgaatattgagattaatatttcttaaccaaagaaacctttattccttccttgaatagggaccctcatcccatccttccacttttatttagcagtctagtctggaagttgaaagaaaccttcctttgtatttctggcaccttgaatctttaagttggatgccaagaacagcattagctccattcatctggagagcaactggccttctgtaactgatattaagtaattaatttatgggtcctgcacaggccatttaggaccaagtgctcccttgcttctggggtttgaggaaatcactgggacagttttcacctgggacttagcttggaggggctgagtggtgaagggttgtcactcaggtcttagttcaggggcaggtgtgggggtggggagtgggtgggagtgggatgtgaggtcccagttggggaggggagtctgtaacacctgcattgtcctctcccacccttctcttcctcctttttggatcagcagggctgaatgaatgcctgaatgaagtgctccgagctttttttgtatctgatgctcaatttctctgccacttgttttgaactttctgtttattcaccatgcatgcattcattcgctcactgagcgcacacatatgaagctaaggaaggcccatcactcgagagcactgggccagggcctgctagggagagctgagactggcagagcccccaccttccgaaactctcacaatacatcaacggacctgggcatcagcaccagtgcagggcctgttcaaacacagagtgctgggccccaacccagagttctgatgcactggggctggggagggctgctaattggcatagctaacaggttcccagggacactggtgctcaagtgtagtgatcaccctctgagaaccactgcaggagactggttacatcctgagaccatcttgatttgcttatttatttatttagaggcagagtctcgctctgttgcccaggctggagtgcagccttatgatcttggctcactgcaacctctgcctcccagatttaagcaattctcctgcctcagcctcccaagtagctgggattacaggcatgcgccaccacaccctgctaatttttgtatttttagtagagacgggctttcaccatgttggccaggctggtcttgaactcctgacctcaggggatccacccgccttggcctcccaaagcgctcagcttacaggtgtgagccaccgtgctcggcctgcatctgaatttatatacatcactgtcacagagccctttttggttggcgttgatgagaggggcatttgttttttaacaaataaagattttttcattaaaaaatcactttacctcatatataatgactagagaataaccaatatgtgttaagatgtggatgctggtggttagttgggctcaggtgtctgctgcacaactccccctgcatgccagccttcccacctgagattcaaacccacgtctctgcaaaatgacaaactactccttttcagaggcctgcagggatgcttgggtatctttgggaccttggatagaattaatatatatattttttgagatggagtctcactctgttgcccaggctggaatgcagtggtgcaatcttagctcactgcaacctctgcctctcgggtccaagcgattctcctgcctcagcctctggagtagctgggattacagacgcccgccaccacacccagctaatgtttgtatttattttagtagagatggggtttcattgcgttggccaggttggtctcaaactcctgaccttatgatctgcccacctcagcttcccaaagtgctgggattacaagtgtgagccaccgcgcctggctggaattaatatttaagagtagtgatatgaatgtgatctcagtgttaagtcttcacaggtccaggtctgcccaaagcttatacaggcctgagcttggtccctgggcactaagcgaggcatgccccacaggcagagaggagaaggggatcaggaaaggtcacaggggttggtgagttgacagttcacttggggtcttgaaggatgaatcattttctagcactggagcgatggtgggatgagggacattttgagcagagggaacagtctttgtaggcatggaggtgagaaagggcaggactggttcaaagaacagagagaagggtgcagacgttgctttgtatgtctgcgtgctggggggcaggaggaagaatggcaggagatgaagctgtattacaaaaaccttgagcgtgaggctgaaaaattagactttattctgaagtaaaggtgatagaggatcacttgacattttataggagtgaggagtgactcaaaaactgctattgagtggggctggggctacagaagaagtctggcagtgctgggagccaaatgggaggtaaaacgaatgaaagagaaataaaaaaattagttcttcagtagtagcagccacatcccaaaggctctatggtcacatgcaggccgtggctaccactggacagtgcaactgcagaacttccccatccttgcagaaagttgtgcaagacagtgctggtctagaaggggcccatggtgtctgcatgggcatatccccttggattcacagattcctcacctcggggagagaggggtgtggccacaggaggaccagagtggaacactctaaaagtggagggcatgcttgttgcccaaggtcaaggacagttggcaggtggtgctgagttggaaggtcattagactcagggcctggggctgccatgtttgggtggctgggaaggctgagtgcagggagatgagaagcctgtctgtgtagagagcgggagcaaggcaacagacctgcatccctgcatgtgacagaagcagagagaatggggccctgatggacttccattcccgtgacacctgggtatcttcaaattaatgctgcccccacttttacccaagatagtttgagtgggtttttgtttcttgcaaccccaatgatgaggagtggttgactccccgtcacccagcccaggacggggcacacaccagtgttccaccaaagctcgttgagctgtcaagtgaacgtgggacaagcagagggagggagaaggctgggggctgcccctttttcctcctcccaccccctcgaatgcagatggagatactggggacgggaacctgaaagatgttcccttttcccttcacctttggcacctggaatgtggttcccctccatcccaagctacacgtgtgcattggtggtgctgtctgtgatgtcttccctcacatcaccaagggctcacgtcaattcaggtggcagtttagaaccaattaaaatgtataagccacaggtagtgagtgaaatcccaaggattaatttgctcagtggagtgttaatctgtgtaatgtcataggcgcttcttcaaacaatgcggcaagatggagccgggaggttcttccccacccctgttttcctgtaaatgccctagttggtccccctgggctgggtgggtgtggcttcatctcctctgagcgctgggaagggctgagttagctttttgggcccccacccgagcctcctagaacccagtcctcctccttgctactgggcagggccgccaaccacactggcagagataggccctctcctctctgtccagccttcctttgctctgtgcttcctttctgcattgcccctggggcaaggtacgggaaggcacagtaatgggcagatccaacctgcccccaggacttgcttcccagggctttgtaattagaatccttcccaattagcaggtagagtggatcagcatccaagttaataacatggcgatgcccacctgtccagccagtccccctgcctccaagacagcccaaagagcaggagagaggacttactaatgatgagctgcatgtccaatcacagccccatggctggctggttgtgagcctgtccactgagtcttggtgctgggattcaggagacctgtgttctaattaaattccttcccccaccagagcttagctcaagaaaaccttgtctcaagggagctcggttttcacctggagaatctaaacgtcagtgtgtgcaagtcagagcactcactttgcagccagtgacactggaccctggcttatgtggcttgtctggagagctaggcagtggccaacagtgggagccatttaatagaatggctaagaattatcgctttggagccagacagacctagattcaagtcctttctctgaacgtagtagctgatgcccttaagcacattttaaaacttctctgagcttgtttcttattactagaatggcgatcaaaatacctacattgcagagttgcatgacgtatatgaagtggtagcacagtacttgcaaatagccatcccttaacaagcggtggcttgtattattgtcgttaatagtaatgataacaaaagtatccttaaatgtcctgagccccagccttcatgctgtctggtccctatcaacctcccctgccaataaaaaagacctgttctgtctaccttacctgtgggctctgacaatgaggtgggacaatggataggatagctttgaaaaggatataattgaccaggcgtggtagctcacacctgcaatcctagcagtttgggaggccaaggccaaagcagatcacttgaggtcaggagtttgacaccagcctggtcaacaaggtgagaccccgactctactaaaaatactaaaattagccagaaatcgcttgaacctgggaggcagagttgcagtgagccaagatcgtgcactccagcctgggcaacatagcgagaatccgtctcaaaaaaaaaaaaggtataattgatatttaagcataaataattattattaccatttagctttaaatggaaggccccagaattctctggggatggctcactcactctgatgacatggggaaggaagttcaggacagaatttcctcttggcttcagaagactctgcattggggtgagcattgttaattcaacttcattattgccagcaacagaaattgatctagctgatttaagtagtaaagaaatttgttgaaagagaatatgatcatttggagcattagtgggaaaactggggaaccaggatgagggtggctgggcactaagaccccagtctaaactgtgctgtagggaaaacttagcatgcagcttatgttctttatggacgtgtacctggaccacaccctggtgccctgtgaacataggtgctgcctaaaccgttgagattcattctctcctgactctgtctgtctaagtcacctgtaagtcctgggtatctgtttggctcttccttggtgatatgctagagtctagttgtatagaggagcagggaaattttaaacaagtgttagacctgtactgttttctgtattaggaggaggactctgctccctgaagacccaggtggtaggagagctgcaggggcttcctattcaccgcacctttctttcttgcattccttccagggaggattatgttgacccctttctgcccatgagaaaatggaggcgcctttcttcccagacctgcctaagatcaaatcgctggtaagtggctgagccaagatgatagaactcagtttgctggctccagatcctgtccaatgcaaatggtggaaagaggttgttggttgctaatgacctgaacaggggatgggcggcaccctcttatggcccagagagctttccttgccttgcccgagctgcaagagctcagggtcccagattcaagatctggattagttagagctggcaattctcaggcagtcgctgaccttgcagaacttccttgggctggtgccactgctacttccttgcagggaggaggaagatgcttctggagtgctggaggaggttctgccatgacctggtcccattttcctcttctgattaccaagtgccaatgaggtcagacaactgatcaaagtgaacatctctgcctattgaaatccccctcttccttcagatccaggtcaaatgcccctctctgtgaaggtttcctgatcagccccggtgggctggatcttttaattttagtttttaaatttaaaaaaattttaatttttatttattttatatttgtgtaggtttttgggggaacaggtggtgtttgattacattactaagttctttagtggtgatttctgagattttggtgcacccatcaatctttttcttattttttagagaccgggtatagctctgtcgtctaggctggagtgcagtggtgcagtcactcctcactgtaaccttgaactcctgggcttaagtcatcctccctcctcagttttccaagtagctggaactacaggtgcatgtcaccaagctcagctaatttttaaagttcttttatagagatggggactcactgtattgctaggctggtctcgaactccagagattaagtggtctgcctgcctcagcctccaaaagtgctgggattacaagtgtgagccaccatgaccagccatggatctctttattcttgcattgctggagtcccaggcagagtgagatattaatcctttcctcagagttggcagccaggacttggattccttgatattgcccaccccatggcaaattataggtgcacagtaatgttttataaaaacagaaaggtctcctgcttttatgtctcctctccacagatataagtgctttatggtgaggggattcatgtggctagaacagggggtatgtggcagggtagctggaggtgtggcagggtggctggaggctagacagggctcagtgttggggcttgctgaaggaggccctgtattctccaggctgcaaggaggcttgatcctgtgggcagtgggagccatcggaggtgctctgtcaacctgtgctgagaagtgggctctggcagtggtaaggtgagaagcccagggctaaaggtaaagtctggatgaggacaaccaggggtgcttgatgagtctgaattaggcatggggaggccagtgctggaattagcagtcaagaaaaagaagggaaaaaggactgggcatggtggctcatgtctgtaatcccagcactttgggaggccgaggcgggcagatcacttgaggtcaggagttcgagatcagcctggctaacatggtgaaaccctgtctctacttaaatacaaaaattagctgggcatggcggtgcatgcctgtaatccgagctacttggaggctgaggcaggagaatcgcttgaacctgggaggcagaggttgcagtgagcccagatctcgccactgcactccagcctgggtgacagaaagagactctgtctcaaaaacaaacaaacaaacaaaacaaaaacataaaaaagaagggaaaaggggaaacataaaaaagaaggggagactcacattgcccggtggcctctgatgggctgggcagtgtgtaatacagtgaaaaggggttcaggagaattctcaaaaccccaggggcacacccttttcaaaaggaggggcaatagcaactctatagactacagaggaggctagtctgtggagggctgaagataggtggctggaatgggcagcgaggaggcccatggcagcccggtgtgatggttttctagggcatgatggtggcaggattgatgctgctgctcgaaccacacaactagttggaaatgcaaacactgctggacctggcacagcacgactcggcattgctaattagccctgagattattccttgcaaggaagcaactccatcacacctgacttatggctgaactacctgagcaggaggcaggttgagttcgtggctgctggtggacacctttcgccttgattttttttcagaaatgccccaaacaatcacccagctcctacctcctggtcctacctctccagggtgacagttcttaagtcttattagttaacagagggactgatttgcggaacagaaaagtcatgaagagagaatgtggtgtaaatgttaatcgtttttttaacttcgcattatgtgatccgttaacattaatatttaatttaatgcagtcaaaagattaatgcatgtgtttatttctaaaaaaggcaaggatgcttcaggctgcttttcagcttggttgagctttgggaaaaaaagaaaaaaaacatcaccacaacaacccacccagcccagaagaaatgtattcatgccataataatacaagtatcctctctcccacccgctctccctcctcaattcctaaaaataagccacagggttctaatggggaccctgattaaatattcggctctgtaatttatgcccaagtgaatcccaacaggaaccagaggccctggaaatctgttgtgaaataattatcctgaatgacattgtggagatggtctgcgagggtgctgtcaataatgcattagcccaaatctgtttgaaatacagcaaggaaattacacgatattcatgggaacctgaaagaattatcagtaaacaaatttaatcaacttgatgttatgcataccactcaacctcttattatctgatcatctaggtttagaacacgcaggggaattgaatgacgtgggatgcaaggctgaggctgtgtgtgtgtgtgtgtgtgtgtgtgtgtgtgtgtgtgtgtaagcttggtggaattggcctcagatctttgcatttcttctccttagcagcatttcatttgcatttttctctaggcctgattgttggctgccagctttcatcccagcctggcccctgaactcccatttttttcccccagtgtcaaagccatctttagaaaagtcagctgactgcccacccatcctccagatcccttctgtctttcagagaaggagtggctgcctctgcccaatatttcagaagcaaagaggtagggtggagaggaattgagtgctgttatctggagagatgcttctaccatagaagaaagagccctgtaacctcatggtgggagtgaggatctgctgctaatttgttgggtgatcttatttaagtccctttccatctctgggccttagtttttccatctgtaaaatggaacttgggatggatggtctgtgtgattttatgacaccttggtagaagcttggcagcatctcatttgctggattgttctctttgtcctctggaacctgatgggtatccaagaggaaaggagctttctcaagatcttatgggaaggtggaggcagagtcaagatgagagctttcagatccacttctcacaacccctccacccccaaagtcagaacattgcttttcctctgcactaaaagccctgggaagcattttggagtctttattttaaacttagctcttgggtttgctgagaggggacttgggttgtccttcccaggtctacaaatccctttcaatttctagacctcagcttcccactctccacacgacaaaggggttggatgaggcggcctttcagagacctcttatcccagctttgatattctacactgttatctatgttttaaattccttggggaggagccaagatggccgaataggaacagctccggtctacagctcccagcgtgagcgacgcagaagacgggtgatttctgcatttccatctgaggtaccaggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgacggatgcacctggaaaatcgggtcactcccacccgaatactgcgcttttcagaccggcttaaaaaacggcgcaccacgagactatatcccacacctggcttggagggtcctacgcccacggaatctcgctgattgctagcacagcagtctgagatcaaactgcaaggcggcagcgaggctgggggaggggagcccgccattgcccaggcttgcttaggtaaacaaagcagcctggaagctcgagctgggtggagcccaccacagctcaaggaggcctgcctgcctctgtaggctccacctctgggggcagggcacagacaaacaagaagacagcagtaacctctgcagacttaaatgtccctgtctgacagctttgaagagagcagtggttcttccagcacacagctggagatctgagaacgggcagactacctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgctaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaaattggataaagagtcaagacccatcagtgtgctgtattcaggaaacccatctcacgtggagagacacacataggctgaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcatctctgcaccaagcggacctaatagacatctacagaactctccaccccaaatcaacagaatatacgtttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaacccttcaaaaaatcaatgaatccaggagctggttttttgaaaggatcaacaaaattgatagaccgctagcaagactaataaagaaaaaaagagaggagaatcaaatagacacaataaaaaatgataaaggggatatcaccaccgatcccacagaaatacagactaccatcagagaatactacaaacacctctacgcaaataaactagaaaatctagaagaaatggatacattccttgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcgttctgataccaaagccgggcagagacacaaccaaaaaagagaattttagaccaatatccttgatgaacattgatgcaaatatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcagcagaaggaaataaagggtattcaattaggaaaagaggaagtcaaattgtccctgtttgcagacgacatgattgtttatctagaaaaccccatcatctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatgaattaaagatttaaacgttagacctaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactaccatcacagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttatactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccgtggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggaggggggaggggtggcattgggagatatacctaatgctagatgacgagttagtgggtgcaacgcaccatcatggcacatgtatacatatgtaactaacctgcacaatgtgcacatgtaccctaaaacttaaagtataaaaaaaaaaataaattccttaattggctataggtttgtgctttgaggaagggagtctagtttccatttctacactgaatgctcctttccactttgttgtgaagtgcaagtgtattcttgttgagcacctgctgtggttggcacccaggaccaggcactgtagggtggatatgctcattgagtcctgttttgtgcctggccctgcacctcgtgttgggataacttgatggcacttgggaagttctacttgcagactaagaaagccaattcgctcaacgagttctttcggggcacctaccatatgtctgtccctattcttggcattaggtgggataatagtatttattgaatatggactatgagctaagcactgagctgagcacttcacatgtttaaaagcatagtgaattccccttgcctcagaatggatcatcaggaagtaaaggtagagacaagaggcagaatgcacttgtgtcataaagaatactcaaaacagccaggcgcagtggctcacacctgcaatcccagcactttgggaggctgaggtgggcagatcacaaggtgaggagatcgagaccatcctggctaacacggtgaaatcccatctctactaaaaatacaaaaaattagccgggcatggtggcaggcgcctgtagtcttagctactcaggaggctgaggcaggagaatggcattacccaggaggcagagcttgcagtgagccgagatagcgacactgcactaccgcactccagcctgggtgacagcgagactccatctcaaaaaaaaaaaaaaaagaatactcaaaacaaagaggtgcaggcaaccccccagaagctactgaatgggttcttctacctccagctatcactgaagctcagccctgtgtgaagcccacatagtcccagcctaacagatgaaagtgtatttctggcactgtccaataatggtagccactagcctcaggtggctgttgagcatttgaaatgtgactagtccagactgagaagtgctgtaaatgtaaaatacaaaatggatggtgaagatttatgcaataaaatagtgtgaagttatctcattaataattttttatattgagtacatgttgcaatattttggagataactgagttaaataaaatattgtattaaaattaattcaaccaatagtcatattacttgctttattatgactaaatatgactaaaatttaaaattccatatgtatcttgcattatatttcattggacagtgctggtttagatattcaaagaatttatctcaagagattagggagtccttggaggatggtgattgtggctcctctgatttctcatgggagaggttagaggggagtttgtcctccactccatgtaaagggttctaagagaattactcatagagatgtggaggagctgatgaagattggtgatatggtttggctgtgtccccacccaaatcttatcttgaattgtattttccataatccccacatgacaagtcatgggagggaccaagtggagataattgaatcatgggggcagtttcccccatactgttctcataatagtgagttagttctcatgagatctgctggttttataaagggcttccccttgctggcaagatggccaaataggatcagctctggtcttcagctcccagtgagactgaggcagaaggtgagtgatttctgcatttccaactgaggtaccttgctcatctcattgggactggttggacagtgggtgcagcccaagaagggcaagccaaagcagaatggggtgtcgcctcacctgggaagtgcaaggggttggggcactccctctcccagccaagggaagccattagggactgtatcatgtactccggcccagatactgtgcttttcccatggtcttcgcaacctgcagaccaggagattccctctggtacctacaccaccagggccctgggtttccagcacaaaactgggaggccgtttgggcagacactgagctagccgcaggagtcttttttttcataccccagtggcacttggaacaccagcgagacagaaccatttactcccccggaaagggggctgaagccagggagccaagtggtctggcttggcgggtcccaccccaacggagtccagaaagctaagatccactggcttgaaattcttgctgccagcaaagaagcctgagcttgacctgggatgctggagcttggtggggggaggggcgaccaccattgctgaggcttgagtaggtggttttaccctcacagtgtaaataaaaaccgccaggaagtttgaactgggcggagcccaccgcagctcagcaaggctgctgtggccagactgcctctctagattccctcctctctgggcagggcatctctgaataaaaggcagtagccccagtcagggacttatagataaaacccccacctccctgggacagagcacctgggggaaggggcggttgtgggcgcagcttcagcagacttaaacgtccctgcctggcagctctgaagacagaagcacatctcccagcacagcgttcgagctctgatagggacagactgcctccccaagtgggtccctgacccctgtgtatactgactaggagacacctcccagtaggggccaaaagacacctcatacaggagagctctggctggcatctggcgggtgctcctctgggatgaagtttccaggggaaggaataggcagcaatgtttgctgttctgcagcctccactggtgatacccaggcaaacagggtctggagtggacatccagcaaactccagcagacctgcagcagaggggcctgactgttagaaggaaaactaacaaacagaaaggaatagtatcaacatcaacaaaaaggacatccactcagaaacccagctgaaggtcactgacttcaaagaccaaaggtagataaatccacaaagatggggagaaaccagtgcaaaaaggctgaaaattccaaaaaccagaatgcctcttctcctccaaaggatcagaactcctcaccaacaaggtaacaaaactggatggagaatgagtttgatgaattgacagaagtagactttagaaggtgggtaataacagactcctccaagctaaaggagcatgttctaacccaatgcaaggaagctaagaaccttgaaaaaaggttagaggaattgctaactagagtaaccagtttagagaagataaatgacctgatggagctgaaaaacacagcacgagaacttcttgaagcatacacgagtatcaatagccgaatagatcaagtggaagaaaggatatccgagattgaagatcaactcaatgaaataaagtgagaagacaagattacagaaaaaagagtgaaaagaaatgaacaaagtttccaaaaatatgggactatgtgaaaagaccaaatctacatttgatttgtatacctgaaagtgacggggaaagtgtaaccaagttggagaacactcttcaggatatcactcaggagaacttcctcaacctagcaaggcagggcaacattcaaattcaggaaatatagagaacaccctgaagatactcctcgagaagagcaaccccaagacacataatcatcaaattcaccaaggttgaaatgaaggaaaaaatgttaagggcagacagacagaaaggttgggttacccacaaagggaagcccatcagactaacagcagatctctcggtagaaagatacaagccagaagagattgggggccaatactcaatattctcaaagaaaattttcaacccagaatttcatatctagccaaattatgcttcacaagcaaaggagaaataaaatcctttgcagacaagcaaatgctgagagattttgtcaccaccactcctggcttacaagagttcctgaaggaagcactaaacatggaaaggaacaactggtaccagcaactgcaaaaacataccaaattgtaaagatcattgatgctatgaagaaactgcatcaactaatgggcaaaataactagttagcatcataatggcacgatcaaattcacacatatcaatattaactttaaatgtaaatggactaattgccccaattaaaagacacagactggcaaattggataaagagtcaagaccaattggtgtgctatattcaggagacccatctcatgtgcaaagacactcatagcctcaaaataaagggatggaggaatatctaccaagcaaatggaaagcaaaaaaaaagcagaggttgcaattgtagtctctgataaaacagactttaaaccaacaaagatcaaaagagacaaagaatagcattacataatggtaaagggattaatgcaacaagaagagctaactatcctaaatgtatatgcacccaatacaggagcacccagattcataaagcaagttctttgagatgcacaaagagacttagactcccacacaataataatgggagactttaacaccccactgtcaacatcagatcgacgagacagaaaattaacaaggatatccaggacttgaactcagctttggaccaagcagacctaatagacatctgtagaactcttcacctcagatcaacagaatatacattcttctcagcaccacatcgcactcattctaaaattgaccacataattggaagtaaaacactcctcagcaaatgcaaaagaatggaaatcataagtctctcagaccacattgcaatcaaactagaactcaggattaagaaactcacttaaaactgcacaactacatggaaactgaacaacctgctcctgaatgactactgggtaaataacaaaatgaaggcagaaatacagatgttctttggggatgggtgtagtggctcacgcctgtacttcaggaggctgaggcaggtggatcacgaggtcaggagttcaagaccagcctcgccaagatggtgaaaccccgcctctactaaaaatacaaaaattagccaggtgtggtggcaggtgcctgtaatcccaactacttgggaggctgaggaagataattgcttgaacccaggaggcagaggttgcagtgagcagagatcacaccactgcacatcagcctgggtgacagattgagactttgtctcaaaaaaaaaaaaaaaaaaaattgaaaccagtgagaacaaagacacaatgtaccagaatctctgggacacatttaaagcaatgtgtagagggaaatttatagcactaaatgcccacaagagaaagcaggaaagatctaaaattgacaccctaacatcacgattaaaagaactagagaagcaaatgcaaacaaattcaaaagctagcagaagacaagaaataatcaagatcagagcagaactgaaggagatagaggcatgaaaaacccttcaaaaaaatcaatgaatccaggagctggttttttgaaaagataaaaaaaatagatagaccgctagccagactaataaagaagaaagagagaagaatcaaacagatgcaatacaaaatgataaaggggatatcaccaccaatcccacagaaatacaaactaccatcagagaatactataaacacctctacgcaaatacactagaaaatctataagaaatggataaattcctggacacctacaccctcccaaggccaaaccaggaagaagtcgaatccctgaagagaccaataacaagttctgaaattgaggcagcaattaatagcctagcaaccaaaaaaagtccaggaccagacggattcacagccgaattctaccagaggtacaaataggagttggtaccattccttctgaaactattccaaacaataggaaaggagagaatcctccctaactcattttatgagaccagcatcatcctgataccaaagcctggcagagatacaacaaaaaaagaaactctcaggccaatatccctgatgaacatcgatgcgaaaatcctcaataaaatactggcaaaccaaatccagcagcacatcaaaaagcttatccaccacgatcaagttggcttcatctctgggatgcaaggctggttcaacatgcacaaatcaataaatgtaatccatcacataaacagaaccaatgacaaaaccacatcattatctcaatagatacagaaaaggcctttgataaaattcaacaccccttgatgctaaaaactctcaataaactattgatggaatgtatttcaaagtaataagagctatttatgacaaacccacagccagtatcatactgaatgggcaaaaactggaagcattccctttgaaaactggcacaagacaaggatgccctctctcaccactcctattcaacatagtattggaagttctggccaggcaaccagccaagagaaagaaagaaagggtattaagaaaagaggaagtcaaattgtctctgtttgcagatgacatgattgtatatttagaaaaccccatcatctcagcccaaaatctccttatgctgataagcaacttcagcaaagtctcagaatacaaaatcaatgtgcaaaaatcacaagcggccgggcgcggtggctcacgcctgtaatcccagcactttgggaggccgaggcgggcggatcacgaggtcaggagatcgagaccatcccggctaaagcggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcctgccactgcactccagcctgggcgacagcgcgagactccgtctcaaaaaaaaaaaaaaaaaaaaaaaatcacaagcattcctatacaccaataacagagagccaaatcatgagtgaactctcattcacaattgctacaaagagaataaaatgcctaggaatacaacttacaagggatgtgaaggacctcttcaaagagaactacaaaccactgctcaaggaaataagagagagcacaaacaaatggaaaaacattccatgctcgtggataggaaaaatcaatattgtgaaaatggccatactgcccaaagtaatttatagattcaatgctatccccatcaagctaccattgactttcttcacagaactggaaaaaactactttaaatttcatatggaaccaaaaaagggcccacatagccaagacaatcctaagtagaaagaacaaagctggaggcatcatgctacctgacttcaaactatactacaaagctacagtaaccaaaacagcatggtactggcaccaaaacagatatatagaccaatggaacagaacagaggcctcagaaataagacaccatacatctacaaccatctgatctttgacaaacctgacagaaacgagcaatggggaaaggattccctatttaataaatggcgttgggaaaactggctagccatatgcaggaagctgaaactggatcccttccttacaccttatacaaaaattaactcaagatggattaaagacttaaacataagacctaaaaccataaaaaccctagaagaaaacctaggcaataccattcaggacataggcatgggcaaagacttcataacgaaaatactgaaagcaatggcaacaaaagccaaaattgacaaatgggatctaattatactaaagagcttctgcacagcaaaagaaactatcatcagagtgaagaagcagcctacagaatgggagaaaatttttgcaatctgtccacctgataaagaatctacaaagaacttaaacaaatttacaagaaaaaaaacaaacaaccccataaaaaagtgggcaaaggacatgaacagacacttctcaaaagaagacatttatgcagccaacaaacatatgaaaaaaagctcatcatcactggtcattagagaaatgcaaatcaaaaccacaatgagataccatctcatgccagttggaatggcaatcattaaaaagtcaggaaacaacagatgctggagaggatgtggagaaataggaatgcttttacactgttggtgggggtgttaattagttcaaccattgtggaagatagtgtggtgattccttaaggatctagaactagaaataccatttgacccagcaatcccattactgggtatatacccaaaggattataagtcatgctactataaagacatatgcacacatatgtttattgcagcactgttcacaatagcaaagacttggaaccaacccaaatgcccatcagcgatagactggataaagaaaatatggcacatatacaccatggaatactatgcagccataaaaaaggatgagttcatgtccttttcagggacatggatgaagctggaaatgatcattctcagaaaactaacacaagaacagaaaaccaaacaccgcatgttctcactcataagtaggagttgaacaatgagaacacatggacacagggaggggaacatcacacaacagggcctgttgttgggtggggggctaggggagggatagcattaggagaaatgcctaatgtagatgtcgggttgatgggtgcagcaaaccaccatggcacatgcatacctatgtaacaaacctgcacgttgttgggtatgtgtataccccagaacttaaagtatcataacaaagaaaaaggaaagctaaaaataaaaaataaaaaaaagggctcccctctttcctgggcactcattcttctccttcctgctgccttgtgaagaaggatgtgtttgcttccccttctaccatgactgtaagtttcctgtggcctccccagttctgtggaactgtgagtcaattaaacttcttttctttataaattacccagtcttgggcagttctttatagcaacatgagagtggactaatagaatgggcatcttattttttggcttaacttcttaggcaggggaattgctgatctgctccttgtgcttatttgaagtggggtaaaacataatcagagggtgcagtaagtagggtaattccccccattgggctgggcaaggtggttcatgcctgtaatcccagtgctttgggaggccaaggcgggtaggattgctttcagccaggagtttgagaccaacctgggcaaaatagcaagactttgtctctacaaaagtaaaaattagctgggtgtggtggtgcatacccatagtccccactactcgggaggctgaagcaagaggattgcttgagcccaggaggtcaaggctgcagtgagctatgattgtgccactgcactccagtctgggcggcaccctgtctctaaacaaaacaaaacagaaaaagcccatgcttcccttagccccaaatatgcctatgtagtaatcccagaaacctgtggatatgttaccctacatggcaaaagggaccttgcagatatgattaaggctaaggaccttgagacaggggattatcctggattatccagtagggcctaatctaatcatacatgtccttaaaatctgagaaagtttcttggctgccatcagagataggatgactcggataagggaagacaggcaggagaaattagaagtgttaaaagggttccacttgccattgtgggcttggctttgaagatgaaagagggtgccatgatccaaagaatgcaggtggcctcttgaagctgggaacagaaatacacagattctctcctaaagcctctagaagaaaacacagcccagccaataccttgattttagccctgtgagatcttgctcaactctgacatagagaactgtaggatagctttttttgtgtgttgttacaagcaattaaatttgtggtaatttataatagcaacaataggaatctaaacaaagacactgggttggagagagggttgagcagtttggcccagtaaaactgcatgagttatttatgggttgagtggacattttggaatgcagcctgatatggtttggctctgtgtccccacccaaatctcattttgaattgtactcccataattcccacatgttgtgggagggacccagttggagataattgaagcattggggcagtttcccccatattgttctcgtggtagtgaataagtctcatgagatctggtggttttatcaggggtttccacttttgcatctttctcatgctctctttgcctgctctgccattcacgtaaggtgggacttactcctccttgctttctgcacaactgtgaggcttcccaagtcacatggaactgtaagtccaattaaacttctttcttttgtaaattgcccagtcttgaatatgtctttatcagcagcatgaaaacagactaatacagtaaattggtaccagtagagtggggcactgctgaaaagatacctgagaatgtggaagcaactttggaattgggtaacaggcaggggttggaatagtttggagggctcagaagaagacaggaaaatgtgggaaagtttggaacttcctacagactcgttgaatggctttgcctaaaatgctgacaggaatatggacaatgtaatccaggttgaggtggtctcagatagagatgaggtactagttgggaactggagcagaggtgactcttattatgttttagcaaagagactagtggcattttaccctggccctagaaatttgtgggattttgaacttgagagagatgatttagggtacctggcagaagaaatttctaagcagcaaagtgttcaagaggtgacctggatgttgttaaaagcattcagttttataagggaagcagagcataaaagttcagaaaattcacggcctgacaatttgatagaaaagaaaaacctatttcctgaggagaaattcaagctggctgtataaatttgcataagtaacaaggagtggaatgttaatctccaagacaatggggaaatgtcttcagggcatgtcagaggtcttcacagcagcccctcctgtcacaggtcaggaggcctaggaggaaaaagtggtcttgcgggctgggtccagggtccctgtgctgtgtgcagcctagggatttggtgccctgcatcccagccattccagtcgtggctgaaagggatgaatgtagagcttgggccatggctttagaggatgcaagcctcaagccttggcagcttccatggggtcttgagcctgcgagtgcacagcaatcaagaattgaggtttgggaacctctgcctagatttcagaagatgtatggaaatgcttggatgtccaggcagaagtttgctgcagggatgatgctctcatggagaacttctgctaaggcagtgcagaagggaaatgtggggtcagagcccccacacagagtctgcactggtacactgcctagtggagctgtgagaagagggccactgttctccagaccccagaatggtagatccactaatggcttgcactgtgcacctggaaaagccacagacactcaatgccagcctgtgaaagcagtcagaagtgtggctataccctgcagagtcacaggtgcggagctgcccaaggccatgggaggccacctcttgcatcagtgtgaactggatgtgagacaaggagtcaaaggagatcattttggagctttaagatttgactgccctgctggattttggacttgcatgggtcctgtagccccttcattttggccaatttctcccatttgaaatggctggattttcccaatgcctgtacccccattgtacctaggaagtaactaacttgcttttgatttacagactcataggcagaagggacttaccttgtcttggatgagactctggactgtggacttttgagttaatgctgagatgagttaagactttaggggactgttgggaagggatgattggttttgaaatgtgaggacatgagatttggcaggggccaggggcagaatgatatggtttggctctgtgtccccacccaaatctcatcttgaattgtacttctataattcccatatgttgtgggagggacccggggggaaataattgaatcttgggggtggtttcccccatactgttctcgtggtagtgaataagtctcacaagatctgatgcttttatcaggggtttttgcttttgcgtcttcctcattttctctttgcctgctaccatccatgtaagatgggacttgctcctccttgccttcctccacggttttgaggcttccccagccacgtggaactgtaaatccaattaaacctctttcttttgtaaattgcccagttttgatatgtctttattagcagtgtgaaaacggacaaatatatggccaggattgagccattctgtcaagatccatccaagcagctggctgcaggggaagaaagcttaacagcaaaagcctttgagatggttctccaagggtggtggttgaggggaatcagaggaggtcaagttgagccactcttggggatgtctagtggacagcctccctgcctgtggggtctcctgaagggctcatgcgtggattccaagatcagtttaggagctaccacatagagattcttaccagagacagcaaagacagggccacatgagagccattagccacccatatcagttagataggctagactatgctaagtaacaaagtccccaaatttttgtgccttatgacaatacagaaatctttcttgttcattcttcatgtctgtctctactcatcctagtggaatacatgctcacatggcatttactattatcaagtcccatggctccacctaacttcaaggggacagaaaactataaccctactatgtgcctggaagggcaaaagagcaggctgtggcccctccctcatggcaagattctcaggctgattccaggctggcctgagaggaagaggaggatgaaattagacatgcaattgcaatttgaagccagactagactttcattttaaatattgaaaatgaaaggagtctgggggctcttcctgcaatgtgattacaaactaggaaatcaagattcatcagggcatggatgaaggcagtgcttagaaaggaataaagttagctgggtgtggtggctcacgcctgtaatctcagcactttgggaggccaaggcaggtgaatcacctgaggtcagaagttcaagaccagcctgaccaacaaggtgaaaccccatctctactaaaaagcaaaaattagctgggtgtggtggcacacacctgtagtcccagctactcaggaggctgaggcagaagaatcacttgaacctagtaggcagaggttgcagtgaggtgagattgcaccactttactccagcctgggtgacagagcaagactctgactcacaaaaaaaaaaaaaaaaaaaaaagaaataaaattgttttttatgtgtggcttgctaatttcagactctattaaaccaactgcccttgcatttaatcttcaaaacaatcctttgaattagtaattattattaccttctttttacctatgacaaaactgagactcagagagattaagcaatatgaccaatggcacacagctgacggagctagtcagaattcaaatctagatttgtgtgactccaagcatgcacattccgttttttttttgaggcagtatctcactccattgctcaggctggagtgcagtggtgcaattgtggctcgctgcagcctcggcctcctgggctcaggtgatcctcccaccccagcatcccaagtagctgggactatagatgtgccccaccatgctaggttaattaattaattaattaattattttggtagagatggtgtattagtccattttcatgctgctgataaagacatacctgagacgagactgaagaaaaaaaggtttaattggacttacagttccacattgctggggaggccttagactcatggcaggaggtgaaaggcactttttacatggtggtggcaagagaaaatgaagaagacacaaaagcagaaacccctgataaaagcatcagatctcatgagacttatccactaccacaagaatagtatgggggaaaccacccccatgattcaaattatctcccaccaggtccctcccacaacatgtggaaattaggggagtacaattcaagatgagatttgggtggggacacagagccaagccatatcagatggggttttgccatgttgcccaggcttgtcttgaagtcctgagctcaagtgatccttctgccttgacctccaaagtgctgggattacaggcatgagccgccatgcctggcccaggtatgcactttaaaagccatccttgctatcttgtgccattttcctgatagaagtcacccttctaaagtggacaaggtaagacatatttacattgttatccctttgtgggtaagagaataaaattaggaagatcctcaggatgtagcaaaagggcacttactatgtgccaggccccactaggcacttggcatgcatttatatctcatttaactcctagggctactctatgaggtaagcaattccattccaattttgtggatgagtcaaactgaggcatcaagagataatgtgacttgccaaggtcaagcaactaataggcgagatttgaacccagatctgtctgtttttcaaaagtctccacccagctacaattccccattgaaaaagttttggaggagttacaggagggagaggccattgttgggtggaatagtcttgaggagggactccagtatgaggggatgtcctggaagcaaggagggtggcaagcaaaggtgctgagatgagagtgcacacaaagggctcaaggacaaagagtaggcagagctgattgtcactgagaatgtgtaagaacagtgggggcaagataaaaggcaggttggagccagatggggagttgtcaggcatgtaggctgaggagtttgactgtgctctctcaggccatgggggaacatttggagtgggatttgtaatgctgatgagaggaaataggaagcctgggagtctgcagttcctagagctaccattaagcgttagtgctggggctgtctgcccatagagtcgttatccccttagcaggtgggaaataggaagggtctagtttaggcagaaacatccctcaagagaaaggcatgtcagggttggtggagacagtgggagaaggttccagatgcagcaggacagaccctggaaggcagggaggcaggggggtggcatagggcagcagaaagaatgcatctctggctcatggcagatcttgttcagttctcagcttagtctctgtgaataaaagttatctgaaaataaatttggaggaaagagactttattccagtcaacgtttgcaaaccagggagaagcagccttcagtgtaaaacgaaggtgcattccagagaacaaagagagggtctgagcatttgttttttcttttgagacaaggtcttgctctgtcacctgggctggagtgcagtggcgtgatcatggctcactgcagcctcgaacttctgtgctcaagtgattctcccacttcagcctcctgagtagctgggactacaggcacatgtcaccatgcctggttaatttttgtattttttgtagagatggggtgttgctatattgcccaggctggtctcaaactgctgagctcaagcgatccatctgcctcagcctcccaaagtgctgggactataggtgtgagccactgcaccaggccagggtttgagttttatagcaaaatttccagcccaggtttctttatgcaaatgaagaattcaaacttgcttagttctaattggttgacacagctgagttctattggtcaatacagctgagccctggttagctgaggtaggtgagctccgattgtttctgagttcaggtgaactcagaaagttaaaaagttgtgggtttttggagaactcagagtatgtgacctctagtcagcaaatggccacgtggctctgttttaaatttaggcccagttagcctcttgggatctatctttaaggatttgctctttcaggttcacatttgttcacgtcttttaccacctgtatgaccctgggcatggaattttgcttttctgacactaaaattaaatggtagaactgcaaatttcctcaaaccatactttaatatgctgcaacatgtagcccctctagtttatcatactttccttttgagccccttttctataggcgaacagggacacttaacatgccaattgagtgtctaccagtctatctagtctctttcagtgaaaatgtttccactctggcttttctatcttcgtatcagggctggctcaaatagttcttttgggattactcaatgactctttaagtaaaagctccatctttcagagttttgctcttttgccttctcctctccaagatggtgcctgggtatttaaggggtttactgtaaccacaagacagcagggagaggagcctcaggtccacactgtgtcctccatatccagggctagtccagtctgctccctggactgtaggccactaaggcatgacaggcctcttcttgcctccttggtgatgggctgctggtggcatctatgattttggccatttgtcctcaagtcacaaggttcctacccatggtggcctctttctttgatctcaggcctctgtcctcttggtactttgatgtgctctcctgatggagggtcaggggtgctgccacaggctcattcatcagaccatttcctgcagtcttactgtgccatcaccctctgccatgttggaaatgagtggattttcttgtaggctcacagactcttgctaatagacatgggaagtaggtctttagtttttcggatggccttggctttcctctcaatctatctaatgtatctccttgaggtgaaacacagcttggagaggaaaggtaaaacacattcacatcacctccagcttcccctccctccacccatcttttcctttccataaccccttgaacatgaagggatgaacaccctggctttactttgcagaagtaccttattccaggccatgtggttcttgggtgctgactccatgtctgagttccagggacagacaggtaaatcagtcctgtctaatcagattatcccgttctggctagtgactggtccagggatgaacatgtgacccacatctgtgcaatgataggcatctctgagaacttattagacctttataacagagaagctctctttttcttgaattgggatgtgatttacatagtgtgaaaatgtatagatctttagagttccgtgtaaagaattttgacaaatgtatacacatttgtgtaatcaacacccaaacaaagatatagatccttttcatcaccctaagaaattccaacaggctcttttccagtttatgccagaaagttccctctgtctcttcctggtcaatgccaccctctccctaacacacatacaccagaggcaaccactattctgatatttatcactatagattattttccttgttctagaacttttcattctctgctgtttatttatttgtatgttcttaatcaaatatcacactgacctgatttctatagttttatagtaagtctccaagccagacagtatacatttcctaatttttaaaaaattgtttaccatgtaggttctttatatttttatataaacattagattctcagaaagcattctgggattttggttggtatctgattgaatctatagattaatttggagaaagctgacatcttatccatactgagtcttccattccatgtatatggtatatctatccatttatttagttattctttaactcctctcagtaataattcattgttttcagtgaagaggtcttttattatgttcattccaaagtattttatatgttttggtgctactgtaaaaagtattttaaagaaatttcttttttttttttttggagacagtctcgctctgtcacccaggctggagtgtagtggtgtgatctctgctcactgcaaccactgcctcccaggttctagagattctcctgccccagcctcccaagtagctgggattacaggcacatgccaccacacccagcttatttttgtatttttagtggagatggggtttcactatgttggccaggctggtatcaaactcctgacctcaggtgatccacctgcctcagcctcccagagtgctgggattataggtgtgagccactgtgcctggaggaaatttaatttttaattttttttttttactagtgtagaagttctctttttagagtttgctaagctggtgaaaagtaagccaggcaagagccaccatagggaggctgtatccctgagaatgaattcaaaacagaggggagcagagctgaaaaatggaggggagggagagacagagagagagagagatagttgagggagagaaagaggcttgaagaaagggtttgaactcctatattcaattctgagtgaacttaggtctaccctggactttactggagacaatacattttatttgctaaagtcgttttgagctggattcctgtcacttgcagctgaaagagtcttgactaatcccatgtctgagttggcccagccttgaaggctagtgtgtatgtatgagtgagtttcatgccaatgaggaaaagaaaaaaaacatggttcactaattcttatttctttttcccacgagtgagaattgttgacttgctagtttccttactaggtgactattaagaactaaatgtttgtatcttccaaattcctacccccattgtgatggtatttgtaaagaggcctttgggaggtaactagtgttaggccttaatgatgaaaccagcccttataagaagagatatcagaaagatcagagagcttattctctcccttctctcctttgcaccctccccttctcccgcaatttcatgcacaagcactgaggaaaaccatgtgaacacacagtgagaaggcagccatctgcaagcctgggagagatcccgctcctgaccatgctggcatcctgatcttggactttcagcctccagaactgtgcgaaaataaatttctgttgttaagtcacccagtctattttattatggcagctcgaggagactaatagagtgacctgttaagtgagcccactactcaaaagctttccttccttcttttccctccatcccttcctcactcgcttccttccttccttccccctcccttccttccttcccctacccttccttcctctctccctccttccctccctctttctctttccttttttagagaagcactatctaaacctatatggaagaaaaaatttgtccctattagcaggattatggtcctgccctttaaaagacaacagatctccacagttttgctgaagaacacgggatctgttcttgcttcttttgggtctacggcatcacagatagcacactagcttttgatggttcctttccctgcaactagggcaatgtcactgcctctcactaaaatgttttagcttactctctttctctgatgaatataagaactagggggtaggagtagggactgtgttt

SEQ ID NO: 355 - DNA, 165537 bp, Homo sapiens
cagacaagcgaaactacaattgttccaatcaacaacttcctctattgtcctgtttctaatttaagggtaactgatgccaaaacacatgacttcctacaatttgctgagtggaaaagctggctgtaaacttaaatttcaccaaaaaggtaactggagagttgctgctgacacacacctcaagcttgggtgaaactttcagatctacagcacagtcccagcgttcaacagcgacaggagaattccgtgagccatgcttcctgggaagcggtctagcgagtccggacaacacgcgtccgcacggtgaccacaaacgtgtgctgcccctttcacagcccctacacacgaagcgcatgtacacgcacgcatgggcctgacaccatgggctgcagacaccgcttgtgggcggcacatgctgatgagggccggctcatgagaacggctgtgtgttttctgcacccaccacccagaaacaggcatgagtaggggcacccacagtcagacaaacccaccaccaccatcagcctcggacggccccgttcaatctttaccaatgcagttcccccagtcacggccggcacgtgtcttcctgcctctccagatggccacggagaggaacactaacagcagcattggcaattctgcgtctaaggctatttcctgaaaagcatgtgggaaatcccactgacttccagcatgaaaccagtgtgtgtcaagggaagaagacgacaagccacaaacggggtaaaagtattcgcaaaagacatatctgataaaagactggcatccataatatacaaagagtccttaaaactcaacgaaaagaaaatgagctcttctacaagttcctccccacatgtattcagtgcatgcctggctgggcaggaagtgtggggcaagcagtgtgtgctggaagggcggaaatttccaaaacagatctaacaagagggcccagatgttgaagtgccttattcccacaaatgtccgccatcactctaccattaagatactggaaatgaggaaatgaagtattaattttctaacaatttgtggtaccctggtctggcaagctgtcttgagctatactggactcagagtaggcacatagtcaagcaacacgacacagcaagggagccccaggacagcggtgggcaggtccctgaactgcgggggctggcaggacggggcaggtgacctgcctgtgaacggccaaatctgtgtgcgcatatagcaagtgctgcattcaccacaagccaggagacttccgtgacacttccactgccttccttggactctggccttcccttggcctcagcagcttcactgctgtccttcaggaatgataccggggcagcagctctgggaagccggcagaccacctgctgccgtgtcccgtggggcctgcgtggctacacagtgcaatagtccaggctcctgcactggagtggagacgctgagggatggaggcaggctcaccagcgagcgtacggctgtgcacatgcgtgcctgcagagttcacagaagccctgtgcgggcaagaatgttgtgactacttgatgacgccggacagtgccagggaattgcatttttgaggcaaggcaaggctttacactgtgtgagatggattcttattacagaaagtaggatgcacatgatgtgttggattttgaggcttaaagagtagcgtctgctcagtttcaaagcaaagagctggaagaacaagagccaataaatgatcttttgctatatgggggaaaagatggcaaaaagtctgaagacacctcaccaaagatgatacacagacagcaaatgagcatatggaaagatactccacactcgaggtcctcaaggggttgtagctgtggtgccaccacacacctatgagaatggccaaagcttagggcacggacaacaccaaaagcaggtgaggatgtggggcagcaggaacgctcgttcacggttggcagaaatgtaaaatgcagcaaccacttcgaaagacggtttgcccattttcacaaaaccagacatactttcaaccatgccacccagcaaccaagttccttggtatttaccaaacagagctgagaacttatgtccacacaaaaacctgtgctcagatgtgagagccgctttattcgtcattgccaaaacttggaagcaaccaagacgtccttgtgtaggtgactgaataaaccgtggaacatccagatgatggaatgtcattcaccgctaaacggaaatgagctctgacgccatgcacgaaaagatatgcgggcactttaaatgagtatttctaagtgaaagaagctactctgaaacggctaccaactgcgtgattccaactagacgactttctggaagaggcaaaatcaagcacacagtaaaagaagcagcggtgaccagggcctggggaagaagagaggctgaggagggtgtcagggcagtggaactactctgtatggcactctaatggcagacgcatgtcactatgcatttgccaacctactggagctacagcacccagagtggagaccctgacgtgacctccgcactggggtgacagagacgtgccactgcaggctcatccaccgtaatcaatgtcccactctggccggcgacacagacactgggggaggctgggagtgggggcaggggcacacgggaaatctgttatcttcctctcaattttgttgtgaacctaaaactgctctagaaagtagtttgttgattttcaatgttgtgtccttgtatttacataaataaataaggcaatcaaaaactcctgataatccctggttgtccagtgttaggaagaaaccaaaactcttcatgagaaaggaattaaggggcatccatgctgactgccgcgtacttggggaagctttctgtgccacctgcttacacctgaacaaagtgtcctatcgtggaggcgcccatctccgggtgtgctatgcatcacctggaaaaacccagcttggctgcctctgatcatacaacgagcctctagtcccagacacatgggctaaagaaatacaaagttcacaccagtttcaacgaggcatgtgacatcctggcatcctccaaacactcagcgcctcacgtggatcagtgtggaggggcttccctaaactgcaggttctggggctccaccccagacccactggatcagagaccaagagtctgcactgcagccactcctgagtcatacgctgtatagggagcgccacgagctccacctcacccgacagctccaggctgcgctgtcaccctggcggggcagctactacgtccccgctttcaccctcaagagtgtcccagttagaacaccccagcacttcagagatgaatgatctaaagcttaattgtgccttaagtcttctgataaccgtctttgtgcattttgtgccacaagtcagggcacttcagaaaccgaaaaggacgcacagcagaccacacatccatccttcttctctgctctcctttcaattagagcttgctgtgaatctgcagcggcagaggggagtgggcagaggccaggtgtatgtgtgtcgatgtctgcctatgtgtctgtgtgtgtgtgtgtgtgtgtgtgtgatgtctgcctgtgtcgcgtgtgtgtatcgatgtctgcctatgtgggtgtgtgtgtgggtgtgtctgtgtgtcaatgtctgcctatgtgtctgtgtgtgtgggtgtgtctgtgtatcaatgtctgcctatgtgtctgtgcggggggtgtgtgggggtgtctgtctgcctgcgtctgtatgtctgtgtgggcatgtgtatgtgtgtctgtgtctgtgtgtgtctgtctctgcatctctggatggatctatatgtgtctgtatgtctgtgtctatctctgcatgtctgtgtctgtacatctgtgcatgtgtatgtgttgtgtttgtaaaataccctaagtttgaagaaactgaatcaaggaaaatctggaagggcccccaggaatgagcggacaccgtatggccacagtgtgtctatggctggcatccccacagcagaggcagcccagtgtgcatgcccccagcatgtctttccccgcactcctctgctgaccatatggggcggcctggcccaagccccagacagtgccctgaagtctcctcccgcctcctccagacccttgccctgcccttctcacacctgcttgcagaccttgcctcctgccccacagaccctgagggcacagcgcagttggactacctctgggtccagcacacacgcagcgcaggcacccagatggtctttaaaagaaacgaatccctaagtgctaaaggcagaggggccagtccaacccataattactccatcaataaagaaaaccagggggcggtggctcaccactataatcctagcactttgggaggctgaggaaggaggattgcttggggccaggagttcaagaccaccctgggcgacacagcgagaccccatctctacataaataaatacattaaaaaaaaaaaaaggctcggcgcggtagctaacgcctgtaatcctaacactttgggaggctgaggcgggagaatcgcctgagctcaggagttccagaccagcctggacaacatggcaaaaccccatctttacaaaaaaaaaaattagccaggtgtggtggcacactcctgtagtcccagctactcaggagactgaggtgggagaaccgcttgaggccaggaggtggaggctgcagtgagccaagatcgcatcgctgcactctagccagggtgacagagtctctgtcccgtgtccaatgccagcgtgaccctcgcagactcgcccagacctccaggaggcctggtgcaagctcatttccctttgctgggcctgctttctcagcagtaaactctacataccaaagggcccttcccccagcccagggggctccctggaccccaagacttcctctgggtccccacggcaccaccagctcgaccagctcgtacctccctgtctagtcagtcacgtgcttgtgtctccccagccacggcaagatccctgaccccaggggcaggcagagggcatggcctggcgagacagggactcagaaggacctataaatgagcaaatgaagcgccttgggtgctaacgccaagccagagtaaaggacctacaatggcactattcccacaaaggctctgactgacatcgacaatgctgttctcatagttactgatgagccagaacgcttgcccgcctccggcgcccagcacacggggctaaccccacacattatggctaggaaatccactggaaactgagcttactggaagagctcccagagacttcctggagaagatgaccttcctgccggtgaagtcacaggccaactgtaggatgctggtggcaaggcccctgcaccacaggctagagcatcacctcacagcttctgggctctcctggctggcaccacactcaattctggaagccatttttccatctgcaaaggcaaacctcagacttgccaacagctgtgggatcctaccaggaactcccagggcctgtggggcagggcacatggctggcgactggctcagatgcccaagaaccacgtcattcagaaaggccacacacagctggacaacggggtgccaagcccctacctcgagaggctgtgtgggtggatcaaatgggagcaggcagcaggcatcagggtaatccccctcctgatccccttcctgaccccatttcagaaggggccagggaagctcagctcttctccaccagacaccgttctatcccccaaacaactggcaggggagagccactctcacagatatgatcatatgtcaggggaagtccgcagttcaccaacactcttcctgacaccaccccagcaccaacacagcacaggacaggcactgagtgtatatacacaagtgtgcacacaacacacacaccacgtgtgcatgcaacacacacctgtgtacacacacacacacgcactcacacacgtgcatgcaacacacacctgcgtacacatacatgcgctcacacgtgtgcaacacacacctgcattcacacatgcactcacacgtgtgcaacacacctgcgtacacacatgcacccatacacgtgtgcatgcaacacacacctgcgtacacacatgcattcacacacgtgtgcaacacacacctgcgcacacacatccattcccacacatgtgcacgcaacacacaggcatgctgagctgaaagtgtctctttcaaaaattttcattttcattgatcttcctgatcttcaaaactatataaagacaggaaatgcaatctccctggttgccatattctaatcagagaaattcattcagtttagaagcatgattatgaagcctgctgacacaggtcaggacagtccccaaaatacactaaagccaaaatctgaacaggaggtggtgtgtggtgtgttcaccagctcacgcgctacggctgatctcgcagactgggctctgtctcccagtgcacccagaacctcccctcccaccttctcctccacatctgtgccagtgcatctcctgcccaggctaccacgggagggtcgtgactggtttcacagcttccacccttacccacagtacccgctgtcagtactgtgaacagggcggtaccttacaacacagagtcagaccagccattcctcacctcacggagtcctgcctggctccccaaacccttccggagagcctgccagcccagcccaaccacggggcccttgccacacggcacctgcaagccttaggccctcaccccccctactcctgctataccctctgcccgctgcccctcagtggtgctgtcctaggcacactggtcaaacagcctcctcgccagcgctgcctggagccgagttccaacaggaccccaagctctcccccttccctccacaacaccagacagaaagtaaacgcaacagtgtatttcaacaggcaaaggccagtgacaatttacatgacggtaaatactcctcaatactgcatcgaatcaaagcatttattactccactttctaaaatttaagggttaaggtgttaggatttgaaataagacacctttttaaacagaatccctcttcatcttctaccaaaacaaactgttacctaaatgtcaacaggaagaagatgcagtgtccgacacgtagcaaacacgcgagaagagctcatttaagaggaaatcacatgaaaacaaggacacactgcccccaaaagaaaatattctccgcgccactgagcttctgttagaacatacaaagttttgctcatctcccttcttacctgtatatagtctccttgatttgcatgatcagctgagtaggtttttggatttttaattaagaggcaatgaggggtgtgcccttctttccaaatgctcaagcactgacctggtgtgtgtgccagggtccgaaggacgctttggctgccatggaaacggtggcatgcttctagcctgcgcatcccctgaaatctcagctgggaattcaggaaaatcaagcgccagtatcaacctgaaatgcccataagccctaggataaactaggtctcctctgagtcgcggttactttaggagcaaacgcaggtacaaacaaactgagtctgtcacccgcagcgtgggagaggcaggtcgcgtgttcctgacagcacgcgaagcagctaaatggtatccaaacatggaagcagaaaccctcacatcacacacatataatcaagaactgacctcacagacagggcacaattgaggaataccactaatgactgccaagatggaattagaccttttgatggttcttccatgtaaaatcaagtcaaatcaaagcggtttccaggtcctgaacttaacctcaagcagaaaagaacatagtgaacgtcgtgctacgaaagtgaaaaatggaaatggctaactgtccaatgatacggagctctttcagttatggtgtgcactcaggacacacgatgtccgtgtgtttgaagggaagtatgacggatatttcagcaatgttaatgtcaaagcttgtctttaaaaaacgtaaagtttgggccaggcgtggtggctcacgcctgtaatcccagcactttgggaggccgaggcgggtggatcatgaggtcagaagattgagaccatcctgcctaacacagtgaaacctcgtctctactaaaaatacaaaaaaatagctgggcgtggtggcaggcgccgatagtcccagctactctggaggctgaggcaggagaatggcgtgaacctgggagacagagtttacagtgagccgagatcacgccactgcgctccagcctgggcaacagagggagactcagtctcaaacaaacaaaatgtaaagtttgggccaggtgtggtagctcacgcctgtaatcccagcactttgggaggctgaggcgggtggatcacccgaggtcaggagttcaagaccagcctggccaacatggtaaaacccagtctctgttaaaaatacaaaaataagctgggcgtggtgacagacacctgtaatcccaggtactcgggaggctgaggcaggagaatcgcttgaacccgggaggcggaggttgcagtgagccgcgatcgcaccattgcactccagcctgggcgacaagagagaaactcggtctcaaaaaaaaaaaaaaaaaaaaagtgaaatgtgggtgaatgaccaaaacttacatatggccttggcctggggctagatttattcctactttctaagaccaagtaaacaacaaaaccaccatgggaccctctccccttcactctcctcaataccaggggctccgccagaaactaaggctgaaggtcagccatctcgagggacagaatgggtcacctctactacttgctggatgacatggcatggctgagccactaaaaacatgggctaaggtgacacttttaacagtacctcatgatgccctgtggccctctgcaaaacccttctacttcctcgtggatcccttgtgtaaactcacaacaggggttcaccacaaggaaaagggggccccaggggcattccggttcagagggccactgcggatgggagacagaggagagggcagaacggccactttctcttcgtgctctcctgtcttcatgcagggaagtggctggacaactctacggggcgtggcgccggcaggagccagctctgaattccgccaaccacatcggttcgactgaaaacccacgaaacatctcccctcctctacgagagaggagttatcccataacctcgtggtcccccattttctgtgacgaggaaagtcagtctatagttcagcgagcagcccctcatttatctggaaaagtcagctgttcagaaccaagcgttttcttgggattatggacagcagccacgttcaagatgaacaatatctcctagggaattaattgggacagtcccgaagtcaacaaaaatgacttcttaaaaactggagtcctggttaatatgtatcaaaaaccttaaaatgcgtacaacttttgatcccaaaattttaccctttagaacttatcataagaaaacaaagccacaggaagccaggcttggtggcatgctcctgtggtcccagctattcggtaggctgaagcaggaggatcacttgagtcctggaattcggggctgcagtgaaccatgactccacctgtgaataggtggcgtgttccagcctgggcaatatagtgagacccctgtctcaaaaaaaaaaaacaacaacaaccatgaaacactacagagcaatgcttattacaccactaagaaaccttaaatatccaaaaaagattggtaaaataaagcatggcatatccacatacaaaatcacaaaatcatgatgaatgacaatttgttgacatgcaaatatacttacccactacctaagtttaagcaggttaaaactacattatgatcacattgagttctttagaaaggtacggatgcagataaaaaggtgttatttacgcatgtttcatagagtctttctgctcctataggacctaaactttacttttttttttttttgagatggggtcttactgtgtcacccaggctggagtgcagtggctcagtcacggctcactgcaacctccaccttctgggctcaggcaatcctcccacctcagtctcccaagaagctaggactacaggtatatggcaccatacctagctgattttttgagatgggatctcactatgctgcacaggctggtcttgaactcctgggcttaagtgatcctccctcctcagcctcccaaattgctgggattacaagtgtgagccaccttgcctggccaaatttacttttaattaaaacaaacaaacaataagttacctctaaaaacagattttctggttccctgtccaacatcacacaagtctgggtaagtgatatgacattcaggagtgttttaagatgacttactgaatctcagatggcctagaccttccaacagaggtttgcgatgcgagcagctcctgaagctcagtagggagagcaagtctgaaaagctgactgcactgaggtgctagtgggtccagctatttggtacggaaacactacagaagccttccccaatctggcaacagcatgaaagtggcaggtccataaccccacccaggaaaacagcaggttcctcccaaatgttcttggaacctaggtgctactcattcctccaggatccttggcggggacctcactcggactctgccccagtgtcgcccacgcctctgcacagcactgcactcacaggtatccatgagtcagccccaactacaaggcactgagcctaccaggaagaaaggagtcgactgcccttttcccttctttccaggctgaaagagaccacaggacatggtctgctacaggcccacacgggctcagaagctctacttcttgtctgggtagtttacagcatcctccctgcctgaggcccagacagcgctgggcttccaaggccaaacacctcacgcgggctcctcagctgaagatatcacgggcacctttccaactcattaattcctaggtgctgacgtccccccggcctaagcactgccctccaggatcggatggccgcctgtgagccagcacaggatgtcgcctccagcaagctcccagcagcaagggaaggcaggcagagcccttggacacctgcgagccaggctctgaaggatgcccggcacaggggtgaggagcccgcgccgccctctacagatgggtgcgccacgatggcaacgggcaatgcaaagccacacacgccggccacatgtggacagacatcgttttgtctgcatcctgtgacactggtgaacttcatcagaatcttcctcatctggggacacaagacaggtccgggtccggcgaggaccggaatgaaaggaccatcatgggctaccaaaaagaccagtttcagaaatgtcaactgatccctgcccgaatattaaaaccttgctaagtgatggacaaaggttcatgaagctgacacacaacagtgtttaaacctagaaaaataattaagccaagctactctggacacaatggagtcctcaaattcatcaataaactgtatttactttatgtgaactccaaatgatagtgagacctgaaagcttatcacagacgtgataaaatcaacatgattcacgtactttagatgttttagattttactgttagttcactaaaaagtccacccttttactcttaaaaaaaaaaatcttcaaattgtgttatctttaaacatttttttttttgagatggagtcttgctctgtcccccaggctggagtgcagtggggcgatctcggctcactgcaagctccgcctcccgggttcacgccattctcctgcctcagcctccagagtagctgggactacaggcgcccaccaccacgcccggctaatttttttgtattttttttgtagagatggggtttcaccgtgttagccaggatgctctcgatctcctgacctcgtgatccgcctgcttcagcctcacaaagtgaaaaaaacaattttttaagagataaggtctcaccatgtggtccaggctagaatgtagtggtgcaatcatagctcactggtgacctcaaattcctgggctcaagcaatcctccggcctcagcctcccaagcagctgggactacagatgcatgccaacatccatgtccgacttataagtcactgttttaaatacagcacacttctcatctgcgaatagttccaggacacacccttacacttttgcacctgcctcagcagcagccccgccctctgacagccccagcaccaggcagctgagctgagctcctgcagcacatagggagcctgggctgaggccacactcgtgaggcagtgggtttccccgatgggatctcggtgcaacccaacaactgagccaactgggactcctcggtctgtgaaacccatgaggacattggcgagactgggtgagcacaacccataaggacactagcgggacaggggtgagcacctgcggtggaagcggggcgggcggccgacccacgaggacactggcgggacaggggtgagcacaacccacgaggacactggcgggacaggggtgagcacctgtggtggaggcggggcgggcggccgacccacgaggacactggtgagacaggggtgagcacctgcagtggaggtggggcgggcagccgaaggagagacaggcctctgccccctagccaccagcagctgagtgctgaccacagcccccacgggcagcacaggcaagcaagtggaggaaatagaggaactgtgagtgagcagaaaaatgcaatgcaatcagctgaccagagaggaagctgggctccttgctaacgtctcaacaaggcacagacgcacccgcaagggagtgggcagcactgcaggatgcagcaagggctgctcagacctgctgggggcatcctttgccccgggctctgtccctactgcccccaggcacatttcactgccaggctgctgggggccagggctccagcctccagggcagcacacctcagcctgctctgtccccttcaaggccagacaagcaaagccccagcccccaccttggcccccagcctgtgggcacagtttctctccacaggcttggctgggcctggcttccacaccttccagctccagccttcaccccaagacccccacctctgtgacggctcccacattctgcgggacccacctccaggctctgctggttctcctctcacctccttcccccacgcagcctggaaaggaagggccgatgctcgtgggagcccctgtggcctcggggccctggctctatccccaccgtgccaggcggcctttccttgcctcccatccgcctactcagaagcccaggatggctgccaggtgaaggaaacggctctggaggggagccaggacaagtctggctttactgaaaagtaacatccgcaggacagactcatagctgactttgtttgaaggagcaagtcggctaagagtgtcattttcctttacacctgcaatcccacggaccacatctcaatgccctctacccccattcttacgtctgtcacttgctctttcacatacgttgcaagtctttgatgagggaggccagctttccctctggaaggagatgccttcagttgtaaaccgacaattcataaaaagttgggggcttcgagtacacaattccgcattcccgagaagcctgccaatcatgcagtggaaacacctgacctggtgcatcgcgcacccctccctggccaggctgccctccctggcacacgccccgcgctggccggcaacaaacaaaacccacacggacaaaggagtctttacaagaacagccaaaacaattccatctgcgaacaaaaactaacggcagaattaaaggctgcaagtccaaacacaatctggctattgtaaacagtgcctcagtttatcaatgtaacaataactctttcaaagattaataaagttccccccaaacactcagcaatctagcattgttaagatactttggaggataaatattagcttgggactcgcctacatgagaagtgaaagctgccaagacagcagttctaaagcaagaaccagcggcagcagcggcggccacagggcagcgaggcatgggcccaggcactgcttccagccttgccgcacatcagttcgactccccaggcacctccttgcacccagcaccacgctggcccctcaccccgtgtcacactccacatgcagccccctgcgagctgagcagcaggactcaccttgggcactgtgagtgagacagagcaagggcaccaatcctctgggccccacgtgccccctgcccaccctgtcctggggtcactggctcgtgagggcgggactgcgactctgtctcctggatccctgatggccaggcgcctggcaacagataagccacccacagcaaacaggaataggtggaaaatggacttaactaaaaggagaggttttaagatgattgttggaaataaaagggaacaaaggagcattcaagcttagatttgattccaacttactttcttgaaagacatttaagtaacctgggtaaccaaatgcaacatggtgttggggccagctctgagagcagtgggtcacgcggggcccctgcaacatggtgttgaggccggctctgagggcagtgggtcactcggggcccctgctatcagcaatcccaggttgagactccaaacagccaggctgagtgggtgctaggctggcccaccctctgcagggtgtgtttttgccccacccgtacctccaccatgggggtttttgttcgtgtaatgcgacagcgtgcagctccacacacacaggaagcaagctgtcaggacagagcctgactcgcacaggtaactggaatcctccccaacaggtgggtgtgcagagagcaggtccctgtccgggcacctcccgaaggactgtcttagcacgaccttgcttctcccaggggagggaaaggaaaagggcctcgtgaggtctccgcaagaccgggctgtgcgtcctacaccaggctgccttctcctgcacattttcctactcaaagacaacggagtccaggcatcctctcagcatcgcacgagttcccctggtgcagaaaaacagactttaaaagtctgaatcagtctcagccaagtgtggtggctcatgcctgtaatcccagcactttgggaggctgaggcgggtggatcacctgaggtcagaagttcgagaccagcctggccaacatagtgaaaccctgtctctactaaaagtacaaaaattagctgggtgtggtggcaggcgcctgtaatcccagctacttgggaggctgaggtaggagaatcacttgaacccgggaggcggagggtgcagtgagctgagatcacgccaccgtactccagcctgggtgacagagcaagactccatctcaaaaaacaaaaaaacctccgaatcagtctcctacagtagctgtgactgtgacaggctcagccctcagtttccccacctgtaaatgggagcaacactgcgagtgttgtaaagggcaggtggcgacacagcacagtgcctgtcacagcaggctctcacggacagagcggttgctaatggccttaaagctccgcggcagcacgtggcccctcgactgctctcagagacaaggtactgtcaactaaggcgactttctgaaatggccttaggatgagtcaaatccttggttcaatacatgacagtgtttgcacatacacagactcagcctgaaagagacaaaaaacacaggaccatctagctgaaaagcagcagctactgaacatggtctaatttttgtttcaatggctcaaaagaataaaagaatcatctaataatgatgatatcattggtttcattaggatttttacccagttgtcactaaaagggatatatttttggtttagaaaacgaaaaccttaggttaataagtgtttcgcactggttatcagaaagccagtgaaagcctggcccccgtccggagctgcacggcacctttcctaacgccaggacgcgtggtggctcctgccccgagctgcacggcacctttcctaacgccaggacgcatggttggcaaggacacgggtcagccatggggctcccaggattgacctccaattcctcatctggggaagcccagagcaaatcgaaggatgcatgggaacctcctttggaagtaggacgatcgtcagaaatacaggcaggcccgggtctcaggacgtcgaggatggaaggagcatccgagctgatcctgcccaacctcgaacctgcagggtagaaacagagcccgggaggccaagggggggccctcagcaaagaggacaatgacacgtgagcagagccgacctgacactatgctcctcctgccttcccaggtggccccacgatggagtttcctcgaatttcctgaaaactggccagctgctctgaacgagcctgaagaaggcagctgcacaaacttaagcagccactagtcaagctcacccgctgggcggccccgcctccaccaaactgcacttctgagcctctgtctccatcgctgccctccctccaggccgccgctcagggcacgccgcctccatcgctgccctctctccaggccaccactcagggcgcgctgcgctcagctcacaccaccccgtgcacagctcgtggatgcggtcctcccttttccatgaactctgcactcgcctcccctttgcacttcacaacattaaacttcaacccaacgtccaaggcctgggctacaggtaacagatgccaagaagtcaaccatctttcccggggctggcactgccttcgcgatttgggacgatgtcgcaagagtctgccgtgcgcctccagtgcctgaacaggcagctgcaagtccgtgggcctgagctcagctcctttcccgctcaagtgccacagtgacttctcatctgggtgcccagaagtggggctggctggcacgtgagtcagagatgcagggcaggggtcacacgatgtcagcgcggcctcgtgcctaggccatgaggcctagcggagacgtgcacagacctgcggcaaagctgcagaccggcatcctgcctgaggctcagtgccagaggccagcagaagtttctggcaaaacctgaagggataaagaagtgctgataaaccacccctactgcctctggaatgtttgtgattttatgattttctgcatccaaaatttgtcacatcactgcttctcctatcccacaacctcacgaacatgagattcctcaagtcctgagctagatgctagatacggaacctctgaagcatgactctgtggggagcccaggctacgacacctcaagaacactgcagcctctgcgaacatgaggaagatgagcaggtggcgctcagtacttctctctaaggggcaccagtggcagtgcctggcctcctagcaggcccaacagtctcacgtcctgggaaggttccctcccagccccaaagctccaggcctacctctagctcccagtgcagtgcaccctgggacaggcaggagaaggcagcagagaggagaaccaatgaaggcttctcgcactgcatccctggatgtcccaaccgctccagaaatcaattccaggcatcaacatcggtgtcacccccgcctacgctttaggctagtcccagggggcagcaagggacaaagggcaccaccgggctgtggtcagtcagctttcagccacccaagtgcaaagcctcaaggattttcctacagtgactgctgggcagcttgaaggagcagaagaaaagtggcagtgtgggtacagcccagccacacttccacgtggacccagaagaatcaacggcagccaggttacaaagggaaacctccagctccaccctgctccctactgcagcagggcccatgatggctggacatttgaaaacagaaaactcccagaaccagcacgttacaaagcacttagggacatcaaagcccagctctgcacatgagctctacggaaggagagtttcacctgctcaaacccaatcaggctgtgtggagctcatgccacctaaagaggctgaggaagcctgagacgcaaagtcttcctgctcatcctaatggcaggagcttcctttaactaggactgctgatatattttctccactggctttcatgtacacattatgcaatttgcttaatgactcagtgattatttgatgacagtcaccttcccccaaaccacccgcacctagatcaactgtccacctagatcaatcgttcatctaggtcaactgtccaccgtcaagtcatgaagactctgaggtctgggatgtaagaaggacagcccaaaagagagctcggctggtgggcacagggacctggggcctcgagagcaaagaacaggtggccacagggccagggtggcagtgtgcacttgagggcacctgcccagcgcccaccccagccagtgcgggtctctcctcgcaccagctcgggagggaggggccacccccagcactccacggccatccggggaaggaaagttggcggggctggcgaggacgtctggtgtctataaaaaatgtttctcccaggagggccgctgaaaacagagactctgagatactctcattcttttccttatttgccactctgaaaaataagccgttcttcctattctgaaatggaatacaggtcaaaacctcctacggtgaacagtgacccaaagaaaaagatcactagatccaaaatatttctagtttggccagtggccccaagtaactctgtttatttggttagagcaaagctctcctgggggatgaaacgcctaccccagtacaaagcctgcctgtgtctgcctgggtcccatgaagaaggactgaagggcaggaggctccttgcccctccgcaccccaggaggcccttctgtgttcccaccagggcctgactgtggaagagaacagctgcccgtgccccctgccccgcccctgtccctgccacggctgacatttaggagctctgtcccaagcgtccaccgtggcatgcagagccgccccacaccccgactccctggggcctcggccccccagcaaggccggcttgacaggaaccagtagccagcagaggcctgagcagaacagggtccggagctggcagtggggctcggggccactggttcccaagcagacttcccccacctcacaggcagcttctcctctccagcggcccagcgggatccagcacggactgagggcgggtgaaacgccagctcctgccttcagcacgtggtcactgccctgccctgcctgcaacagcagccaccagagagcgtccgctgggaaccacaacgcgcccgcaccccagcggccatcctcgggtcacgcagcctcatggcttccttcactgccgtggctgagattcctcggcctgcgccatgacggggcctcgcctacgttggaagataggtggttcccccgtgtgctccccagttacacgggttcgaccttcactaaatctttaccgaatccccactccacagtgaccggccttgcacttggcccgaggtcacggtgtgtcatgtttttctgcggaaggaccccacttcagacaagaccaggggtataaaccgcacacgagcagtcagcctccaacaaatgcatctttacaagtcctgtgaggtctgcactccacccactgcacatccacggccacgtccgtttaaacatatttcccaaagagacgcgcaccccaagttagggaagcgccgccctgggataacgaggaccaacaggacaagactgagaggcaggagcacaacccacggcggaaagcacgacaccgggcaggggtctgcaaacgccccgtgcccccttctgaccggccgagggcacctgaacacatccttggctttcagtctttcccgagtgcatcctaaagatgtgagatcgtgagttctagccatggtcccagtagggcaccctcaagacctctggaacctgtgtggtgcttctcacaacagaacagggccgggcacctccttgacactgttcctcaggagaaccagcagcgtgaaggggcctgcggttgcctggggtgggggcagacgtgagcggcacctcgtggctctgtggctcttgttactgaccccacaggcgtgggcagttgcattgcagggaccaaggacacactggctcccctccgctggggacttcctggtcgtgagctatgcccagaggagtcaaaaaggcacaaggggagacaggcctggctccagcccttggggtgcccaaggcactgggtgcccacagcccctcctcgggaaggtgaggtatgggcttgtgacaccccttccttccctcgggagctgaggagaatgggcggtggtggtttactgcatgttcagaaaaggcctccaccctcaccaccctgcgtgagacatgggatctgtgccctcaggaaactcagtccgagaggtggcctcacatgcgcggttgttacaagcagagccaggtaagcgcagaagcctgccaatgtatcttcctggtccctttcggggcaccctttacccacacgccctacttaaaccacttgaaaccctttccagatgagggcaggtgcaaatcgaggaatttatacttcacaagaaaagtacttcccccattgaatatttaaaagagtaactgcacccatctgcatttgaccctgcttcctactcacactttcttcagagcctgccccccagaaatgtgaccccctgttatcagccaggagccccaggaatgggtaaggccccaactttaacttctttcccacttgttcgcttatcagcagcagcccccccgcccccccgctccccaccaccgaccccataccacggcctccaacctcttccccatcttcccccagttaagttcaagacttgggaaaaatagaagcagctgctcttcacaaactactttaaaccttacaacgaagccaaccaaaataactccatagttcaatgtcagctgcagtggggaggagctgcagagttctcttgctggcggccacggggctccctcctgaactcatccaagttagtatttttatcaccaaatcctaagactatcagaaaacatctgaggccgaccaagcaccgtgtgaccttgaggaagtcgcctgaccgctccaggtcatgtgcgaggccttagggtgtgaacagagcacttcccggttccttccacttctacacgctttcattctacaactgaaaaccacacacgaaggtgtgtgtatcatcatgagagagaggccttcagagcccagcagcaacctataataaacagactataaactcagcacagctcatgctttcttcaaaagactgattttaacaggcagaagacataaccgcagctatgaaaacctctcccggcggatactaactacagcatcgtgactcagctgctctgatgctctgataggtgaggtcacctggatactacaggtgttttcacaagaggaaataacccacacgcagggcacggagcgcagactgtgcccctgccacagaccggccttctccccaaagtccctcgttaacccttcacggcaagtctggagtttcccatttccatggccaggacgctgggcttctggcctccttggctgactggacaattacagacagttgagtactgtcttttctgtgaacactagcatgtatttagcttaaaaggatcttctgtgcggcatcttttcagtctagcgagagaatgctttaggccataacaggtgaaaagtgcctcctttcacctgccaccccgttcaagagctgccaaggtacagcaggctctctgctgggcagaagcaggcagccgggtggaacagctagaatctccagcatctgcagacgggcctcagtggggcggtgaggagacggctctcagacctcccagggcacagtccacagggtagcacacaggagggcccgggccaggggcacctggaggaagacggggctcagagaaggagcagctccatctcgtaccctcttgcgcccagccaccgagggggactagacggctttgcaccgacccccacgtttctcccaccctccttgcccctttcaagcctatgtcatgtcaacagcctcctttttggtggtggctcacatctgtaatccctgcactttgggaggctgacgtgggaggatcgcttgagtccaggagttttaggctgcaatgaaccatgatcctgccactacactgcactccagcctgggcgacaggcttgagtatgtcttaaattttttaagacaggctgggaattcatattcacgctgcccttcagagcctcgagggctgcccttgtgcagctcattcaaaacctgcagaaggctggccgctcagtgcaaaacacacaaacaccagaaacagaaagttcacagaaaaggagatgcaaatggcacttaggggtgttcaagctcacgtccagtaagagaaatgcaaattgcaagcgcatcggtacgccacattttcacatacgacagagtgacccaccacgggacaaggctccaggcaaaagccctgaccgtgtctgatggggaccacgcctggttggaccgctcatgagaagcacacttctcttgccccaccaagttagatcttctggagcccagctagtctacacacaggaatttctcctacaggcctacttcacacagccagggacctgtgtactgactatggcactgtcctgtcctgcaggactgaggcagccagggcccagcaagctgcagtgagcggggtcacactgcctgaggtctgtgctggacacacagcagggactggatggaacctatgctcttggggcactcacggagggtgccggccctggctacttcatgcagagccactgctgggttgggaaagatgacaggaagacgagggcaaggggcacaagtccccgtgcagccacattttctgtgggactccccgtccaaatgcagatggccaggcagctggcacagcagaagaacttggggagcagtctggactgcagtcagagatgagtcagtaccatcgaggcgctaatccttcggcgtgggtgggaaaagaggtccaggaaaggaacccagctcccaagagggaggcagaggcagagatgtggtcccagaggaataagcagggcctcagccggccatgaaaccagccaggtgcgcgatggagtcagggcctggggaagaggatgatcggagaaggcggtgccagggaacagtgggcacagaggccagggcgagagcagaaggggcagaggcggggatggcgggggagtgcacactgcactttcgagaaggagtgagaaacagggctgctgcttgggagactcggagccaacaggggttgtacttttgtcctttttagtgaaagacattaaatcctacactgatcaaaaacctaagttccacgccttagttccccttaactcactcaccccttccatctatgacagacagtcatctggagtgaagtctaagagtcacaaagatgttatctcaaccgtggctcagcattcaaacaaggattctaatctttcagggctccagatgggaaacagattgctgagaattatcagttttatttgaagagtgcagagaggcgatttgtacaaatgggtatgactgggttttccttgggcggagaagagccggctggcctgctgagaagctggcttcctactccggtggacgccatgctggaaagggtcagcttcctgtagtaagagaagctaagaggtcaggggccagagggaccttcaggggtcccctgcggctgtggcctctgcagaggggggctcagggaggcctggagtgagggctagagaaagcccatggcccggggtcttccagcccagcccagggagcactccaggtaaggcaaggcctcaccaccctccaagtcctcagcactaggagcccaccaagagccaactctgccctggaggccccggacactggagcgaggtgcccccagccctacagcttcagatcccagatctcagtcccctacaaagcatgcagtccctcacctcagcagggaaaatgagctagcagagaactccaacacccagacatcgccctacaaagaactttaaagaagtaaaaagcaaaaaacatattatgttacattatgctagacagtactatcattatacatcatatgtataattatacatgtccatatataatatatacacgtatgtatgtatatattatacatgatctacatctacggtcatctaacactgcactgtatataaaggaatctattttttttaagtgcgtggtgcacatctggctgtgagctcaccacacgtgcaggtatctgaccccaggctcctctccaggactcctcggcaccggcagaaaggccccaagtgccgcagctccaagcccggccctcccactcaggctgggctcagggttgagaattccacccgccactccaacgctgccaagtcttatctctgccacatttctcaatgtgacattgcacaattcttttggacaaccttgactttccgtggtgctcactgctaattttaactacctgatgtttccccacaaagtaaatatgaggtgttcatgccaccaccatggcagcgttccagtcactctgcaaattcggccagtttcggtcatgacaacgacatgaaacacaacaacccaggcgtgaggacagccacccttgggatttatctccactggggatgaaaccaggccgccctcctccagggctgccaaacacagctcccatgaacgaccaggtcaagcacgttgtccttgggtccagagacagaccaggcagcccacgctgcgtgtggtcttaccctacggtccagagactgcagggatgtggcgggggggcctggggaggatctttcctggacacacataaacaacacctaaattgttttgttttgttttgtttgagactgggtctcactctgtcacccgggctggagtgcagtggtgcgatctcagctcactgtaacctccgcctcctgggctcaagcgattctcctgcctcagccttccaagtagctgggattacaggtgcctgccaccatgccgggctaatttttgtatttttagtagagacggggtttcaccatgttggccaggctggtctcaaactcctgacctcaagtgatccgcccaccttggcctcccaaagtgctgggggtgatccacccacctcagcctcccaaagtgctggaattacaggcatgagccaccgcactggcaaaacactccctaaactgtatacaaaattgcatctatttgcatttttgtgagaacaagtttacagctttcaccacatctccaaaggaatccatgacccagaaaagatagagaaccagcccagtctggagaaagagggctgggggacacacacgcgttcatctaactggccaaaggaatttttgttgtgatgtggttattatcttctcataatttttttttaaatcagtcctcccttttgtagtttacttcagaatttagttgggcaatttaggttcataccaaaacaaaaaagggggggcaaatagaaacaaaggaaaatagattctaagtttaggaaaagctataagtaacagcgcagatcactacagagctattttctgaagctcatcaaacacgtacttggtgatgtcagaaagtaacagtcaaaccacattttctagaactgatccaagaggaatggacaaacgtatgaacgactacaggtaaaactactggcatctgtcaaataaaacaaatcaggcgagcagtggtgtctggagtggagtccctgggtcaatgttactggcgtggcttgccagggcagtgtgagcttgttgtgaaccctctgtataggtgttaactcatgcattttgaaaagtaacccaggacagacccagccaaggaaagactgagctagaaaaaaacagcaaaatactggtttcacatttcataaccaaagcacaggccgtcctccagataaaacgttcatctcatctgcatgttaggttcaaagaagcggctgggacactaccgctcaaccctcagattctggggtctggccaccgcgttggccctcagagctgctgctcctgcgtgcctggtgctgggaggccatgcgctaacttaggtatcacagcacagagaaaccagacctcacggccctactccccgcccctcaccgccctggagctgcctcgaagctgcacacggcagacaagcgggtgtccatgcacaacctggggcaggttctcacaggagaaaacggctcacactcaggagacctgcatacatccccgaccagggcacgcggcattctgggcccgccaatccagctgtgggctcaggccacgtggcacactgggcccactctgggctcaggttcctcagctatgtgggccgacacagacttctgctccctccccaaggctctaagttaccgtaaacttatggccacagctcccacccaacagggaaccacacaaggaggccgtggagcacagagccccgcacgcgcccagggcgggaggctggccaagcacacaggctcctcgggtccctcctcggaaggctgcggcccgctcctgcacccctgctctcttggggggttccagtaacagctccctccgtgtgccccttgggcctggagtggaagcagcagcatgaggcttcacccctccttgctggtgtccctcagccctgcccgaccctcggtccagtccttccactgcctcctctctctctctccttgcaggtgccacttgccgcctggtaacacgaggacctgactgacacagcaactaacatcgctccacaacacacacaggcatacacagtcttcatgggtcactgaaggtgtcagcgacaaaaaccacaccctatcaacgctgatgaagggctggctctaagaagttctccatcagcttgttaacaaatcaagactagaaccatcagccttgaagctggctctaaactgcaggacagatgagtgcgcagatgcctgactctgggacactcaggcaaggggcctacataccccctagggcccagattacaggtcagtcatcggaaatggggattggacacccacatgcatggtgactcgaggacagcaccatcctcccccacccccctactgaggctggatgcgtgggcctacgtaatgcacgccagcagttcactgtgactacagccacctgcttcctcaagcccacaaagtgaaaaagaaaatgcggccgggcgcagtggctcacacctgtaatcccagcactttgggaggctgaggcaggtggatcatgaggtcaggggttcgagaccagcctggccaacatggtgaaaccccatctctactaaaaatacaaaaaactagccaggagtggtggcaggtgcctgtaatcccagctacttgggaggctgaggcaagagaatcactcaaacccagtaggcagagattgcagtgaacccagatcacgccactgcactccagcctgggcaacagaatgagactccgtctcgaagaaaaaaaaagaaaataaaatgcacggcaatggcactgtacaaagtgcagggtggaatccgcaaagttccactgaagacagtgtggcaatgtctgcctttgagcttagcttagagtgttgggacaagggggaaggcatgctcggaaatgcattttctgtgtacaaaacttctctgcaatcaaaaaatggaaacagaccgggagcagtggctcatgcctgtaatcctaacactttgggaggccgaggcgggcagattgcctgaggttgggagtttgaaaccagcctggcaaacatggtgaaaccccgtctctactaaaagtacaaaaatcagctgggcgtggtggtgcacacctgtactcccagctacttgggaggctgaggcacaagaatggcttgaaccttggaggtggaggttgcagtgagccgagatagtgtcgctgcactccagcctgggcaacagagcgagactctatctcaagaaaaaaaaaaagtaaatgtaaaaaaaaaaaatcatccgcggtaaagatctacagaagaaaaagtgagaaaaaatggtttgaacaagggttgagacatctggtttggggattcaggccagctgggagcaaaaagaagacccttgggcacaccacgctgcagaccaggaggacctgagtccgtggcccaggatctctgtagaccagggtctccgtggaccagggtctctgtgtactgttagcatagcactcccccagggccaaccgagggaccctgcctgagcttcctggggacaatgtgccacctgagaaaacccacagcgactggtcagggtggctggacagaagcaggtctcagtcaacgcctgctgtgaatgaacaagccgcatcgggagggaccagtgcgtgcagagggaacgtgcaccggggccagcccctgcctagaagcagagcaggaggtcagcagaggcagccctgaccccagcccccgcctcaccaacccaattccaaggtagcactgcaggcagatggccagtggggacaaggctggcctgaggcttgctgggacacacggtccctgctggtccaaggctgggactgtggagccccatgaggcctccccagagcggtcccctcacagccagttccctgtgagcagtggaactgcaccagcactcctgtggcaggaacggctgtgagctcaacgtggcaacccacgtcccggggaacccatgcatgctaaatgggggccaccagccagcatggcaggagaaacacacatgtgaagacagagggcagcacaagagaggggagcggcggtgctgagccccaggcccagttggtgcgggacccctgggagggaggcaccctgggagggaatcagctcctaagtcaccacttgcagagcccaccaagggccaatgccaaacctaggcctcatctaaccctctgggggctcccagggcactcccaagtggcagcctcagctcgaaggtgaggaaagtgagtcaggaactggcaggtaatggagcattcacacccggcagagtgggggcagcaggttccccaggttctccggggacagtcctcccactggacttcaggagagagctgcgggcaggcctgtctgtcttgggttggcagaggggtgtggacattccagagagggaagtgagaacacacactggacaggaggaagcagcgctgtgtggtcagagaggagctgccacaggctggaggcatgtgagccagggaaggcagcccctgtgggtgaagggaaagcaggagggaagctgggaccacacctgctttatgggtggggccctggggctcagagaaattagagatctgccccaggcccctgagagaggcaccaggatccaatctctgcaggacctcccagtcctggcaggaagagcccaagggcaccaggcggaactcccagggccgccaccttcaagttaggctcagttcctccatgaagatctctctctttttaaaatggagataacagcgcatcacagggctattaacattgaaagtttaagtgttatcaggaactaccgcactcagcaggggacaggtataaggaaatcccttctgcaatgacgtgaaggcatctaagatgcaaagaagctggtctggaacacccacttccacaacacagcacccagggggacgcagaaaacagggtaaacggctccacaagcaactccatctccctgaactgccccacggcagcactgactgaggcccctcgattgaccactcggaacccaacatcagtctgaaaggtctccagaggctggaagcacctgggaaggttaccctggttgagtgaacgtgatgagaaaaaacaacttctcaaggctgaaggccttgagtgccccagcagccagcagccctgcaccgcccaggatggtgcggagctcatctcgtaaggtcagaggctccctggctttggtgctggagcccttgcccctctggcacaaagggacaaggtgtccacagcccggggtcagcccgacaagaccaccatccaagcctggcccctaggaaacaggcttccagcctgggcaacatggtgagaccctccctatataaaaatatttaaaattagcagggcacagtggctgacgcctgtaatccaacactttgggaggctgtggtgggcggatcacaggaagccaggagtttgagaccagcctggccaacacagtgaaacctggtccgtgctaaaaatacaaaaattagccagacatggtggttcatacctgcaatcccagctactcaggaggctgaggcacgagaatcgcttcaatccaggaggcagaggttgcagtgagttgaagtgcagttgcccactgcactttagcctgggcaacagagtgagaccctgtttcaaaaaacagtaataaattagccgggcatggtggcacacgcctgtagtcccagctactcaggaggctgaggcaggaagatggcttcagcccaggaattcaagctgtagtgagctatgattgcactgctgcactccagcctgggtgacagagcaagacctcatttcttaaaaaaaaaaaaaaaaaaattaaaattaaaattaaaattaaaaaaaaaaagaaggccaggcgtggtggctcacgccagtaatcctagcactttgggaggctggggtgggtggatcacctgaggttaggaattcaagaccagcctggccaacatggtgaaaccccatccctattaaaaatacaaaaattagctgggtgtggtggcgcacacctgtggtcccagctactcaggaggctgaggcaggagaatcgcttgtacccacgaggcagaggttgcagtgagccgagatcatgccactatactccagcctgggtgacacagcgagactccattgccaaaaaaaaaaaaaaaaaaaaagtggagggaaagaccctcacgccctttatcatatgaagacagagcaagaaggggcgatgtttgaaccaagaaatgggtcctcaggagacaccaacctgcctgtgccttgttcttggccttccagcctccagaacttgagaaagaaatctttgttgttgcaaagccacctggtctacggtacgtgtttgaagcagtctgaccaccctaagttactgagtcccccccaggtttgccacactgaaccagaaacaccagtgagggccttgggaggagggtcagaaactgcttcctctggttcttctctacaccatccacttggtgcttcaggaagcacaggcagctccctggctgccttcccctctgagttattaaagccaaatgcaacagggctccaccaagaagaggcgggcacccggtgggcgccgggcactctgcctggcaatgcggcaagtggatgctggcgggggaggtaggcctggggtccacgcctaaggcccgctaagccgaagcagaactgtgtgggcaaaaataaatccccagatggacaaggctctgaggggatcaggagaaaatccacatggaaatgtttaaaatctatttcccagaaccctatcatcaccaggcagaaaccacagcctgcatttacagggcttccaggctctcccacagacccagaaaacttaatcaaaaacctatctgaactttacaaccacaaactggcaccagccacgggcccttatcagcacacagcctggctgctgcagagatggcacgaactgtcaggaaccaacccgggactgacagcccggccagtggccatgccacacacagcctgcacctgtggactttccatttgcagagatctaggaaatggcaaaatgctttcttctttttgcatagatttttgaattagcaaaactgccactggctagttcacttgttgaaaaaaactgttccaattttattttaaatttgattagctttaaacattacctcatttcatttcaggaaaagttagcaagatttttctcacacacagccacagtattaaagagaaggacatgacacccaaaattgcaaaaaaaaaaacaaaaaaccttctccatgtgactgttcacccagcttctcactccagctgtggatggtgggccacagcgctgcccgggaggcccacctgctgtgcgacagccctgcggcaagcccgactggcccaccatcccccgtgtccacactccccaggctctttctgcaaagcccttcccttcatcccacaggccatgtcctttaaaactcagttcaaagactagtgagagtcaacagaattgctaacgggtgatgaatctggggataacacgattacactattttcactacttttaggcatgtctcaaaacaaccacagtaagaagtttttaagaagaacattctgtttctttcaaggactacctgctcagacgttttccgcacccagccatgggtcagatgccctcctcggggttcccaggcctgccccatcaccctggccagatggctgtcttctcaggcacctgccttgagcctggcactgagcagccacctggggaccatctccagaatggaacataccacagcaggcccagtcccctgctagctcacagtctgagcctagtgacagtgcccaacaagagggcaaaattgggcaccaaaggctcaacccagcaagccaagtggccaacccgaaagaaacaaggaaacaaattggagcggcagcacctcctccctgacctccgcaggagccagggagccaacccagagggcagtgccagctgggcacagctgcccatacctgtggcagccaggagtccttccttccaagctcttggccagggaggaggggtgtgggaactagcatgctgcgtgggccaacagcagggctggccacagagccccctccagcagcagctacctggcatggggagtgaccgcaaaggtgcctcaaagtcgaatccaaggcatggagggcactgctgcatttctccacgcagaagacaaacggcacttttcagtggggggtggggggagctgatgagcagtgcgacccagtggcccacaactgcactaggccggccgtatccggtggctcctctccctcaccagtgcccccaccaggcgctgctccagaggtcccagctgggcgcccggcacggatgcagatgccgcactgtctagcagcgtgagtgctgctgtgaccccttctcaggcgcttactgagtgctggagacagaaacccctcacacaccctggttaccacacggaagcagaagctccgagcactgggtggcttctggaaggtcacaaagccaaggagggcccagcccggactataaactctccctgcaccccacccacaacgaggacgccaggcttcatgatgtttctacggaaggagaaagcggacggggagccccgtgcctttaagaattaaaaacactctcgacacctcaatagttcagtagtggactagacatgttttcaacagccttgatattcccttcggcttacctagggagacacctgtcacactagagacaccagctccaggctgcaagtccataacaagaccacctgagctgtgggtgtcgttctcgccaccaaatcagagctgcccttcaaatgggcacggttagggacagcagagcggccgtggccgcagccccgggatccggcttcatccagcagagggtggtggtgcgcaggccctgatgggggaggacttccacactccaagcttttaatgccgttttacgtaagcaacacgaaaaaaaccactagcagttattctagtactcctggctgggagcggatttgcatactgaagtaaagcctcaggttagggcaggaatttctagaaccagctggactctgctgtacctgttcttcttcagcagccaaaacgtttctcaaagtcttttaagagactgaaacattgatttcagtattaatacccaaaataccacgaaaatataaggatttgctgctttggagaagggaccaatggaggatcccctttccagggtgatttaatccggttctgtgggggtaattaggggctggcctgtcttcctggtcccgttcttcactgtttaaaccgcaggattcctagaacacgaccgtggaactgctcttctcctcacccatccctggaatgaaggcactggccccatgatctgacgacatcatcgcctccccaaatagctgcatggccgaattggaagtgacgcattcttagtggactcctaatggccagccctgaggacagaagacaggttaaaacttcagccggacccacattaccgattccacagagttgggcgagtagcctgctttcctccaacaaagctgggagacaccagagaccccaggtccgtcaaatctcctcttatgtcataaaaccatcacacaacgcaaagttctactgctctcagtcctcagcgtgctgtttctgagtgggatgggaagtggtggttttttggttactaaactgattttcttaccaaatttcattaggtctaaaggctaaaaatagtaaatctttctactttttgagcatctccagatttgagcaaattctcagggatgccaagtgtcaacgccccggaccagcctcatctggttctcgggcagaggcccaccttcccaacccaccccatggccctgatcctaatggcaacctgatggcctgagaccagctgcctcgctccggaacaggcacagcgatgccctgtgcaggaagaagggcggagcagggtgaccagattcctgccaggcaaaaacctctagcaaatctaaagtctggccatgtcagtcttctctgcttctaacacacctttctgtcaaattaaaatttaacccgaggcacaattccactgtcttacattttagcccaaccagatgaaaatgccgcagcgtgcttactcgtgaaatggttcatcttctgccctttaacactgcgcatttagaaaacaggcaattaaatagtaaagcttaacatggagcagcacggaccccgtgactcgacgaagtggcgtggaccttacccgtggaccaagtgtgcgaacacagcacagcaagcgccccgtgcaaacacaggagcatcctgaggggcctccggtgtggggaactcagagagccgcaaggtccccacaaacgcctgcctaaaactggactgcctgagaagctgctgtggagaaagtcccggtgcccagggagcccccacctccagcctgcctgccccgcctagacaagaggaaggcactcttcccagggaacgttccagcaacagagatgtacccggtaccagggacagttcaattatccctttaattaaggcaccttaaacgggccccaccccccagctctttgagacctccttccggtgtattttgtgcatttagtaattgtttatcaagatcaatgatatttatgtttctgtgatcaattctgtactgataattacaatgacataaaacattcttctggatgttaacatagcctaatgatcacagaaatgttttaaattgcaatatatacttttgtcacagagaagtatggagaacagtccataggtcgggtgcagtggctcatgcctgtaatctcagcactctgggagcctgaggcaggagggagggtcgcttgaggccaggagttcatgaccggcctgggcaacatggtgaaactctgtctctgccaaaaatacaaagaaaaattagctgggcataagcccagctacctggagggtggaggtgggaggatcacttgagccggggaggtcgaggctgcagtgagccatgatctcaccactggactccagcctgggggacagaatgagaccctatctcaaaaaaaaaaaaaaaaaaaaaaaaaaaatcctgggcaactcagtgagaccccatctctgcaaaaaataaaaataaaaactagctgggcatgatagcatacacctgtggtcccagctactcaggaggctggagagagagaattgcatagacctaggtggtcaaggctgtagcgagccctgatcccaccactgcactccagcctgggtgacagagggaaacactgtctcaaaaaagaaaaaaaagaatgagggatgaaaagactttcaaatggagcaaacatacaagttcacaaagaaaaaaactgccttgtcaagactgttaagaacaatttgttcattttttaaaagggtgactgatggtaggtatcattaggatatttaacattggatactttttaaaaagcaatacaatggttacttttaaatgccaacattatactagaaattgcatcttttgcagttgtttcaaattaggaccaaaaatttaaacatcaacttaaaaatgtgtctatagtttttcaaagttttttttgttttttagatggagacagaggcttgctctttcgctcaggctggagtgaagtggcgcaatcttggctcactgcaacctccacgccactcaccatcaccaccaccaccaccaccacccccatccccgctgccctccctccccccgaccccacccctgcccccaggttcaagccattcttgtgctttagcctcctaagtagctgggattataggcgtgcaccaccacacttggctaatttttgtatttttagtagagatggttttgccatgttggccaggctggtctcgaactcctgacgtcaggtgatccactcaccttggcctcccaaagagctaggattacaggcatgagccaccgcggcaggcgtaaagttattttacagaacacataagcaaaaatgttttcaggcctttgcttgacagcaatgtaactctaaaacattcctaattcattcatcactgacagtgaaaaagctgcctctacgatactcaggcagtccccctcgcctcgtgtctaacatgctcttaatatgcgatttcatctccagcgtggagatgtcaaacccctcccctcaaaaaacttacaaaatattcccttcccatatacaccaaaccaaaaaccatgctcttgaataaatgtatttccctaaaatgatgactacattgttggtgataaggaacttattttctgttttttcttattttcttgttttctggccttacaatgtctttttttttttttttttttgagacagggtctcactctgttgccccagctggagtgcagtgtgggtgtgatctcccctcactgcagcctggacctcctgagctccagcaatcctcccgcctcagcctctcgagtagttgggaccactgatgtgagacaccgcatccggctaatttttttgtatttatagagacagggttttgccatgttgtccatgctggtctcaaactcctgggctcaggcaatctgcccgcctcagccgcctaaagtgctgggactataggcacgtgccatcgtgcccggctaatttttgttttttttttttttttggacaggtggggttttgccgtgttgctcaggctggcctggaactcctggactcaagcgatcctcctgcctcagcctccaagagtgctgggattgcaggaacgagcctctgtgcccagcctgagtgatttcctaaaattgtgcaataagggtcatatataaaagtataatgaccaccacacctgaccaggtaagcactgtgttgatccctctttattatctattctaagggtttgctatgcatttttcactcaagattttcctttctttgaaataggaaaaatttggttgccagtcaattcagatggctccaggatttcaaggcagaaccccaagagaaaccttggggcaaactacaaaaactcagagcaagtagcataacagaaccccaggttggaagggacttttcaatgcagcaaattaagcacctctgggccagagttcaggaatgcagtttcctctcactgccagcaaaatccttcaacaggtttaggaggatgaaagtaccgagacccaggtctgaacaatacctccctcactggggcctgggcccagtagaggtgggagggtgagatggccaagctcaatgacttgaaaggttacgcaaatcccttcagctgcctcaggatcccactctggactggctggcacccttattcctgcactggggacaaaatgcccagcactattcccccccgcggctcccgacagactctgagagtgaacttgtgttctggagccctcactagacaggaaggtgggccttgggatgaccctcaaaataatgcagctacagcccagcccctctaacttaagagaaatcccaccagctgcggtagtatgaacctataacccagcagctacttgggaagctggggcaggaggatcacttgagcctaggggttcaagacctgcttgggcaacacagtgagaccccctgactcttaaatacacacacacacacacgcaaaggagagagactataatgccagcacttcgggaggcccaggcaggcagatcacttgaggtcaggagttcaagaccagcctggccaacatggtgaaaccccatttctactaaaaatacaaaaattatctgggcatggtgatgtgcacctgtagtcctagctattcgggaggcggaggcaaaagaatcgcttgaacctgggaggtggatgctgcagtgaaccaagatcgcaccactgcactccagcctgggtgacagagtaagactgtctcaaaaaaaaaaaaaaaaagggggggagagagagaacttcctctccctctcacctgaagtccccaagctacacagcagctgagccaaagagaactcagagcccttctctccatcatcagggttttgtgctatttcccgcaatctaaccagtcgcactcaacaaatgacccctaccaagtgtcccgtcttcctggggcaataacacccacgtcgtctgaggtgggaacaacagcaacccatccacggctctcaaagggccactctatcagggatatgaaacactaagtgggttatgcggctgccctctaagtctgtggatgtttttaatcttcttaaaatgcctcctccaaaagtcacttgccaaggaggccacttcgtaaacactatgctgtttctcctgtcacctccacccaaatggcaaggggttgaaaatgacaatatgacctgttaagcttccctttcggcaggccctctcctgattcagggtagagaagattcatttccacgaacattaaagaggtctcccggtcctctgaaagtgcctgatttcacaaaagcttagcatttgatactcgggggaaaaggccactagaagcacattttgaaagtttcacatttaaaaagatccttgttcattgattttggtggggtaattaagctaatctaaacaaggggaccttgtctaggagccggtgggggaggtgcagccgctcaggtcctctgcatgaaaacccactgcagacgcctgcttttggggtcctctcaccccttcctttctacaaggctgctcttcggctgggaggtttgctccctctggtcaaatctgtttcctggctcaggtggagacaacccttctgatggtgtttcactaagtgcgccttcgtcagcataatcacgcagtgatgaaaacctggggaacctaggaggccagcgaggaacagtcctcacccatcattagcaggaacgcggcttccagcatattctgcctccacaaattacagacacgactctgccaggggtgttcccaagaagggcactggcaatttggggttgtctgccacctacagtgcttgtcagtcaccctcactcggtgccaggccacaaggctgttggtcacaaaccaccccagccagccactgggcgtcaggaccctcgggaagagcgggagagggcactgggatgcaccacggtcagaacgacaatcacagcccgaacccctgcgctgcactcctctgtcctccccacctctctcctgacaacacagatacaatccattcaccaccaagcaacctcaagattggctgaaataccttcctcggctcctttcctccatcgggaaagtggggagctgccgctgccgcagccctctccttccctgcagatctgcggggcgggctggggcgggatctcagagctcacggaaaggaggcagaatccggtttacaggcttgctccgcccctcccccacccccctccaataagcaaagttagagggtgttacaagctgcaagacacacaccttggagctcacccagtccaatctctgatctgctttcacgatgcgacaagggccaaagctgcagcacgcatctcggcagggcagcaggccactccccccacgaggcccgggaggtggccctgggcagcctccccactccccgccctgtgaacacctgggccaaaaaaacacacctttaaatacccagtgtgtatttcaaacacatttcaaacgatttgcttctttcctttacagccactgccacaaaaacaattagcctgaacgggtgtgaaatccttgatgtgtaagacgacctagttccccagcctctctctagaaacacatgagttctttactgcgcctgagtctcctccacccggaacctgcagggctgcctcttctcatcaagtggcttctgcaaaacctctcccaagcatttaaataatctctgctcgttcttttaacaataattcaaacctagcagaaaagtgaggacactatacatttcttttaaggacagtgtgtgttacctgctctgatccccatgtgttacactccctaacctgtacaccaatactccagctttttgttttcttattttttcctaaagccagcacaaaataacagaaggataagattcctaccacattctacctgtctgccaatgacacaggaaggatgagaccgtctggggaatggaagcgcagggcgctctcagtaatgctgggcagatgcagtggcttttccccagcagaaatgggcttcgattcagaatctaccagcccacaagaatcatctgaccccacaacaattagttcaatcactcatctggtaaaccctcctcgctccgggtcatagactggaaaagacagcccccaaaacagtaataaaaacgacaagccctgttttgctggagtcagctgaggtatcagatgggggtcagtggctaggtctgtgaacctgaagccacactccatcagtgacccgcactggagagacacaaacacctcaggctccttaggaggtcaagcggcccttcccagccctccctagcccccgccttctagaatcattctgaatagctaaccaggaggctgggccccgtgtggatccgcctccgctggaaaagccgctgctggaagtgctccaatccagagcaggatacctgggggaggaacgggttaagcgcaaaggggaaaggggcagcgggtgctgagacgcagaaggtgcggggacttctacagagcagggaatctgggcccggatgaactgatgccctggcctctttcctccagggacaaggtcggtctcaggaaatcaaggtatcttcaaagggacacaagggagcgcagtgccgatgagaccggggcagagccacagtctggcggtgcaggctgggggtccgaggcgggggacactggctagcagtgctgccagggtcgtgtgtgcactgggcagagggaaaggaggggaagaagggaaggggaagaaggggaagaagggagtgtgttcggttgggaggaccggtccagacagaggggagagggggccacttcgcgagtggtgtatcgctggttgaattctcataagttagagatagcaggcaggggttagaaggacaagacagggtcaggaccaggagttagaggcgccaggctcctctctgggtagagaaaccgaggaactgggggcggggaggactgatgggtgcgaaagcgggccgggtccaaatgaaggcgcgcgccccggggtgggggccggggtggggggaatgagggaggctgcagggctggggaccagggcaggtgcaatccggaaagaggaggcgggaaggaattggggggccctgaggagccagcgcaagccgggtgggggcacgtcccctcccccggagaaggtgcggggctggggctgcggcgcggacccgacctggaggccgaggctgtgcgggaggtgggggtggggaggctgcaggtgcccggcgcccaggtgcgaggtgcagggggcggcggggcaggcggctgcgggcggcaggccactcacctgtctcctccggccggggccgcgggggcggcggggcggccgggccgggccgggcaggggctacgggggcgcggagccccgggcgcaccggggtcgggaggcggctgcgggtccgggcgggggctgctccctcggccggccggccgggcggtcagtcagcgacgcgggcgcggagagagcgctgcgaggctgcggccggcgcgcggagacaacgccgctttatcgggtcggaaacagccgctccgcgccgcttccgctgacgcagcgccggcccctgcgcctcatgactatgcagcacccgccgccgcgggacggggattcggggggcggggtctgcgccgcgcgcgctcattggcctccgctgccgcccaccccgcccccgaacggccgccccgcccccgccgcgcccctgccccgcccccgcgcgcaccgtggctcccgcccccgtctcgccatggccccgcccccagccataatccagccccgcccccgccctcctcccgctacgcccccggccccggccccggccccggcccctccgcaccgagcgtccgccctctctcccctaaagcgctggcccgcaatccaccccatccctctctgcagccgcaggaggtggcccccgcctgtccccaccttctctccccgctcctctcgccactctgtcgcagaggggtccggctagccacgaggccccggcccccggcagcccagccccttggcaagcaccctcccgccccctccgcccctgcccgtggcgcggcgacatgggccccatccaggtgctgcagcccctcctccgctgcaggagaaaactctcctgttttcccctccctgccaccctccgaagacctcctacctggtcccggaccacgcccccgtccccaactcccccaacgccccgcgctctgcgggtcccctctccaacctggagagcggggcaggacgaagacccgacccggagcttcctggaggctgggcctccctctcaggcttggccctggccagggacactgatccgtctctccccacgtgtagaagggccacaatccctagggcaggactgctgggaaaccccatcaagacaaggtctggggaggcggctttaacagacagatgtgatgggctgaggccaaccctgttaacgtcgcagccctgcacccttgccagggtttaagttgctttggaggaattacttcatttctcagaaccttggcgtcctcatctgtaaaatagaaatcgtaagatccatctcacctgttgctaaaggaatttagaagtgaagtgcagagcagagcctccaagagcatcggaaatgggaaaatctgaccatatcaagtgttgacaaggaaatggagcaactggaactgccagacactgttggtggacatgcaaagtggtacaactttcaaaatctttttgaaaggccttgattacccagcaattctgctcctagatacacacctaacattgtgtttctgttgatagcagcagtgtttataattgccccaaactggaaactactgaaatgctcatcagccgttaaatggatacataaattgtgatatattcacacagtggaatgacagcaatgacagtgaataatcaactacacacaacaacatggatgactctcacaaatgatgttgaggaaaagaagccagaggataaaaagccatatttgtttccatgtggataaagtggtagaaggtgtatatgggggtagcagtcaggatagtggttacccttggagggaggggtgccagagccaggaagcagggcacagaggacgtgtctgggggctggctgtgttctgtgtcttggtctgagtgctggttacagtgtgctcagtttatgatgacttttccagctgtgcagtcaagatgcatgtgcctgtggggcacggtgattcacgcctgtaattctaacactttggaaggccaaagcgggtggattgcttgagcccaggagtttgagaccagcctgagcaacatggtaagaccctatctctattaaaaaaaaaaaaagacgtgtgtgtttttccatgtgtatgcagtatctcaacagagggttagtaagtacatcaatggtctgtagacagtccaaagcagcatcagacacatcatgagtgctcaaactgtacatctgcttccctggtgatttttctttcaatggccaaaggatagaggcagcggcaattccaggtgtgctgtgagccaactgtgtgagcctgggcgcctacttaacctccctgagtcctcttctataagtgagcattctaatagtacctagttcacaagttgtcctgaagcttaaacaaaatagcaaaatgatgctttttaaaatgacaatacaatcaagaggacagaacaggtaaagactttgtttattcacaaattgctggtattgattgaattgtcttcattgtcattcatgcagtaaccaactactgagtgtgtgcctactatgtgccacacgctttgctgggtcctagtactggagctgggaacatgatcccatctctcttcttaaggagtgcattgtggggtatgtaccagccatggtagccatggagcccagtctaggatcagccttgtagtaggtgctccataagtatttcttggggctgggcatggtggtggctcatgcctgtaatcccagcaccttgggaggccgaggtgggtggattgcttgagctcaagagttctagaccagcctgggtaacatggcgaaaccccatctctattaaaaatacaaaaattagctgattggggcagtgtgcatctgtgggcccagctacttgggaggctgaggcgggagaatcacttgaacctggcaggcagaggttgcagtaagctgagatcgcaccactgcgctccagcctgggcaatagaatgagaccccatctcaaaaaaaaaaaaaaaaaagcctctaaaagagtaactgaatgcaagtatagaagtataggcaccagcctagcaacatagctaggccccatctctacaaagaattcaaaaattagctgggtgtggtggcacatgcctgtaatctcagccctcagaaggctgaggcaggaggatcacttgagcctgggagttcaaagctacagtgagctatgattgcaccactgtgctccagcctggatgacagagcaagaccctgtctcaaaaaaaaaaaaaaagaatgtaagtgtaggcatgaagtttcttgtgaatgaaacttagaaggcagtttctaagcctgagatgtggaaacccaactaatttacttctataacctggagttaaacacagagaccagagtaaagttaagaaaaaatatatccccattgtgcaagcacctcaacaagtgtgtgtgcatgcgtgtgtgcatatgtgtgtgtgcatacgtgtgtgcatgtgtgtgcatgtttgcatgtgcgtgtgtgcatgtgtgtgtgtgtgcgtgtgcatgtgtgcgtgtgcatgcctatgcaagagggcagtggcagggccaccctgcagcactccttcccagcctacccggccagggccttatattacctgccaccaccaagaagggtgatatgtgtcagtggcctgtggccccattgtccagctgcccatggaagccggggaatggaatcctcagggcccccacacatctttgccccactccaccccctccttaaatggctggctccccagtcctgtgaggagagagcttgatacggggaagccctcttgcccaggggtcagaaagacacggactctggcctggctctgaagcaggcgtgcctgggcccttagctgtcatgggtgtgtgacctgtgtagtcacacatacccagtgctcagaatagctccacgcttggcttagcgctctgctgttgccatctttaaatgcttcacagcttttaagaagggccccacaaatgctgtggcaaatcctgcatctttgtgagcatgacaacctccccgatgctgggacgagtccagggcgtggtgcctccatcactgcttaggttccaaccttgtcttctccgtgcctcacctggggatgccttggagcagggccaggcccctctcatccccagcgctcatgtgtgcacaccttcctgtgagatgggtgtcatcctgcagaggaggaagctgcgacacaggttgttggtacctgtagccgcacagctggtaggcgatagagccgggatttatacctgggtcatatctggttaggtgttaggtgaacaggctgactgattgaatgaatgaatgaatgaatgacgtccgtgaacacacccatcttactattgctgggcatcattcccttcctctcctctgtgcctcgtaaatgaagaggaaagagcctgtttggtgcaaaacgtccacatcccacaaacaggctgtgacctgctctgagccagaggccagctggtgacctggtatggacagctcctaccttggttgaaaagacaagactgccctctttggaccttgtggagaacacactgggccatgggagagaggtagaaggtgctccgcacaacaggtaaatcaggagagaaggagaaggaatgaaggccactcagacttctccagcccctgccctcagcttccctggccctctgtcagcctttccattgcacagacgaacaaaccaaggctcagaggtagcgtgacttgcctgagcagcctctcttcctaggaaaagcaggagggcttccgggcaggaagcccccacggaggtggaggctagagggctggtgaggcatgcgggtgccagtagagcccgcgggtgccagtagagcccgcgggcgccaggagctccacattcctggcaggcctggcaggtcccccctcccctggctctctcctctgtcacaccaggtgactgtccgtgccacccttttgagcccatccccagacctttgcatctgccattttctcttctgggagtgtccctggtgctctcctgccatgaggaagtgtccgagagcaacaaccattgatcccagtttgaaaggaaagggagggaggtggtacatatggaagccctccctgaactggctccaattttactatgattcaaacaacaacccgcctttaaccaagggcctgctgtgctccagctgccctcaacccctgcccagcttccttagagaatggaggcacaggattctctccagagaccacagcctacacagcggtggggtgggggcggcaagtaggtgggccctgaagagggaggaaagagaggggatgagctgaagcagtgtcccagccagacagtcccttagtgacacctcctgtgctccttcacaaatcttttatcttttcaaagcaacaaacacgtttttaaacaaactcgttcacaaaaccccaatatgtcaattagcacgctcatgtatcaccaggtgttcctaagacactgccccgcttggctctcgtgcttagggcgctgatgttcaggctgtgtctactcaccctgccagcgtccttccgcctgctccgccccttccccaggagcagcctctgcttaggtgaggctaagagcgcaggagcagagttctagcttactgtgtgaccttggagaaaatacctaatctctgtgagccccaaggcaaaatgaagagggtgtgagctccacagagggtaggggccaaagccctgggatgcaggtgagtaggtccacaacccgcaggtcttggatctcaattgcccaggaggggacccgagaccctaaagaccatgtgcctgcccagtgtcctgggcagccaagggctttcagagcagccccagggccgggacacgaatccaggtcggaacctccaggtacctgaattggctccagagcaatgggcttctggggtcccacggcttctcttcctggggtcatatggctgcccggtgtcatatggccaccaaggggccatgtggcatcctatgatcgtgagcttcttggggtctcatggctacctgaaccatgcgattgcccacggtcacaatcgctaggagtcacacagctacctgacgatggagtgatttagccactcggggtcataccccaggtcacatggacacctggggccacacggctccccatactggtgtgtctcattggaagttcaatgcaatccaggccattccactgcttctgtgtcctgggtgagccccatcccctccctgagcctcagtttcctcatcagtgaggtggacagaatctttgtttctctagcacaaaggactgtatgagaggattatgtgaggaaatgacagtgcagggcccagcggaggtcattgactaggaagagctcatcagtgaccacagtgccaggaaagggcagctgcccaggactggctgtggccgtcagcacgacgctggccctccaggcctgggcagaacctgaagattccccagaagagactgaggcaggttttcactgaagggccttccccacatgggcccgccctgggcaaaggccgggtttcagaagcacgagaggggtgaggggctgggacaggctccacgcccgcccggcagcaggatgtgcacgcttgcagctctgcgatgcctttctctgtagctgtcttatatcccacaatgaaacctgtaaaataagtcaacacgatcagacaccgactttgtccaggtttgagggcctcagcacttgacctctttcctggggacgtcttcgagcggccagatgggggtcttaaagagctccttgaggcccgtgtgtggggcatatggggtggggctgagaaattggatctagagcctagtggggcagtggctggctagtgcttgttcagctgggctggtcagggcccagataatgatgcggatcagttaccacagggctccaaagccagctgggcccccgcctgatcaaagtaatctcgtgttgacagcagccctgcgctgggtgccattagattccccatctgctagaagaggaaactgaggcacagagaggggaggtagctggcctagggtcacgtatcgagtcagtgactgtgccagggtttgaacccaggccatctggctctgagtcctcgtgcccccttccacaaggtcacagggcctgccaggggctcctagactgtcagagtgtggagtggttgctgcatctgctggcatctctagcccacctgtcaggatggggaggaggggcagggcccagtacaggggctggcactggagccatagccatgaaccaaatgaccagggtgacctggaaaggaagcagggaggcagccacccagggcggccagcagggtggagcatctggcacggcttctcacagtgaagggtaaaggcaggtgatgtctggggtcaccccacccaggacccctgcggcaggccccacctgctgatggcaccagggcagggcggaacccagggtaagcctccctcccagacatcccctccaggccgtggtcctcagcccagcttcgtctctggactcccacccctgcccctgcttagtcagcagcctcctaagccctctgggttggctctcccttttcctgcgtttgcttacactgctcatcctgccggtagtgcccaccatttcccttgggtctgcctgtcccatgtgtcctcctccaggaaaccctcccagaccaccccagctctcaataattcctgcctcccccagcacatagcaaaaataaggcccacctaggctttaagtcctgaatcatcatttaaagaaccgcctatactttacaacgtgcttgtcctgtccacagtctcattggagcctctgagcagccctgtggagtcagttctggtctccccttacagatgggggcctaaaaggtgagggcaggaccagagctcacctggggtgtcactgcaccagtagttaatactcactgagacctacctgggtgccaaagcctggcctatgtgatttctaatcattcattcgttcattcactcattcactaaacattgactgagcacctgctctgctccaggcactctgacatagatgctagggaggccacacctcctggaatctgcatcccagctgagagacagccaaggagcaaggaagcaagtgacatgcagtaagccggccagcgatagctgctgtggaaatgcggggaagggggcaggcagagtcccccttgaaggggactttgaggaagggcctgaaggaagagagggaacgggcagaggagttagcttcatctctcagtgggagttagacaccccctaccccacgatcaggcacagtagggctgccctcagccaccttgctgcagttctcctggccctgccagccagcccccttccagcaccagctgccttcgaccctctgccctcaactgtgagcactatgtgggtgggctctagcccaccctgtccgtccctgggtccctggtacacagttcacaacttgcaaaggaacggacgagaaaggagtgaatgagagagcgtgactggcctggctcccagctgcatcttgtctagggtacaggtgggtgcaggaatgtgccctcccctaggaggaggccctgtaggaaacggcacaccctggagaaactagtggaaatgaggcgcatcctggttctgatgctttcctgttcacccacgggctcacacactcctgcgttcatgcacgcatgcattcattcatgcatcctcccgttctggaagaagcacaggtggtcagggtcccgtggagtgtgaagcagaacggataaagtccctgctctcaagggcgttacatccaaggacatagcaataaatacatagtggaagaccaggtggtactaaatacacaaagagggcagagcaaggagggtgttgctatggatagcaggtggccagcaaagcccccccgagtggggtacgggaaccccaggagggtctgagcagaggagggactcagggatctcgatgttttaaaaaggctcaggctgctgctgagggtggctggagggcacaggacgtgggaagcttcttgacaattcagggagctgatggctgcaggcagggtgttggcagtggaggagccgtggccggattcttggtaaacactgaagctgcagggcggaatcactggagggctgggagtaggatgcggctgtaaaagcttgcataagcctcctgaagcctcagttttctcgcctgtgaagtggggtgctagtacctcactgccaaggctctagtgagaagaagccagggaaaatgtgggagtgaagccagccctcgttggctcagcaaagcctcaatggggccccattcatgctgggcactggtctaggcgtgggtacacaataccccacaggcgcttaacaaatagtggttttggctgggcatggtggctcatgcctgtaatctcaacacttgggagggcaaggtgggaagatcaactgaagcctgggcaacatagtgagaccctgtctctacagaaaatttttaaaatttgccaggcatggtggcacccacctatagtcccagctactccagaaagtgaggagggaagatcacttgagctcgagagtttgaggctgcagtgagccagtggtaatcccaccactttggcaagccgaggtgggcaaatcacttgagcctgaaagttcaagacaagccaacatggtgaaaccctgtccctactaaaaatacaaaaaattagctgggcatagtggtgcgcttgtagtcccagctactagggaggctgaggtgggagaatcacctgagcctgggaagttgaggctgcagtgagatgagactgcaccactacactccagcctgagccatgggagtgaaaccctgactcaaaagaaaatagaaagaaaaagggaggtgggagagagcaatgctaaagccagaggcaactggggccacagtgactgggtgcggcagggcatcctgggtcaagggtggcagcctgttagacagctgcccatggcagggttgctactgtctggccctgtggtgggagagcccaatagaagttgcccggggtgcctgaggtccggagccaggaacgcaggctgcagagagggctgaccccatttcccgaggcagtggtgccaggaggcctgttttccagggtgtttactgggctctccggctccaaggagctctgagtatttgggctgagtgcccggggtcagcccctcgacagcacgctgggaggtgggggtggctgtgctgatgccaccctgggccagtggagaagggtggaggcagcagactgcccggcaacccatgagtgggaggggaggctccaccctccttaaccacagcctgagcagccacttcccaggcccacctctgatttgggtggagctgagctgggagcacttttccaggctacctagtgagggaggggcacagcagatagcaaaggggtcacgattcagtcaacagggtcaggctcagccgggaagcgaataggatcagggcttagtgggtaaaatgagagccagtgctaagtcgagggaaggatcatggtttaacatataaccagggtcagggattaatgtccaagcaaggtcagggctcagtctgtgaccaggatcagggctctgtgtgtgactaggatcagggctcaaaatgtgaccagggtcggaactcagtgtgtgaccacgatcaggactcaaagtatgaccaggatcagggttcagtgtgtgaccagggctagggctcagtgtgtgaccaggatcagggctcagagtgtgactagaatcagggctcagaatgtgaccaggatcagggctcagagtgtgaccagaatcagggctcagaatgtgaccagggtcagaactcagcatgtgaccaggatcaggactcaatgtatgaccaggatcagggttcagtgtgtgaccagggccagggctcagaatgtgaccagggtcagggttcagtgtgtgaccaggatcagggctcagaatgtgaccagggtcagggctcagagtatgaccaggatcagggctctgtgtgtgaccaggatcagggattagagtgtgaccagggtcagggctcagcatgtgaccagggtcagagctcagcgtgtgaccagggtcagggctcagagtatgaccaggatcaggactcagtgtgctacgaggatcagggctcagagtgtgaccagggtcaggggtcagagtgtgaccagggtcaggggtcagagtgtgaccagggtcagggctcagagtttgaccaggatcagggctcagtgtgtgaccagggtcagggctcaatgtgaaccacaggatcagcgctctgtgtgtgaccaggatcagggattagagtgtgaccaggtcacatgctgtgaccagggtcaggactcagcatgtgaccagggtcagagctcagcatgtgaccagggtcagggctccatctgtgaccaggatcagggctcagagtgtgaccatggtcagggctcagtgtgtgatcaggatcagggttcagtgtgtgaccagggtcagggctcagtgtgtgaccaggatcagggttcagtgtgtgaccaggatcagggctcagtgtgtgaccagggttaaagtgcagcctgtgactaggatcaggtttcagaatgtgactagagagttcagtgtggatcaggacagtcagttatgaggattagtaacgagtgggatcaggactcagtctttgactgaggccaggactcaacatgagggccatgtgacagtcacagccctaaagtggactcagggtgtcctggtctcttctcactgaaccagtagccccattcatcattctttctctttcatttgagaaccatcttctctgtgccaggacctgtcctaggtgctacagactcaagggccacttagccacagtcccagccctgaatgacctcccatctcccaggcagcccagttgggtctcaattgtacaacacaccaagataacttagaggctcaggaagggccagggaggcattcttccccaggtactcagtaaggctctctggaggaggttttgcaggctgggtcacttgaagaagggggcaggagggcattccaggcagcaggtaccacctgagcaaaggcacaaaggctggttgccaagatgagtgcttggcaagtgttgggagctggagtcacctgtgcgcgaagagggctcagttatcggacagtgggtcttcatgggctctgagggggccccaggtgacagttcctgccaggtgacagtagttgctctagcagccggtgggcactccctgctctggaggccacccaccttgggtggaccagagtctggaagacaatggaaaggaatgaacctgcgtgaggcagacaaggatggcgggtggaagggtggggacgggtgcggaagggtgggtggaggccagggcagcagagcaggtgagggtgggtagtgccctggaaagacaaaagccaacacggggcacgttggggtgtgtggggaccttggtggctgagtccccaggtgggtgccatcctctgggagcttgatggaatggccaaacccctgcagcctcgaggccccatctgcccacatctcgcttgaaggctttgcctgggggacctcgaggccctgtgctctgccatctgtgcaggggtgtgcaggtgcagggactgggtgggtgggcgcctggaaggacagagctgcatggccttggctcccacctccccgagaccttggctttggtgtccagcctggccctctctccatgtacctcttcacagagcttccagaatcatcttttccttcttgacactcctgcaccccgaggcctggaccaggcgaccagctcctttgaggcctctccatctgagaattcttccaaaactgactcctcttctcactccttcccaccccttccctctgcaactcatccccagagacagggctggggagagagcgggctgttggaggggcagggggctgcctccccgggagaactctgaggccccaaagcaggaagggctggggtgcaggggctggctgggaggaggaggagacctgagcctgctgacagggcaggagcggccagggcgcaggtggggttgaagggcctgcacctctcacggcaactcatccaaccctctaagagcctgcttcattggaccaggtgctatcattattccctctgctcagatgaggaaactgaggcctggagcagttaagtgacacatcaaagtcatccagccatagagtccagactgctgatcccaagagcggtcagggtcattaatagtggagcctcttccccagcaagaggactcgaattagaagtaaagtaaggccgggcgcggtggcttatgcctgtaatcccagcacactgggaggctgaggtgagaggatcgcttgagtcctggcattcaagaccaacctgggcaacaaagtgagacccctgtctgtactaaaaatttaaaaatatacctaagggctgggtgctgtggctcacgcctgtaatcccagcactttgggaggccgaggcaggtggatcacgaggtcaggagttcgagaccatcctgtctaacatggtgaaaccccatctttactaaaaatacaaaaaattagccaggcatggtggtgggtgcctgtagtcccagctactcgggaggctgaggcaggagaatggcgtgaacctgggaggcagagcgtgcagtgagtcaagatcgcaccactgcactccagcctgggcaacatggcaacactcgacctcaaaaataagtaaataaataactaaaattaaaaataaaataaaaatatacaaaaaatgcctgggcgcagtggctcacacctgtaatcccagcactttgggaggccaaggcaggtggatcacctgaggtcaggagttcgaaaccagcctggccaacatggtgaaaccccatctctattaaaagtacaacaattagccaggcatggaggtgggtgcctgtaattccagctacttgggaggctgaggcaggagagtcacttgaactcgggaggcagaggttgcagtgagcagagatcgtgccattatactctatcctaggcaacagagtgagactctgtctcaaaatataataataatagataaataaaaatataaatatacataaaataaaatacaaaataaaaagactggagccttgtgttggtcaaagggctggatgtgggagtataccatctctgagttcagaggtgaccaggcatttgtggggcccctcaccccctgctccccactcaactcctgttcaggttcctgacacaggtatgaccccattgctctcacaaccatgatgccatttgagcctcgatgaccaatgacagctgacatctatggagcattctccatgctaaacacttttcatcccttgctcatttgaggccacctgcaattttagggccatattctgatcaccctttaccgatgcataaatgggcctgggcgtggcccagtggcctggacactcgttaggggaaggcagagccctggcccctctgtccattgccccaggctgtcctcaaggccggtaataaggtcactctcatcctgcaggggtggggtacagaaatgaacgagactaacccagttcttgctcaacctgccaggttggtttgaccctgttggcaccccacacctggagcaccctcaggctacgccctccccacctgctctttcccagagcagggacttctgcggtcgcagctgggctgggggcccctagccgtggggggtctgggcctttgggataccctccttagtctccagagaacatgggtttgaggacctgggcttgaccctcctgggtctccaggcaaagcctcagccccaccagcttcgagggtgagggcaggtgcacagccaccgtgggaggcaggcatgtccagggagcccggtctgtgactgggggagatcacatggagggttgaggccaacttcccacatctacaacattcggccgtgacctcccctcacagaggcccgggagggtcatggattctgctctgaatgctggcccagcaggtgacacacaccacagctcagcccccttgttccagggccatgaggggctggcttcatggatgaatgaaccccaggcccacctggaggctgcatcctggctaccctggccccaagttggggtggggtcaaagggcacaggcacaattggatccaggtgttggagtcccctccactctctgcaagctatgacatcagacaacctgcttccctgctctgtgtctcagtttccccatgtgtatagcacatggcactggtataggttgttgtgagcattcgcttctctgaggccaatgagacagatttgtagcccattgagtgggggccaccggggcaccagatggggatttgagagtgcacaggcatgcccacattctgcctcagactgcaggtgaacaggctcacacacgtgtgcatgcacatacatgtacacatccacatgcacatgccggcggctgtcccatactccccttttgccactgtcccgctggtctatgtgtgcccacggatcctgccccgctgggtgtgccccactgcacaggcacacacacacccctcctgtcctttgctcacacacacagtccctcagtgtcccatgccccagccccagggtgtcttgcttttcattttgtcccctgccccttttgtctgacacatgtttctgtctgtcactcacgtcttcctgagggagtctgccctgggcctaagggtttgaacagcttcagagaaagaggaactggccaggcgctggaccaaagccccttcttcctgctgccctggcctgggccccagtgggggtccttgagagccaaggccaccccgcctgtcctcctgttagtggctgatgctccatctgcctgtgccagacgccctgttggctctcggtccagcggctgttctgggatgtgtctccaggtgcccctcgaggagtcccctcctttctgcaaggaatgccagccacaccctctttgccactgtcctgtgggcccattgggtttggaaatgtgggcctcgctgaccaggcgagtcctgtgtgcaggctcctgagtgtccgcctgcacgcacagcaccgatcaggtggacagacgcctctcaggggaggaccctgatgcgcagctcccacctcccagtggcctccgtgatgacgccatggtgacttctgcagggactaaggctgtccatcccgtcctggtgcccagcccagagcctggtctgtggcaggccagcgaggaacaaaacccacccaccttaaacatggctgctccgcccacccagggccttccaaggcacagagtctttctgaccggcctgcagcagacataagaccagaagtctcgtgcctgggctgtgggctccccagggtaaagccaccagaagctgtgcaggtccagggtgtagtctgtcctcgccatgcttggagccctctggaaggccttgcgctcctctgggcctcacgtatctctcctgtcgaggagtctggggaccctccctcccctcgctgccatgagtggggtgtggtggaggggcctgggcctcagctcagaagccccagggctgggctggaatcctggctccaatcttggccactgggaagcactgggctctacttcagtctcctcacctgtatagtgggaacaccagcagtacccacctcatgggcccttggaacaggggactaatgggtggccctgggtgaagtggtgccacatggaggctccaggaaggccagcctgctataggaggtgctgacttggtggggctggggggtcttgatcccccattcaggtggctccaggacactcatctgccataatcctggggtcacctgaataaggtctctgctcatccctggaggctccttcaagaacactgtgctccttccaggactctgcccacagtgggtgggaggagccttcgcctcgagcctcagtctcctcacccatgacagggaatgcagcccgacgggaccacaggccttgcaggagggggtgataggccctgcataaagggggcagcgatgagacggcagcaatgagacacaagctcttcagccccaaggccatagcacccctgagagtgagctccttccggaagcttctcaggctccctgaagctgctggggaactagaagcgttcagtctgggtcacctagcatgacaccccgggaagcacagccccagctctgactccgagctctgggggcgagagggggctctcgcatcagcacgtggcagtccctcaatgtcgaacccagaagagtgaagaaaaaccaagagacaacagccggcctcggtcctgagcccgaccggccttcggcattgaccccagcagcgccccgtggtgtggctgctgctacgcgaccccccgggggatgcggaggccctggggctgctgagcaagctgccacgtggtgcctgccatgctggggtctgaggccccccacctgccgtggccccgacacacatagcacatcatgggacctgcggttcacagaggattgtactcccaggggctctgccgaccctacaaccaacccccaccacgaggggcggcaaggacaggatcagcccactttgtgaatgaagaagctgaggcccagggacgtgaagggcacacgggggctggactcctggccaggaggtaaggggcgggcagggtctctgcagacggaaaagatggaaaggcgttcccggctgaaggagcagcgctgcggaaacagcaaggcctggagaccctctaaggctgccagccccctcgagggctgcagccacagaaggcgggggtgggggtggcgggggcaaggacccagagagggcctggggtcaaaggtcatccatactctggcctcttcgcacacactgttccttcagtcagatgccgcccggccttgcccagctcccatgccctccaatctaaactaaaacgcagcgcccctcccaaatgctttctcagccatccctattccagagcaggaacaaagacgctgggaccagctcaagacacagacgtctggacagccttactggagacggtggggacttggaggccagggagggcgaggggccggggggacaaggaggggcggaggaggggaagctttggtccagcctggcagcctgaggtccagtcctactctgcctaccccgccgttaggcgagtccagccctgcaggagtgccctaagcactaaagagatttccccagcttgccagctttcaccccggagctcagcagatggctgtgactgcctatggtggggtctccggcagcttgcttcccgcaaagctccttccagggctcagggcttccttcggggtttcctgctacggtacgaactcactcgagcctcatcacacccatttcacaggtgggctcagagagacgcctgctggggcacacggctagacagcagcaggctgagctgagaatatgcccaccgggggtggggcggcagggctggaggtgccagggctgctccccaggtggggtgggaccgggagaagagacatcgatacccctgtggatgcctgaggtcaattagtcgaggaggaggcagaggaggaggaggcagaggaggaggaggctgttgcaagggccagattttgaaatgtagctgcaacaactgccctggtaaacttgattcaccccaccaggctgggagccaccttctcccggagcctccttctccagggagggctacagcccccagcccacttgaagcaggggtcccagccctcttcatctgtaaaatggggtggagagtttctttcttggggtgttgtgggttgaactgtgactccccaaattcaaactgaagtccttagaatgtgaccttatttggagggagtctccacagaggtaatcaagttgaataaggtcgttggagtggccctaatccaatgtgactgtgtccttggaaaaagggagatttggagacagatgtgccacatgaaggagaggatggccctctgcaagccaaggaggcaggcctggaacggacccttccctctggccctcggaagaacccagcctgctgacaccttgatttcagacttctggcctccggagctgtgaggcaataaatgcctgttgtttcagccgcccagcgagtggaactttgttctggcagccccggcaggtgacagggggttgttaaggttgtttagatgtgtgcgaggcacggagcgacgcccagaagacgagggcctccggtgagtgtgagtgattcctaaacacggcacacagccaacaaaacaagacaacaccaagaccgggtgtgaggtgggcgggaaaagcaggacttgtagttgacctctgggtcctggggatgggggcgggcaccaggcatcatgatgggtaggagcacagctgaaggccggggccctcgggggacacacttagcccccctgtgcttcggtttcccccttggccaatagcacccacccaaggggttggaggattacctaaggcaggggttggccaactctttcgggaagggcccagggagtaaatcttttctcctttgcgggctgtgaggtctgtgttgtaagactcacttctgcagctgcagtttgcacgcagccttacagcagatgtaaaggagtgggtgtggctgagttcccaggaaacttgattcgtggacactgaaagcagaacttcatgtaatattcttgttctttggtttttgttttgtttgtttgtcttttgagacagggtctcgctctgtcacccaggctgggatgcagtggcaccatcttggctcactgcagcctccacttctcaggttcaagcaatcctcccacctcagcctccttggtagctgggattacaggctcacatcaccacgcccagctaatttttgtatttttagtagagacggggtttcaccatgttggccaggctggtcttgaactcctgacttcaggtgatctgcctgcctcagtctcccaaactactgggattacaggtgtgagccactgcacctggccccttctttagttttcttttcaaccatttaaaaatgtaaaaaccattttagcttgcagtcctacagaaacaggtggctggccagctttggtctgaaagccagccctgccctaagtgaaggagccctctcagcactaagaggcgccgggccagacctgcttatcgatcacctttgggcccagtgtggggctgctgctccggaaacaatttttctttttctttcaagattcaccagctctgttcaggagggtggccagcttggcgacctggacatttaatcctccagccaaagattcccttctgtgcggcagccctgagggggctgtctagatgacctcacttgagctgagtgactgcctgggatgtgggtcccgtgaatggggcacctgtttcacagatgagcaaactgatgctccgaggcaagttactcaatcccctgaccccggcacggtgccccgcctcttggagcccaagccagcggggctgaggcaggggctgctgggggtggacaggggaggtgggcttgggagcactgaagaaagggtgacactccaggcatctgtgaaagcccagaagacatccctagacaaaggaggaaacagggttagggaagggcactcctagagaaggagcagcttgcagaggcccagtagtggcaccacaggggcagctggaagatgtggcaccacgggggcagctggaagatgtggcaccacggggcagctggaaagtggggttggtgggcagaggtgagactgagtcctgggagaagtccacaccggacatgggagactttcccctgacctgatgggctttatttaagcaaggaagggactggtgtgaattagattggagacactccctctgtcggcacagagacagcactctccactagaaatctcatgccagcctcgtgaataatttctaattttctatcagccacgttaggaaaacggaaaaagaatttgatgcaaattattttagtaatatattttatggaacctaatatatccaatatattatttaaacgtgtcattcatataacaaattatgaatgagatatttcacagtctgtctcatactaggtggggacatattccacgcttaccgtacaactcaattcggactggctgcacctcatgtactcagaagacaggctgcagtcttgtatgacatcttggatgagactcaggccgcagtcttggatgacacatacgtggacatcgggctgtggtggccggagtagagtcagagaggctggaaggaggcccttttccagggcaggaatgatggtgcctggcctggagctgtggtggggttcctggccctccattcagctgccagcccatcccagcttgcaccggagggaagcagcgggcctgggctctgcggcatcccaggggggcaggtcacagggcagctaccctaccccagcctcctccctgaccccgccggtgtctgcccagacagccggcatccccatcccgctgggctggctcccggccctgccctacccccaactccagactcatgtcaggcttcctgtcccagccggagggtgacccgaggcctgaccccagaggcccaggcgatgggcccggaaggaaggccgcctccttgatgcagccacagcaggcggggctggggcttccccatggactccctcgggaagcacttcacactttggtgggcgctcagccagggcggcccccagcagcggcaggaggcgagggcctctggggcagggaggacatgcacctgcgcctgggcctgtgaggggctcccccaccacagcgtggggtctctgggcatgccagggttgcccccactagacagccagggttctcagggaacacagagcaggcaagcaggccggcttctgcttcagcctcagcccctgtccgcacctggggcagcacaggacaggtttaggaacagaccctagctgcacgcctggtgaggaccttcacctctgggcctcccgctgctcctctgtgaaaatggaggtatcggggtgttcgtcccttctagggccagagagagatggcagcgaatgcacgtggtccctaaaggagagccgtccgtggccacgtaggaaagtgtcaggcccagctcctcattcctgggatgtggccttttctcacctgcgctgaactctgctctcaggactcaaaccctgagctgctgtggaggctaactcactcatgctccaggcccatcttctgaataagtttcccagaccctccaacctgccctccgtgtcggccctggggtgcctgcctctccttccctcttcctcttcttctcacaaatatgggccgagctcatgtgatacgtcaggcactatgctaggacgtgggggtccagctggaagggacaggacagaaccctgccctcctggagctggcagtctgtagcagacactaatcagttaaacagatcacaaactgtgactgtctccagcagagacacctggttggccttgggggagcacatagcagatggatgggggtccctgcccagggctgccggcaggcggtgcaccttgcactgctcacttagtcccacagcctcgcttgcccgcaggcagtgtgtcctctgcacactttcagggctccgtccttctgcccagcgcctctgcaggctacgccttctgtgctgggcctctgggcatagttactaggcagccagggctggggccagcccttggccttagctcagctccagggaggatcaagagggtgtccagtgtggccgtacacctgggcacctgcttcagaatccaggtccttgggaaacaagtggctttggtcttgccaatgcctttgctctgttttcagctgggaattaagctggggaacagcaggaggggcagcatttgctggccctggtgcaggaggttgtgggtgagaagagccgagttcaggtccccacctgggcagcctgtggtgtgagctagaggtgcagaagcctgcggggacacggagggcagccgggcaggagcctgcggggacacggagggcagccaggcaggaggctgcggggacgtggagggcagccgggcaggagcctgcagggatgcggagggcagcagggcaggctgggctttctccagtgcttgctcccctcccaagggagttcctaatttgggtccccctgctcttccttggttgagtgggccccacgcacttggctatgatccagcagactcctgcgtcctggtgtgtccctgccccaccttcccactgccctcggcctctctcccagcccctgggagctgggttttttgcttccaatttcaaatacatcagactccatcccactgtcctatcccaaggtgtcttttgcctttctgggaaaataaagtggcaggggagtgaacccaccgcaatgggacagccctcctcctgtcctccgcgggagcagcatctcgcaggggctccgccaagccttcgaggcccagccaaagctggggtgggggcactggccggaagcttaggggagggggagcctgcaggacttcactcctgtgcccgtgtggccgggggtacctgcttgacctctgagctgtcaccgggaatagtgtccagcctgcctgcctgctgggacctctgcagagaccatgagctcagtcctcagggcctaggtcctgggttaacactgagggctgtgcggccaaggaccccggggtgggcatgaccggggtgtgtggaggaaggaagggggtctgggaaaggatgcagacaagaggtgggtgctgggccagcacctgcttctgttcttggcctcaggaccgtctatggaattgggagtaattctctgcaacatgggccctgcagccgaggtctgggcagaggcgtcagggcacagagcagtggtaccaccatgccagggagatgctcaggccaggaccaagcagaaaggggagctcaccataaactccctggggggaggggagcgctttacccccacaagaatgggcagcaacaggtcatctatcctcagggcccataaccccttcacctgcttcctggtgacctgctgccgggaagggccctgggcctcagggcctttgtggggcttcctgtacccccctgaatgctgtcactgtgcctgaaacctcaccagtggggcctcatttctttggtcctataacactccttgattttccagcgttaagcacacagtcatgagctgttgcctgaagctgacacttactgagggtgttctgtgcagcaggctttgtcctgagccttttgatttttttttttacatgtcttgtttatgcaggataaatcccagtaacccatttgcagaaaaggaagcagcagctcagagaggttaggtaggttgcctaaggtcacccaacttgtggcagaagcaggatggagccctgcctatgtgatgatggggccaggagcaccctgatcatctttagagcccacccctaacccaggtgggggcagcaggtccctgtaagcatgctggatgaaaccaggcggctgacagaacgggagggaggctgcccttgggcttccgcatttctggattcgagctctgctcagtcacaatgggctgtgtgcccttgagcaagttacttcacctctctgagcctcagtgtcctcttatcaaatgggatactaagatataattcaaaaatatgttcttgagaattcaatgggaagatcctgccggagtctggagcctgtctatttagtttgacaataaataattgggctagtatttacactgatctctagtaaggggggcacagagcagggaagggtgtgccgggagggctgaagtgtgcccctgggcatcggggcgactgtgccagcacccgcctctaggtttacagcccttcctgagaactagaaaaatcccctcctctgagcagatgccatccttggactcatgggcttggcacctggtttggccccacagaagagactcctacccagttctcttttctagcccagaagaatggcatttctggaccatctggaacatctggatcatctcccctgctgatgcacaaacagccaggcctccggagaaggggggtgggacagggtgttgcaggcagagggaacggcccctgcaaaggatcatcagggagactgagcaggtcaggatggctgccggaacaagcagcgtctcagtggacctgtggagggcaggggatgagcaggtgaaggaggagatgggtggagagcgtgtacctggggcaggcctggaggcgggagggaggggctggagccagagaaaggggcggctggtggagggaggtgaggctggaggggctgggcctggtactttggatgaagccaggtcactgcaaagatgaaatgtgatagcactgggcaaaggaagcaaagcccatcaccatgagaccagctcccaatccttccctggaattcatttaggaaaagatctagagaagtcaaggtggggcccggaggggatgggatcagggtccgtgggaagcaagttcatgtctttgcaccgaggatggacaggagtgtggagtgtgggagggaagaggaggaggaagcagccgaggggagctggaggggaggggtgagaggaggggctggaggaaagcctggggttgtgtgcagggacccacagaggactcaggtgagtgagaccgcaggcaggccgtgaacagccccaatcccacgacagaggcagccaaaccctttcccaaagatgttttatagagacctggcggggcagggggggactttggtctttttcagacacagaagttccttctgtgactgagggtaagtgtcttagcctcctgcctcagtttcctcattgcataacaggactgtttcagtgtccacactcagagtgtgagggctagatgaggaaatgcacgtgcagtaggatgccacctgtctttggaatgtctgcatgtcaggtgccccagccctcaggatccaggacaggtctggctgcggtgggtgctggatggatgctgaggaggggagggacagtcactgcataccagcctctgccaaaatggggagcccaggggcaggagtagacaggaaggacttcctggaggaggagggctggcagtttgggaagatttagatggggagaaagtggggcaagggcatgggggtgggaagtctgggaaaagatgtcctggcagggtggaggggaacggaagttacgatggtagtggggaaaagcatctgcccaggagccaatggtgcaaacacagtgtgtgtgtgtgtgtgtgtatgcacacccgtgtgcacaagcacctccaccgctttcccagcctcctagccagagccctggggctcagctcaggcccttacccccagccccacccgaccacaggcttcacaaccagaggccaagaccccggcaaatgcacatcccctcgtccctctctgtcccagccccactgctctcccagagcctgctgccatcccctctctgtcctccaggccttgggtcctccacaccctcctgctgccacctggatgccccaacctcccgtggactgttggggtctcccaggggcccccgcacttctgtctgtatggctcttgtccactctgcccggctgacacctccggccacccgagactgctcgaatgcccagcaccccacacagctggcacctcctctgcagaccgcagcctgggagagaggggaacccacgggcctgtgagtctttcagatcctggtaaacagtaggagcacgggaaatattctggagagaaatcgccgccctcagctccagtcccttgttccagcctcctgctgggtgcccggggggagcggacgtgatgcagctctccacccagtacctggtacccagctccgtgcggagcacgggggccagccctgaggactcctactgacctgcaggttcgcggtccagagacggggcagctcacaggcaggggacgcagctctgacatcctcaggtgttggagctggggccaggaggtcatggagctgcaatcccaactcaaggactggttgagcactggcactgcccaataaaggcccctggttgagactgtgggtagggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaatgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgattgaggccagggctcaacgtgtatcaggagtgaccagggccagggctcagattgtgattgaggtcagggctcaatgtgtatcaggagtgaccagggtcagggctcaggaggtaagggagctcagggtgctctctgaagttaggcctcttagtgaccatcttcagctggatcttgctggaccagaagccagagctttgaccccacaggtgtgccctacctgggccctggaggggcaggtcagtctttcttgagtgccatcctttcacccatgttttaagcctcctgttgacaaggatctggacacaggattacattccaagtccttgctcaaagcctgagccgtctccaccccatcagccacgttggttgtgtccctgacccggacccggcctcccctgcagaccctcggggctccctccctaatcccacccttctgcacgcacctgggccaggacatgggcagtcacagctgacagattgtttaggggatcaggaagccggtgggtgtgcagcagatgcctgtgtggacatgcacacatgcacactcatgcccgcttccaggcaggaagaccggaggctgcacgtgggcagcggcgggtggtggtagtccttgaccagggtgtgagtccagtttgtcttcaacctggtgctgggaagtggggttggggagggtgtgaggcatcctggggtccttggtgggttagactcctgaaacccagcaggtttcttgtgtctctgagcctcagtttccccttcccatagcttgggaagaagagactggcatctccccagggttcctatgtgggtgacacagatcaacgtgtcaatggtttcctcactgtccctatctgaccgcatggccctgcctgtctctcctcctccctggagcccatgtttgggacttccacatttggtccctgagccttcatggagtagctcctctgtggggaaccctggaccaggtgcagcagggagtcgggagagagcagatggactccctgcactgatggggctcacggggccctgggagagagtatcaacttggatggtgacgatccagcagggccacagctgaatggaggtgaggacgagggcccacggggcttggggcacagtggctgcctctgctcagagacagcttcccagaccacacggcggcccagctgtgtgtgggaggcataggagctctcctgaggaaaggcatgggaaacagagggaatagcaagtgcgaagacctggtatggaagtaagaagtgaccggagtgttgcttgggggtggtgagcaggaggcaatgcatcaggcaggcggaaccctgcccctcccaggctgaccccagccagacggggaaggacctgggtccctgctgtgggtggtgagtcccatacatgtccctgcccaccctgtcatcctgcagggagcaaactgatcccagagggggtgcccagcccacgccgtgcagcaccgcagggggaacccagcgtgatagagagcagtgtcttagacctggctccagcgccgaggctgcggcccaatcgaggccgggtccttcccctcgagacttcagcctcggctctcctggacttcagggtgacatcaccagggtgttgggggtcttctgtgatcctcctacgaatacttctttttttttctttttagagacaggatcttgctctgttgcccaggctggagtgcggtggcatgatcacagctcactgctgcctcaacatcctgggctccagcaatcctcccgcctcagcctgctgagtagctggtactacaggggtgtaccactaggcctggctaatttttaaaaattatttatagagacaaagtctcctatgttgcccaggttggtcttgaactcctaggctcaagcaatcgtcccgcctcaggcccctgagtagctgggtctatgggtgggcaccactatgcctggctaatttatttacttatttttgtagagacggggtctcactatgtttctcaggctaatcttgaactcctgggctcaagtgatctgcctgcctcagcctcccaaagcactgggattacatgtgtcaaccaccgtgccctacccacttctgttttattattgttattattatttaagatgggatctcgctgtgtcacccaggctggagtgcagtggcacgatctcagctcactgcaacctccacctcccaggttcaagagattctcctgcctcagcctcctgagtagctgggactacaggtgtgcgcctccacgcccagctaattttttgtatttttagtagagacagggtttcaccatgttggccaggctggttttgaactcctgaccttgagtgatccgcccaccgtggcctcccaaagtgctagaattacaggcatgagccaccgtgcctagcctgttttttttttattatttttaaaattttatttatttatttatcgagacagggtcttgctctgtcgcccaggctggagtgcagtggtgcaatctcagcccactgcaacctctgcctcctgggttcaagcaattctccagcctcagcctcccaaatagctgggattacaggtgccggccaccacgcccggctaatttttgtatttttagtagagacagggtttcactatgttggccaggctggtcttgaactcctgacctcaagtgatctgcccgccttggcttcccaaagtgctggggttacaggtgtgagccactcctggcctcacttctatttttcaaaccgagggtgatgcttaacccaagagtaggtgctgtcaggccgaaacatctgttctggtccttggctggctttcccaaggccctgagtgtcctagggccttgtgacttcctctgtgaactggaaaacagcccccaactccagtccctgcctggctaggcttgcctgagcagagcagaggtgagaggcaggaaagatccagcagcctcagagctgtgaacggtgccagccccgtgattgacatgtcagccgcactaatagtatcgcttcatctctccagactctccctttcccggtttgtccactgttctgtttggaaataaggttgtgcccttagtcataccttgataagaagggagacgcccctgcctgccctctctcttctgttccacctcctctgccgaacgttcaggagctcctcattcaaaagaccgtcagatgaaatgtttgctagagataacactgtgaagcatttagaaacaccttgcaccagcctacttcttaaatacttgttaaaaacgagatcacaccccaaatagagtttcatagaatataccttttttatttttcattattttttgagatggagtctcactctgttgcccaagctggagtgcagtggcgcaatctcagctcactgcaacctctgcctccagatttcaagtgattctcctgcctcagcctcccaagtagctggaattacacgcatgtgccaccacacctggctaatttttgtatttttagtaaagacatgttttcaccatgttggtcaggctggtcttgaactcctgacctcaagtgatctgcccaccttggcctcccaaagtgctaggattacaagcatgagccaccgtgcctggcctcttttttaaatccagtttttattcagcagaatgttccgaaagatccagagggtaacatgtgggcaaagtccctgagccctggctggggtggcctgggtggggttgccttcctccgacacccaactcatgtgggccctgggcgcccagcaccgggttccttccccccaaacccatctcatctggactctgggcacccagcgccgggttccttcccccaggccttgagcctggctttgcagctcctgctgccccagggcaggtggtggtggccgcccagccctcacccagccccgagtcctgtgtggaaggcgattcctcccactttaccggggaggacacagaggctgagcgtggtcacggccggagccccagcgcagcatctgagctgcaggctggccgccccccaccccgctgcacccccatattccactcacagaccttcttcctgctgaacacagctgggccctgacgcctctgtgccttggccacaaggcaccttctgctcactcagctgtccctccagtccccgtagggctgcagacccaggcccacccagtcacaggcctggcagcgagggggaacaaaagggtcaaggggccgcccagggctgggaagggccttgctccacctcgctctcctccattccccgtgtgggcctccgtctcccattctgtgaaatgacccgtttgggccacagggtccccaagtcctcttggcttggggccgtctgttccaagaggaggggccatattggtccttgaggcccctgcggcccagtaagtctgcagtgaggcctccctggacgtatatatcaacaaaaagtcaaactccgtaaagtgtttgagacatttattctgagccaaagatgaatggccgggggcccatgacagccccaggagaccctcagaccatgtgttcaaggtggtcgggccacagctaggtttcatacattttagggggacacaaggcatcaatcaatacacataagctgtacattggttacgcctagaaaggcggaaccaccggaagcggggatgcttccaggtcataggtggattcgaagattttctgattggccgttggttgaaagagttattgtcggtagataggaatgtctgggttaagataatgggttgtgcagaccgaggtttcatcatgcagatgaagcctccaggcagcagactgcagagagaatggatgggagatgtttattatcagactgaaagactgttctgccagtcattccaaaagggaggggggataacaaggtatgtccgtctcccgcttcccaccgtggcctgaactcgcttttcaggttcactttggaatgtccttagccaagacgagggtccgttcgtttggctgggggtcttaggattgattttctggtttccatatgcaatgggagtgggggagagatggggtgggggcagcctgaggctcagccctggccaaggaagccccctccaggcattggccaggttctgactcctacagtgttacagccggcagggaacttggacccacaagctcctcccctccccaagcctcagtttccttgtttgtaagatgatgcctggggtccttgcttccttgtagggctcaaacaagatcccaggctctattaggaacagtgccaaggcagggggcccccaacagctcaagcaggctggagtttggtgctcacggagtaggggaagctggtggcttctcaggctcatgacattgtccctgcagggtgcagggctattccctggtggggctgggggtgtgtgtggccattggcaggagccccgatgttctcatccatgagtcagcagagatgggaacatcaatttatttgagtggctggtgcagccgagtccttggaggacaaggagtttttgccaagcctgggccgaatgtgccagggcttggggcagggaaactgtgtccagggacacagcttcaagggcccctggttgatgtccccagggcctgctgagtgccaggccctgggactcagagaggacaccacccgatgcaggccctgggactcagagaggacaccaccggatggagctgcccaaagggagtgccagtcggatgtgggggtgggggaagaggagggaccaggatgtgacgggtccgaggtctcacggggtgcccaggtgggctggatttacagagcatgggcggcctgcaggaccatgaaggggcaatgggggcagaagacagaggttggaggcagggtggcatggagggtctcggggcaggggcaggagggtctccagggtggtcagtctgctgcagtcagcagagggcactggaggggcctgggctcaggctccaggtagagctgacctagcccagaatgggcaggtgagggaaggccaccgcctggtgggcttggctgtcccctcacctggaccccatcgccggcctcttccttgcacggggtagatgctcattgatgtggtgacgtctagcaggaggatggccctgggcagggctgtgagctgggagacctgggctgggatctcagctttgggcccacacactgggatggaggagtgtttactgctgtctctgaatggctgcaggaaggctgagggggcacatggttgatgggccaggccactctgggcacagttgctgagagtcggctcttcctaagtgggggcacccggggtggtggaagggagtcagatgccaattcccaatgggtcctggtggtcgtgccctgctgcagggccttggcacccgccgccatagccatggagtccaggggggcccccaggggctggaaaggcagggaaacagattctccttgggagcctccaaggaagccagccctggctagcacgtctgtgctctgtctctggctttgcctgttctggacatctctggaggtgtgagcaccatgtggcctttcgtgtctggcttctttcacttagcacggtggcttcaggtccctccgcattatcgcatgtgccagtgctttgctcctttttacacctgagtaatcgtccactgtggagtcatcctttcagctgctgagagatgcgtgggcagtttccacctgcagccatcgtgagtagtcgggtgaggctgctgaagcagacgagtgagggcactgcccgggccatttgggctggagcgggggtttgaactcctctttgtgggacggaggctgtgttcttgcccacacctctccctgctccaggcctgtcttccccttgggactgggactatgacttggtggcttcagcctccgcagggtgagcctgatcctgagagtcaggctgggctgaggaggacgggtgggcctcctgggggaggtgacgacttcggactggaccttgcaggagggatgggctgtctgaggatgggagatgggaggaggtattgcaggttgggcagcaggtgaggctgagctgggaagggaggtggttgaggctggttcttgggctgagtgctggggaggggtcggccggggatcaccgagaggtccctccaggctgcatgagcagaggagacaccctacgggtgatcttcttgcctttgtttctagaattcacaaatcctacaattctaagctctcagaacccttggatctgaaggttctcaaatgctaaggtttctagatgttagcagacgaaggtgtcaagacgcatgggatctacgatgcagagttctgagtggggatatgcgtcccccaccccgactcaccccacgacacatatcagtaacagcctctgcaactccgccttggtgcccccgcacgttccaggggcagccacactgatggattgctcagaacgggctggaggtgagatgtgtttgcccggagcccccacacactgtcgtctccagctgtgcctgtccctccccaccttccactctgtgtctcttccctgccccccttgtgccccagccccagccccccctgttctttcctgccacccaatcctgtgccccacgacaaggaggctgagcccagggatggccaggaaggaacccccggcaggctctcagggtgggagagaggttgtggggatcaggggctttgcagaagggacagggaggcagcccagagcaccccagcttcttggccagcagcaggtaacctggctggagggcggggcccccatgggccatccctgggccagctgcccagggctaccaggaaggcagcttgttttgtaggaggtcaggcagcgccctaaccccacctcttgtcttccctgatgtcacaccccagggtcagccccttgggccagaatgggggtgatggtgggaaccgggaagctgagagaacagggaggaggccgggtggggcacaccaggctgtggctgtggggatggggagattcctcgcctgggcaggccgggcagcagcggggcagtcctggggggtgtggtaaatgcttctgctctcttcccctgactacatgggagcctccgtcccacctcacctggaaaaggggcttggaactgggctgctcggccttgggcacaccaaacggggcccttggagccctgggcttcctggggtggctgggtccccaccctgcctctgatccatcctgagtctgcatttcttctccaggtgccccctgcccttggcctcccaccacggcctgggagtagatagtgggctggggcaggcccagcgctgtcctctgtgggaaaggaggactctgggcctggaaatagttgagtgtggacagaaataaccctgactggcctcaaaacagaacatggaaaattaaatagggaacattagcattcaccccgcgcttgccacagccactgtcccatttgggaggcgggcgcgcttatcctcatttagagacagggaaactgcggcccagagaggggaggtgaccttcctgaggttcctctgccagccggccaggccctgtgacccctgtgcctctgtgcttccactacacagccgcatctccacttctgccccgacagttcctgctgcagcagatgcccttccagatgcaaactcctacgcatccttcaaaacccagctaaatgtcacttcctccggaaagccttccccacctctctagcaggcagttgagcccagcttacatttccgacaggccctcactgcccgggattgcagctgcgggctccttgagggcagggattgtccctcattcatcctgattccatgccaaggcttatagtaggtgctcaataaatgcttgctgaatgatagatgggctgtgtgtggtgctaagttgaatgccttgtccctttcccacaatttcatctcaaccacccaagaatttagcgtgagtatggctgttttactaaggagcaaacaggcttacagaggtgaactcacctgctccaaggtcacacaacagtcaagggctggacctgggatttggtcccagccccgcaaacacagccccactacgtacctagcatgggctcaggtaggccctaggggtgggcagtgtatctgaccactcgtcctgtccaccttcccctgcacctgtggccccacggacccctgggctggctctcaggtgtggcatctccaccttcccccacaggcccagaacccaccctgctgggccagcatcgtctcccaagggctcccacacagacacagtgggagccccttccctcaggctggcccccaacttgtccccttagaggggtcgttggtaagcactgtggcctgaggcttcctctgtgagagacttgtgggggtcatgccacaggggaagagggaagtgaatggatagaaggttctagaactattagctattgcagggacaagatatgaagaaaggatttcaaatcctggtttaaagaatcagccaggcacagtggctcatgcctataattatagcactttaggaggctgaggcaggaggatcccttgaacccaggaattggagaccagcctgggcaacatgttgagaccccatttctactaaaagtaaaaaaaaaaaaaaaaaaaaaaaaaaagatctgactatggttccatgtgcctgtagtcccagctactgtgggcattggggtgagggtggctgtcgcttgagcccaggaggtcaaggctgcagtgagctgtgattgcaccactgcactccagcctgggcgacagagcaagaccctgcctcaaaactaaaaacaaacaaaaagaatcaaggttctggggttctggagttgtttccatctttccggcctcccgcagtccagcaaaggcctatgggtgaggcagagcaagtgctggagaaggtggcagcaggtggcctgcgggccagtggacaggaaggaagtgagacagctggcaggcgactcggagcccgggagcgggagtgggctggaaagacccctggcctggccctgccttggctccccagagggtgtcagggcccagtggccacactgcccgctccctggggccccctgacaggagttcccaccgacctctccaggaatctggggcccgggccttgtgcccacctgccaggccagtccaccctcagctgaaccacagtggggcagatggatacacaggcaggggcgtggcccagctgtcgggccagggtctactggacactgtcactgtctccctctgtccctacaggtggggcctgtcccctctgcctgacccaaggggccagagaccgccgagtgacacacacccaagcactctctcccttgccaccggctttggggcaggtgccagtgatctggttggcaatgctcaggactgcctgtcaggacatctgagccctcaggctggtttctcactcctgcccacacagcggtctcggctgccaggctgtgtgactcggggtggggggctctgacctctctgggctcacaggtgatgaatgaggtttttaacctgaggaccatggatggccgtgggggctcttggctcccccgacaagtgcaagtgcagcctgtcatccagaaggagaggcagctccccagctgccccctgacccctacacagctgcccagccccagccccactgctcttcgctggggtgactccagacagggcattttctgtctccctgcatgctccccacccatctctacaacagggaaaacagtttcgctctgcaaggcagcacaccacctcgggacctggagagaaggcgaaggtgaggagtgggctctgccccgagctgtgtgccccgggcagagtgagggctcacttcgctgagcctcagcctccttctgcttgggaggagggcattataagaacccctcctgtccgggtatacagaggagggaggagctagcctgcctgtgcgtggagggtggagggtggagggtggagggcacttgtacccgactccatctgcactccatctgcaaggctggcatggggcaggcacacagtgaagacgccctcacttgtccccaagttgggaaggcaaaggaacctgcaaggccactcaggtaaggaggagtgcagacattctctcgaggctgtgacccctgagcacaagccctcccctaggtggggaaagagacctagagggaggggcagtctggaacgaggtccagtctgagaacctctcccaggccggtcaggaagtcacagatcctctgagcattcttccaggattgctcagctctggggacgacgcctggagagacaggcggcagaggaaggtcggagggtcctggtgcctctgcagcagctcccaggccagcagcgccacctggtggtcatatgccccaggcacttcaatcctgccggcattcccagcggatcagtggaggggctggggccagctggaggggctcgcccaggctgggctggggcccagaatgtgcccccttagctctgcccacccctatgtgtgtgcaagttccagggaaagcccagagaaaatagggttggccccaggggaatgagccccattggaggggtcggccactgtgatcatggtgcatggatgtaagtgtgtgtatggggaggcagacgttttgttgggagtgagaccctcagttatacctggcacagggtgggtagataaactgttgattgaattaatgaatgaacgtgctggggactgtccagaggacagccctgctcctttcattagctcagttcaatcactgattgagtgccaaacaccatgggaggacacacacacacacacacacacacacaccaaaagaagagacagggttcacatacacacacacatacacatactcacatacacacacatacagactcacatacacacacagactcacatacacacacacatacacatacatacacacacatacagactcacatacacacacacacagactcacatacacagacacacacagacttacatacacacagacacacacacacatacagactcacatatacacagactcacatacacagagactcacatacacacagacacacacacactcaaatacacagactcacatactcacagacacacacagactcaaatacacacacagactcacatacacacacactcatacacacacatacagactcacatacacatagacacacacagattcacatacacacacagacacacacacacagacacacacagactcacacacacacacagactcacatacacacacatatacatacacacacagactcacatacacacacacactcacatacacagacacacacagacttacatacacacagacacacacacatacagactcacatatacacagactcacatacacagagactcacatacacacagacacacacagactcaaatacacacacagactcacatacacacacactcatacacacacatacagactcacatacacatagacacacacagattcacatacacacacagacacacacacagacacacacagacacacacagactcacacacacacacagactcatgtacacacagactcatgcacatatacatatacataggtacatacacacactcacaaatgtaaatacatgtacacacacatatacagactcacatacacacatacacacatgtacgtatacatacaaacacaaacatacacacacgtgcatacacagacacacacagcgactcacgtacacacacgtacgtacacacacgcacatacacacatcacatatacaatacatacacagactcacaaacacacacacagactcacatgcatatacacatacatacacatgcacatacatacacaatgtacacacagactcgcatacatatacacgtacatacacacagatacgcagacacatatacaaccatgctccacataacatcgtttcagtcagtgatgggctgcgtatatgacagtggtcctgtcagattccaaatagctgaaaaatggctgttgcccagtgatgtcccagccatcgtaacactgtggcacagtgcgttaccttttctatgtgtggatttgtttagttgcacacatacttatcaccgtgttacagtcgcccacaggactcagtacagtaacacgcggtacaggtttgcagcctaggagcaaaggctacggtgtagagccgaggggtgctggaggccattccatctgggtttgtgtaaggacagtctgtgacggtcccctaatgaggaaatggtctaatgatgcatttctcagaatgtgtcttgtcagtgagtgacgcatgactgtacataggtacatggacacacacactcacacatgcacactgctgcagtttgcacgggtgcccctaggttcacatgtcagaaactcgatcaccagtgtgacagtgttgggatgaggggccactgggaggtgtttgagtcatgcgggcaccaccctcatgaatggattaatacgttatctcaggaatggttctttttcccccaaagcaacaaaaggtaaaagcagggaatggttcatcatcctgggagtgggttccttgggaaaggacaagtttggcacactctctgtctctgtctgtctctctatctgtctcgccttcaccacatggggcccctccatcttggacttcccagcctccagaatttgttgagccaattaattcctagtcattaggaattagccagtttgtggtgttctgcacatgtggttatagcaacagaaagtagactgagacacacacacacacacacacacacacacacacacacattcctgcatgtacacatgaatgcctgcgtacatgtagacacacagacacgcaggcatgcataacatgtgcctacacacagatccacacacactcacttaattctcgcaaccttgccttaaggcagagggtgtccgcaatctccccttgacagaggaggaaactgaggcttaggaaagacacgtaacttgctgaggggctagtgtgatacaggggcctggcggctgggccatcctgttacctgggctgtattctggagggcctgctctgggttgggctgtggcagcctctctgtgatctcccgagttagggttctgggagctccccaaaacccttccatagctttgttctggagaggatggttgaggtgggggattcagactcctggacctcaaccctgcacccccaccaggccactaagaggggcacccgtgggggtgagtggaggaccctgaccccaggccactggtaccgcctggatgcctgcagtacacaggggatccgatgtccttcagcccccaggctggccccgatgtgaagtctgatgggtgttgggcccccgtgctgcccccttcccccacaggtagctcatttgctgagtttccaagcagaatagtttgtaaaatgtgcaatgcatttgggaggggatgagcctctcatggacagtagggcaggtaccaggagagtggtggccccagccctcccagtcccctgggagccccacccaggcacaccaggttcagatggtcagtgcctgttcccccaggaactcttggtggctgaagatgcctgtggactcccattatgtaaaacaccgaggattcccaaaacccagtgatgctataatgtcattgaaatagtgagcacatagatgatgtggcatttcccgactggcccttggggtcaagtggtagtccgaagggcagctctcaccgggtggtcagacagcacgctggacacccaggggcccctcgatgctgtgacacgccagggaggcacccgggtccctgatgttccagtgcaggacaagtgacagcccacctggcccactcctccccccaggttcatgccccacccccactccatctcagcagagtgtcccgaggcctccctgggttgtggtgccgggcgagttcccctctctgtccaggactcccacgctggtgccctgggaagctggggggctgtaggagaaggacagactcagagcctggggctggcttataaacacaagagcttttcccacgtcagcccttggcgtcaacttgtgagggcgtccccatgcaggcgtgataggcagaggctgtgctgagggccggggcagcagaggaggtgggcagggcccagaggcactgggtgggtgcctcgcacaccagggctagggaaccatttgttctaagctctggattacagatggggaaactgaggcccagagaggggcagggacatggctgaggtctcgggggacccctgagcagccaggcctccgctgcctcccttgggcgggtgtgaggggcacctgcggtttggtgttaggctcccacctacaggggcaaagcccaggctcagaggtgacctggaatcagcgaatcaggggccgagctggactaggcaggagggtgtgtggttgcagcaggtgagctcatctgtaaaacgggggtgcgacacccctggccctgccagcctgtccaggtctgcgcggcacttggcgctcccagcaccacaccctccaggagaggcccagctgggagtcatctggaagaagtccctcctggcccaggtgggcaaagagaggaccaggagggaatgacgtcgagcacctcttcctcattggagccctcctgggtgaccccgtcctgtgcccaacacgtgactgttctccctggggctggccacgtgggggtaggatctgagcacccctgcagctgagccacgagagcacaggactccccagggctctgcagggggcctggcctcagctccagctgagttctggagaggtgctgcaggggagagttaggtagacacacctggaggcccagaactagccgagggatggtgaaggggtcatccgtgctgagtccttgagggctcagtgaggcccgaggaaaggtggggcagggtccagtctggagggtgaggctgggccttgtggcctgtcctggggtgggggtggggaggaatcagtttcaagaggcagccccaggaagagtaggggcagaggagggggtgggacttgacaagcggaaggccctggctggggctgggcacaggctgctgggccagtggggcgggggccaggagtcatggagcaggtggtccgaggagatggggtgagggaccatccagggggagggaatggcaggggacaggactgggagcaggagagtgtggtctcatgggcggagccacttccccaggcctgtcctggccctccagccgcagcccctcccctcggcccctctatctcctcccacctttcctactcacccctccactccctcctgcacctgggcccgcccctccacagccagagacgttctgcagacgctgagcttgactgccccctctccctggcccacagctttctggtggggggtcaggatgtagggggtggccttgaccctggagtcaggcagggctgggaggggaattccagctcctttttgaggtggcgcctgggaacgctgggttggtcccatgatgtctctaagcctcagttttctccgctgtgaattgggtgcacagaccccttcgggtgggggcccagctctggagggtgggcggatgtggccacgtgggtcccctctcatcccgtgaggggtggggagcacagagcgctgggctgcagaggccctgaaggagagaggaggggctgtgtgtgaagaggcagggaggctggagtcagaactgctaagccaggtggcaagcagggtgtgcgggtgtggagatagggggtgtccagctccaatagggcacacggtgggggtctccagcgcagatagtgcacccccaccccgctccatgccttcaggcctccaggaagctggggcaggcacccaggcgacatttcctgctattaatggagctttaatctaaacaggccctaatatttacatccagacgcctccggctgccgcgggtgccagactgtgggagtgatgagcccccagacagcgcctccccacccagagctctgctgggccagaccagagaccgagaactgggcacctgggggccctggtttgagccccctccctgaccacccccaaagcctaagtttctcctctaggaatggaggtggtcatctcaccctcccaggttcagtgaaggggccactcagtggcacttagtaggcccacagggaggccagtgctccctctccctggtgtgttggaccagctgtcctatcccctccctctccctctaggccatatctctgctgatatgataggactcagtggctgtgggtggtctggctgcctcgcccacctccacgtccttgccctgggtaggcaggttcgggatcagggatggagcgccttgttctgctggtccatgccccccacccagctgctgtgcccacaccctgctggcaagtcagccacttgtgccccctccatcccctgcccatcagagctgggcagggctcaaggcccctaaatctgcctcccagcagggatgacaaaaccacaaaaccactgccgctgcctccctgtggagccctgctggtccgcaggacacagagttggggcgtgcgtagggctgccaccctgctccataccctccgccagctccatgtcccccaccagcccaggaccagagtcgtgggcaagaatagaataaacagctttaattccagacgaggacatctcgtgaaggagattgtttacgtcggatataaatacacacaccatttcacgtcacttgggcgttttgaaaatctggaaagggagatcatggggagggggcgcaaagatctcacgccctgtccccgtgagtgtggagagggggcacgcacagatctcacctctgcccctgtgggaccaaggacagtcttggtctgacttttgaagctcctgggcctcggtgcccacagaggaggctgaagtgggaaggagccggccgtcaggagaaggaagcaagcagccgggggagctgtggggcccagtccagggcattggggtgacccccttccccagccccctgccctccagctgtaaggctgaggagaggagaaagaggagtggggtgtggagaaactgaggcttgcctatcaagggttctgcatcgggggctggcaggcagttctcagaggtctgagggtgggccccaagcctgtgtccctggccacagaagacaggcggcctgtcctctccagcatgagtggtagtggacgcacttgccgcttcggacaggatgtccttcccctcccggcctcttacagtctgagaagcctctgaggcccgaggaacccaagttgaatgattggatttcagatgtggggacaaggaggggacctggctcacctgccttagagacccctcctcctgaagaaagggattgttccagaaaaattgcaagccctgcctcttcaagcacagcaatcctcaagtgtcagccattcactctttagcgtgaattagagtgacaaccaggaatggagccaggctgggggtcattgatggggaggccaaaggcccgaggggcacgtaacaccggtggaggaggggcagggaagactggcggggaaggggccgggaagactggtaggggaggggaggggctgggaagctgcatggaaggcccttcactggccccagcgaggcgggcgcttggccttacctttgcccaggccattccccctcatcttagcactccttcccgctggcccctgcctccttgcagccctgggctggagaggtcttcacagtacagtgcgggaccaagggcagaggggtgtcatactctaggccacgtgcagagcttgcttgaggggcgggagtgggagccggcaggtagtctctggggcttggggcgccccctaagatggagcaagaggatccacagctcctggaggaatggagtccagagtccctggccctggatgacttgtgagcgtgggtggaggggtcccaggtaagcaaggccattcagggactgctgggccacatgagcctggaagaagctcatggcttgggctgggcaggacacctgagccctgacccctcactcctcagctctaggcatgtgaccacgtgggtgccagctcgcagccctgggaatgatggctcgctggctgttggtgcctgcttgcctgaaagtcgccgtgaatgctgcacctgtggtcagcggggtttttctgcatgcacagccctgtcccccagccacgtcctttcctgaacgctgggcccctctgccttgtggaaccctgcatccctggtaagccacggcccctctctgagcagcacccgagagctgggggctgggggaaggttccagaattgtgcctggtgcctggtaagtatcaagaatgctggcggccatggtgatacccactgcttctcgggcatccggacccagggaggaagtaaccctggcagcactcccagttccaccaccttgcggggcacgcctctgactcctctgggccggtgccccccaccccagctgctccacatggccacagctggggttggtgaggacaatactggccttggatgactcaggcactcactctatgaccttggcaagcccctttctccctctgagcctcagtttcttcatttgtaacatggggatataaagtccaggaccctaaactggggtcaggagactctgcctcgagctgaatcggggagccccggccttttcctcctcctccccctcctgctcccagccacacaggccacggtcaccctgagtgtgtaggacttctctgtagccaaaggcctggcctgaggacctgagcccatctcgcctgcttcagtggctatggccaggtctgatggcagggcctcagagccggaagtgccagggatgccccacactcctcttcctcaccacaggctcccttccccattaccagtcctgaaagggctgggagcttggacgctcggcagaaggcacgtgggaggaaatcctggagtccagctctgaggagatgatcagaggccccagccagagaaaagctccctccctagtgaaggcatggggactcatagtgagctgggccagagcagctggtcacgtcctctctgcccccggggggaggaaaatggctgtttgcatggggagatggtggccacaacccggcatgcctgggttcactgctgcgtgactttgttcttggttttcttatccataggatggggctgtgaacactgcctctacctggggcagcaggtgagccattctgaggccattcctagagtgggggctttgggatgatcgtgcactctctgtggaaggaggtgcaagggcactggaggaggtggggctggttttcattctgaccctgccatttcccagctgtggcccctgtgtgtgtcacttgacccctccagcaccaagaaatggatgaaaagtagcgtctcctttgtgggttgttgtgggttcaagtgtcaacctagatatcacagtgcttgctcacagcagagcggcctgtgggtgtctgccgttttatcgtgcaattcacggaggcctcaggtgggggggtcttgcagagacatgcacccccccccacctccattaatgcaacacgaatgctccctggccttttctttctgtccttgtccttcctcctgtgtgtgtgttggagggagcattgttgttgttagctctctcgggaattcaggttgtttcttaactctcttgggaattcccagcacctaaataatctttgtccttttttcttttttctttttcatctcatccttctaatcaatggaatccactgtgcccttttttctgaggaactccttctggagacaaactggccaaagtgaggagcagctcccggctacccctgtgagttttcagtggacgtgctataccccaggaacagcaaatcaccggcattcaggccaccacatcccatcggagccagtggcagacattgctaatcaaccacagcacagtggccttagacgctcaatgcggtgctctgggtagccatcaccaatcaatcgagatggaaccgattgccacccctggcatggtgggtgtccacgctggcatgcccagatgagtcctgaccttcggcccctggcagagccctgctgactaagcctcgggcccattagccagggcctgggtgagggcgtgagggccggcactgaggatgtgatgacggcctgagcccttggagctcctgtgcatgctgaccacgtcaccgctgctgggctcacgctctccgtgctggccgaagaggcctcggacggtggcctggaagccactggtgacgaagcagtagacgatggggtccatgcagctgttgaggctgctgagggtcacggccacgtggtagaccacgaggctcgtgtggtgtggcatgtcgggccacagcgccacggccacttggcgggcgtggaagggcgtgaagcagacgagaaagatgatgagcaccgtgagcaggagctgcatggcccgcacgcggcgctggcgaccctggtggagcagacccggccgcgacagtgcacacatgatgcggccggtaaacacgctgatgaccagcaggggcagcaggaactccaggacagtcagcgcaaagacacggcagcagggccggctgcctgtcacgcccagcaccgacagggtgacggcaccggcggccagccacacgaaggcgcacacggccctggcacaggcaggctggcggcagcggcgggagccttcgggccgcacgatggccaggtagcggtccacgcagatgcaggtgaggaagaggatggagcagtgcatgttgaggaagtaaccgaggacgtgcgggaaggcacagcgcaggcagcccctggcgccgtagtacacagcgaagcgcgtgggcagggacagccctaccagtagatcggtcaccaccaggttgatggtgtagatgactgagggtgtcttggcccgggtgcggcagcagaagacgtacagcgccagcccgttgagcaccagccctgccaggaagatggctccgtgcaccgccatcagcgccagccacaggcctgggaaggtgccatgcagctcctcgtccagccgggcaaacaggtggaacaggggcacctccagcccgctggcattggtccgcactgttgtcactgcggtggcattggggactgccccggccgagggccccgctggagacacagagggcatgacggcagccagcacaccccaggcctggaagcaaggagaccaggtcaccccaggcgccagcctggccttaagccctgccctgaggcccagaactcagctggcccgtctgcccctgcacgcccagcatcccccttctccatgccctcgcctggctggggcctcaaatgcctgctcccttggctctacccagagggagcctcggacagcagcagaaaaggcacaggctttcagagtcagacgcgtgttcaaattccaggactggcacttgccagcgtggagactcgacaaaatacggaggtttctgcgaccgtcctggcacgagggggaggcggaaacacgtgcggtgcagggctgtcctcgggatggagagctgataagggcaagaccacggggctccagtgtgcagttccagggcctggctccagccccagctgtgccactgactagtgtgcttgctcgggtaggccacttaacctctctacctgcttcctaatccatgtcactgggatcgcgttgctgctggggtgactaagcaagcgggtcagcacggcagcgccagcagagttggtggctgatgacccagttctgctgggacagagccttgttcatggtggggacctctgactgccctgcccactcccctgtccccacacccaccgtcatggcccccatcctccgggaccacccatctgttctcccctcctcctaggccagcatcaggtcaatgccctggatgggggtcctcatgagggacctttacaaagggaattaggctgtccagtggggctgcatgggagccaaggaccagtctcactgggcaccccaggctcctactggccctgagaggcgggcacccctatgatccccccaaactacagaaaaggagacagaggcccctgtggggtggctggttggggctgaagcctggagccagagtgtgagtcaaataaacaccgagctcccgtctggcctgggcaggggggccagggtggggggcgggcgaggggctgtgccggagccacccactctgtttatgttcctgccctggcgtgtttaactcggcagtgatttatccctctatttataaatgaagggttaacggccctacccccaccctacagctgggctgaccctccaaataagggcatttctggctttttcaggagaaaggagaagtctttggggccagcagggtggggaggctcgtgggccgtttcttctgcacagcgcccctcccccacctgctggagaagggaggacacttaccccttcccctcctggtggcccctgctgtaaacaggctgtgccccgccactccctctgaccagtgcgtggccccatcccacccctggggaacaatgagccctgccttcaaacagcccctggcctggctcagggcagcaaaagaactcttgctttcagagggccaggtccctccagtcggcggccaccttcttcctcagagtcagagaggtcagtgcctgcatgaggtcacccagcatgccctctgcctctgggaccccagccctgggtgcgtgctaccctggaggctgctgggaggagtcaagtgctgcccaggcctgtgcccagcccctcctgccacccccaccacacaagggcccaggctcagctcccagctccccccgactgcaagcaagctctctatctccaggccctgacacgcgggcattgatgggtgcatttgttggatgaataggtctgtcctccctcagcccaggtgtgccaccagagacgggatttgggggcacagcaggcagccaggggaggagaggaggctgggcacatgggggctgggaacctggcgtctcagggctgtgggcttcaggagccccagaaggtccccccgaaagagatgcgtccctcccctgctgtggatgaaacgctctcagaaaaggtcgaggcggctttgcagctggactgagggactgcatggccaaaaaagtattttgggattcctttctatgtgccttttgcttttccaatttgtctgcacggggcctatattagtgtcccaatcagagacaaatcataaacaacacagaacgtttcctgtgggagtgagtcccagggtgatgctggcccctgggaattctgctgtcccagaaaactccccagggccagcccagcaggctcaccagcaacgctgcggtgctggggtcctggctagggatgtgggggctctgcggtctctggagctggggggatgggcagaatgtgctggacaccccagaggccagaccggagaggagagggagctagcaaagcatgctctgattccccgcactaagggtctgaccctgatctcaaacaaagctgaaccctcatcttggtcacacactgagccatgatcccagtaatgtgatgaacctcgatccctgtcccactctgagccctgaccctggtcacacactgaccccaatcctaatagcacaatgggcgttgattcctgtggcgctctgagccctgatcccagccacgacctgggccctcagcccggaccttctgtccctgtctctgccctcctctcccagcttcgtctggctgtctctgtctccatattgtcaacccccacctgcctcccacagcgacggatgtcccgattcgattattacggggcctctctggggctcccactcaccaccctctttgttcagaaggaggaggaatgcaagcggggactctagaccctgcaggggcccatggaagtggctccctggcgagtgcctggggaaaggagaaggttccgcccctcctgggacagcctggctctgcctgtgggagaggcacagactctgctctccggagggcccgggtgatgagcagtcaccagcacagagacccgggtttgagtccagccctgccactccctcagctgagacctgggcctggtcagtaggctggccgtcctcatctgctgaatggggtcactcgtgccttccacagctctgcctcgccctggtagcctggactgaggggagaggcatggttttaccctcagagccggccggagaggggaggcagggccctgtccccaagcctagtttccctaagccaaacctgggtgtgggggagatggtcctgtctcctccctctttcctggcaggcaccctgggtctgtctgagacagcagactccatggcgggggccaactggccagagtctcatgggcagggactggcaccgtgtcctgatcgtgctgacatggtgttggggctcagggcctggaggctgtgccagggctgggaggtttctcttttccactggcccaggccagctctgctccccacccacacacaggtacttccttggggacagaacagagggaacgagggcctgctctccagggctgagagtcagtgagtggagacccagcagggtagggacctggagtgtggccatggagccctggctctggcctggatggccctgccaaagcctggctccatctctgaacggactatgtggccttacagtctctgagcctcagtttcctcatctgtagagtgggcaaaatagaatctcccctgggggttcttgtcctgatgtgccagcccagagtaggggctcagacacaggaagtgatgaaagtatgggacaagctgccagcgggggacccagagggcgagggggcgagctctgctccaacctgggtgtgcagcctagaccaggtccagctcccacactactcactgcccccgccagcctggagggagggctctgacctgggtgggtcctctctgagcctcagtgtctcctcctgtgaagtgggaatggccggacacgctgccctgcatggctgtcttgggccttggctgaacagagcacctgctgcaggtgtggcggggcaggggcaggtgtgctgcggcatctctttcttttctgtttctggcccacccttccgggtgggcagacccccagagcccccacccctccaggtgggcacacctcccagagccccggcctttcaaggcttcgctgagctcctccaggggagggggcagagggtgaaggaggatgtccctcatgccctccccgtaggtatcacatcacaaaacagccgtcctaggcggggctgccgctgggttgggggttctccctgggaggggcctgaggcctggactgctgggcagggctggggatgtgcctctccagtcactgcacctgactgatgcttctgcaggcgaaactactagcggggcctaaacactccatgcgccctccaggcccaaccccaagctgttcctgctctctccctttcggcttattcatgcccatttttaggacttccccctggacttgcctccttaaggaagccttcttcctccctgggctgcctctctctggtgcatcctcccagggcaccctgcgcttcctcaatcccagggttcatcccacggcgctgctatgtgctgcaggcttccctgttggactctgagcatcttgaggcggggctgtgggtgggggctgagctcccatctgttccaccagcccagcacccagattggcctggcagagagcagcacccgtcttcccccttgtctgaatgaacgccctgagcaagcctcatcagggctggcaaggtgtggcctggtttctcaacctggcattcagggtgaatgccacctggcctggccccctctgaaacctgcctacccagtgtcttggtactggtctggaattggcttccacccccagccccatcgtcactacccatgagtcctcccagccgagcaaggctgacacctcctcccggaagcccgtcctaatcactctgaccattgtgtccacacttacattccttcccaccctctatctcccatcaccactctttctttctttcttttttttttttgagacggagtgctgtggcgaaatgtcggctcactgcaacctccacttcctgggttcaagtgagtctcatgcctcagcctctggagtagctgggattacaggtgcccgtgccacacctgggtaatttttgtatttttggtacagatggggtttcaccatgttggccaaggtagtctcaaactcctggcctcaagtggtttgcccaccttggcctcccaaactactgggattacaggcgtgagctactgcgcccggccccatcaccactcttgatagcaatggtctttggtttgcaggccagctctaccacccgccaccttcgaggcctcgggcaaatcatttcatcactgggagcctcagttccctcacctgggactttgggaaccatatttgttgaatgaatgaatgaaatcaggcagggtggctggactaagtgagaaatactgcagacacccccaacatgggaggcgtgcgatataagagcacgggaggctcctggttttggcacctggatggggccctgtgtggaccagcccgctcacacgtggggagaggccagggccaacacgtgtgctcagtgcaggacttctcagagcctttgtgaaactcacggtcctgggaacttccaaggggtgggagcgagcatcgagcatggaagctatttgaccctgtcccctccctgggggttcctgctccatccatcccaatggccacaccactagtccatgcccagagcactgatgggggctgctgcctccctgccctcacccacagcttgttgaatttctgctgggcacccggccatggaaggccagacccctgggcttggggtgctggcacctgcccagaggcctccagcggggcaccagggtcatgccggcctccgtccttggccggtgggtggggagggctatgtcctctcttccctgggctcctctcaaacccaccccaccaacctgggagttctctcttggctgcccagcagcctgtctgcctctgtcctgccacatgtgagaccaggcagcagagtggccccggccccagggcagcagatggcccagggtggctgttgagcctgcctgggggtctggctcaggaccctgtgtgctgtctgtggacgtgtggaggacgggcccagccttttccccacagaggggctctgagcacctgctaagggcgctttgcatccacacagcaatcccaggttttacagatgaggaaccggaggcccagaggggtgagtggtgtcctcacggttacccagcatggagctggtggggctgggaatcagacccaggtccactggcaggacccggcacaggccggagtggagcagagtgcgggctggggagcagaggggctggattaggcatctctggaccgggagtttgtgcacaaggggattctccgggccctgaggccgcatgtgtgaccacgggtctgtgtgtgcttgagcctgcaccccagacggcgtggccctcatggccttccagggctaaaatagccatgattcggggaactgtctgcctgtttatttttatgattattcttggtttcacagcatctgcttttgaatatcatctgctgtttttgataagtctgagcctccgtttcttccaccaagaggcaggtgggtgcttgctgagctctccaaatggggtcagactcaccccaggtcacctagcaagtcccaggtgaccctggccagaagccaagtctttctccctgtcccccacgcccacaggccagggctccctccaccccagtgcagagagagacgtcactggtgggcacagactgagctctgtggggaaggacacctgggccccatctgacccgactctgcctcagttccaccagctaagagccctcttgctgagactgcggctctaacggaaacaccagtgtctctgggaggggcatagccagttggaggtcctgcatgtcacctgccagcccctccctgcctccccatcattgggttcattgctcacctctagctgggtgtctctgggaggggcatggccagttggaggtcctgcgtgtcacccaccagcccctcctttcctccccatcaccgagttcattgctcacctctagctgggatagccgtagctgcagcagctcctgaaacccctccccaacctcagcctctccaggagctgctgggacaggcattctgtcatgtgcacctgcctggcctcagcctggtccttccgcctgaagctcctcagcctggtcctctcagcctcttccctctgcatgtgctgttccttctgcccggaatgctgtttctctccctgtgccacctggtgaaggctccgggcacccacagtcattgttccacagagctctccctgagcccctctgatgccctagtgccctggatgcccctgccccagggggagagctatgatcccacaatctgaagggcacccgctgggctcatccttcccagggtcttattgacttccctcaagatgcccctgggtgggtgtttctggccccactgtgcctgtggggaaccaatacagaggggctaagtcatgtgtccgggctcacccagctggggtgcaggaggggctgagctctgcctcaatctgcctgctggcactttgtcccagtgcctgggatcagccttctgcggcacccagccctgtgtgtggagggaatcagaggccccaggccacacagccccgtgcagtttggaggtgtcagaccaggacttagaccccagcactgcgggcacaaatgggtcccaggcagacctggccccacctttccgagctgacagctcagggtagggtgggaggtggctggtcacggccgggatgggcctcaggacaatcagagggaagagcgctcccggcagcaggaagggcacagtgagcatgaagggccagaggtgggaaggagagtctgtgttcagggctctgtgagacaccgggggcgtggggagggctttgggacgtatggtgaggggatcaacttaaggttctttgggccctgacgcccctcctcagggaggccctccagagcccacagccccgcacgcctgcaccgcctggcttccttcgcagtgccctgccacgcgcagttccctatgtccctgctttcctgttcgctgtgcttccctcactgaactggagtgcctcaggggccctggccttggctggcccctctgagtcactgagtcactgctgagtgatggagtggatgattttagaatacccctctgatctccttgagcctcagtttcctcatctataaagaggagatgctaataccacttaacaagaagacaatgaagccaccccgtgggctccaggagctgctcagaaatggtccaaactgcatggcccccacgcccggctctccagccgcagaccccgcctttgctgatgggcccacaccgtgtggctcagagaggggcagcgacttgccacggccactcagcagaccgccctggagcccagcgactggatgagtcctggggggagaggggagggaagacccaggatgaccagctgttgaaggaagaagacagggcaagtggacaggcccagcctcctgcggggtgcattccccgtcctgcgaggtcgccagctgctccacgtctgccccgccagcaccctggctgctggccagttcccagcccgctgccccctcgggaccctgtcctgccgccttctcacagcgcagtcccagtgcgagcttcgcggggctggagccagcttctaggtccacactgagggctggcaagcaagccttccctgggactcagtttccccacccctaaggggtagagacagcaccaaggctactgcagagggcctgagctgtgggatggcaggacgggcactctgaagagggagcatggcgcttggagcccatgcccacaaagccctcaccatggccctgccccagctgcggggtggtggtggctgaggccccagagcctgccaagtgcctctggggtcccccaactctgtccctggcttggcctgtgggccaccctgctgccttgccaggtggggaaaccaagacccagctctgggcacccagcagatgctcggtgagtgttgaacggagggatgaatgagtgaatgaatgaaatccagagttgggtgggcacctagcagcgcagctcccccttatgcagccagcccaactcacgcccatgttctccctcaggtctctgttttctcatctgagaaatggctccctgtccagcaggacctgctctgagctctccccagcccggatctggaggcagtttctctgccctgcccttcccactcctgcttggctgggggtgagaacccctgcagggagcagctcaggagcctcctatctagggaagctggggagagggaggctggggccagcccacaggggaacttaccgcgcttcacccgggcaggctggagatgggagtcctcagctctcagctctgcatgcagcccggacctcgccttcctacggcctgacgtcaggccagcgcttggggctccttttgggcaaaggcagggtgggggcggggcaggctccttccccgcccccaggaggagtcaaggctcagagcctgagggacggtgcctggggcaccagagtccccacacccactggagacagaagaagaaaccgaggcacagaggggcctggggcaccagagtccccacacccactggagacagagggggaaactgaggcaccgaggagctgagcctcagctgcaccatccaggaggtggtggctggcacttgtgtgtgccgtgtgcagggcaggaggtgggaaactgaggcacggaggggctaagcctcagctgcaccatccaggagacagtggctggcacttgtgtgtgctgtgtgcggggcaggagggggaaactgaggcacggaggggctgagtctcagctgcaccatccaggagatggtggctggcacttgtgcgtgctgtgtgcggggcaggaggggaaaactgaggcacagaggggctgagtctcagctgcaccatccaggagacggtggctggcacttgtgtgtgctgtgtggggggcaggagggggaaactgaggcacggaggggctgagtctcagctgcaccatccaggagatggtggctggcacttgtgcgtgctgtgtgcgggacaggaggtgggagcacacgaaagcccaatttccttcccgggagggggcatgtgcatggtagcttcagcccacgcaagcctgggttcctgcatggctctctgttttgcatgtgtcctgggtttggctgtgtctgtgtgtacccatgaccgacagcctgcacacctggcatctgggcctctgtttgcacccatgcaccggtggcatgtggcatgtggggtcaggtgtgtgggaaagacctggacgtgacccaggccagcaggtggggagagcgtgtgggacccggacctcagtgctggaggaagcgtgagctcatcaacaggcttgatcccagagggctgctggagggccactctccccagacagcttcagagccaggaggccttgtggccagcctggggtggcagcgggggttgtcggggagcggttggggccatttagttagtgtctcctctgccgagagcaccatctcctcttgttcccatcccgtgtgcttctgctgatactcacactttaaccttccagccgcctgagtgccgaggccctgctgagtgggttgtactgcacaccggagactcagggaaggctccccaagggaggggctgggccttcccgagctcaggctggttgtaatgcagaccaacaggagagagtaggtgggccctagggtcctgacccagcctgctggggagggatgccgtctgggaaggcttcctggaaggggcagagggaggtataacaggaggcaggcagcccagatgggcagagggacaggaggccatcagaatatttcctggggagcaaagctgggagtgggcaggggacttctacactgagtctcagcagcctctatgggtaccagagtgctgcaacagggagccattgaaagttctgggagaggatggtttcttcactctggagcagcctccctgcggctgcagggctgagcccacaggctgcaattatctcctttagaacatcgttgtgtctgttttagctggggaaactgaggcccagagaggcacaggagtctctggccaccagcctcttgcacctctctggaccaggactggctcctggcaggcagggtttcaccgggcttgtggaaggtgggggtggatgcaatgtcatttttgtgtgggggtggcctggaggcagcccagattgggcagggctggagccagaggaggctcagatttcctgagcaggcgagggtggctgagtcaccgcaccagtgccaggcctcatgcccacctctgagggcctggggctccagccttgcactctcaggcttgttctcagagaaatctcagagacggtcccccagcaaacagcggggaactgcctggggaggggtcacagcccacgccagcctccctgactcctcccccagggagactcttctcagcaggacccagggatcctcttggggggacaccagggatgggggtcccgagctcagggccaacactccacaaccctcagaggagacagggcacagggacaatttcctccttgtcatctttatcaggctggcaggtcaggccaggctgtctgtgactggggtcaggggtcagaggtcagagagtggctgtgcccagggtcaggaccccttcaggtgtgtctgactggcccttcgcagggcaggactgctcatcctgggctctggcacactttgcagggtgggaggggccccttgggcagacactgtagggaactgggcctggtggagagccctctcaagcccatggaagcatccttggaggccctgccagcggtgaggcatcagcagcctaccattcctccttccccaagggacagggtgcagggaagcgccacaatgatatctccacatgagccgccagcagggctaccaggccaccctgggcaggaggcagaagtggccccttgtgaacctccatgggagccaggtggacccatggctcctgtcctccacccttggcctgtgacgccaaggccctctcgctgtggcagctgcagttgggaatcccataacgctgcaatcaagactgacaagccccgcccatcatgggcagtgctggcactgtagggtccccatcctgagggatgaagccaacaacgggccactgagcagtccccggggtggagagggctcaggataatggggaacagcagatggtggtgacaggcgggttctgccacccctgctggtgcctgacaccgcagacctcgtctgtcctcctgagagaccctcgtcttggtgccactcgaggatgtaaacagccccgggaggctggcagccgttttctgccatgtgtccaggggtgaggtcctcccaagggggcctgcgaaggtggggtgatgccagccagctctgcaggactcccacctactcgagaggccagagctatggaggaggggcagagggggagtgcagagcttccagatgaggggtgatcgggagacctgcaggctccttcctggggggtccagtgcccacaggccctctcctgcactctggacttgctgggtagcgggcaggcacctgccattgagctggggtgggcaggagcctttctctgccccagggagaggtgagcctgcatgtccagggaatgtgggggccccttgtgcagccctgggttcaagcccagcctggcgcctcccttgtctgctctgatcctcagccttggccctgtggcctgtgctcacggctgggaaggggcgtccctcctctcaggaagcgctgggtcctgccggccacatcacagctccacagggaggctcagccccacagtgggaaccaaggaaactgggctgggggtacagggacaggaccagccccaaggcccacagcagtgaggggcagcctgggcccagtctgcggcctcctcctatctgaggggaagacgcggaccccacggtagcagagcatgtcggggctccaggggtggaggctagaagaaccagggcaggctatgagaccctgcagggcagagcctttgagaggtgggtggggaagtacccagagtccgggatcatccaggccagtcttggctgaatgcctggaactcagccacaactggggacgtccagggtacctggtgctgtgcctggtgcacagttagcgcgcggctctggggctctagggagtcatcctagggtggctgctgggactgctaccctctgggctggccccctcggtgccccaaggcacccccttatgcctgctcaacactgagggttccccccagggcatcttgtctcaacatctgctcttacacacagggaaactgaggcccagaaagggaggaaggcctgtccaaagtcacacagcaaatggggcatgcagaccctggctggaaccatgcctggcttgcagccccccagtacccttctgttaaacccagtctcatggactgtgggaaggggcacccacagaacactgcctcatcatggggtctggcagggctgtggccctggccacagctggcacaaggtggtgagactcagtgtgggctggtactgctgaaggggcccacacggaagaagctgcagccttgagccccatggagcccagggagggtccccgcagggaatggcgggggacagcagcgcggggcttattggtgagaaagcagagggaaagccccaggctcctaagacccaatccgggagggattgctggtggaggaggtctggtgaccagccttgcaggctctcccaggattcacactggctctgcctggccttgccatgggtccaggagcctggggtgaggtctgagtgtggagtgtggaatgcgtgtggggctagctgagtcttagcttacagaatggggcagcagggcctcagggggaacactgggaccagaggaccttggaacccgccaagttggccccaccttttatacatgtggagatgaaggccggagaggggcttcagctatcgaagctccgaggcagctcagctccatgccagccttcctgccacctgggcaggggtgccccttcacgccctggccttcttgtggccagccaggttacagctggcagctgggcaggggtgcagttcccaccatctgggtctccaggcccacccagggccagcccaggaggtgctgggtgagtggtgggttcccccagggcagagacagcaggaagaggattgccaccgtggggggcttcccgtgtgtcccgttccacctggcctgtgcctggaccagcacttctcatcccgcccacctcctggtgagggtcctcacagagagcaaggggactaagtcccttccctccctcgggctcacacagctgggcccctgaagagtcaggcaggaacctgggagctcagaggccaggccactgggctcccaccaccccgggaccttccacttggggtttgaggaggcggccgagcctttggggtctgacccacgttggggctgctgtggcaatagactccccagggagagggagaggggaagccccgggaccctctcaggggcctggccctgctccctctctccacagcctcctctgacacttggcccagccagggaggggctctagtgggatcagcacaggtgccagagcaagcacaggtccagcaggcttggtggccgggggtggtggccatgcgggccctgcttggcacctcttatcccaggcactggaacacaaaacagggcagagtatgaggcactgctgcgtggagccctcctgggatgtgatccaagggttgaaacccctggtctagcaggtcagtcactcaacatgcagcgctcaccgagacaagtctataacagctgccgctcactgagagcttctggcgggccaggcacaggggaagcacttcaggtctattaattcccccaaataatcttataatggggcatcctgttcccatcttcagaagaggaaagggaggctcagagaggcaaagtcacttgcccaaggtcatgcagctaggagggtggagctgggaccaggcctggagtctctcagcccttacaaagcccccaaattgccagagctttctctctggaagctccaggaacccatcacctggggaactgtgacaaggaccccacagcccgggaaccccaggggagagagtgtgaggtctaagatccctcctgggcccaggcgcctgcccggggtggcccaggccagccaccacaaactggccaggctgggctgagctgcaactccctctagagttggcccagtccacccaggtcaagaacaggccacgtccccagcagggctcgggacctgctttctatttcagcacttcccagcccccgatggccccttgggacaggaatagctgtgtctgtctgtgtctgtctgctcggcaggcctcagaggagcggccccgggtacccgggttctcctgaccttggcttcctcgttggcccaggagcagggagcatggatgtccaggggtagtgtccgtgtggggacgctgcagtggcagctgctgttctctgcccaacccctccaccttccctcatagcaatgagctttggtcactgtgagtggccaaaatggcctaggccagcacaggctaaaagctactggctggacatctggcaccggtgggcagggaaactggtgacctctaaggagcaggacgtggagacccaggctctgaactctctggctctgagaacaacttttaggaagttgcttgggttcagggtttctgggacaagccctcccaagcactggtcacaagctcaggaccgagaatgtgaccccaaggtctctcctcactgtctctgcagaagcctgagagccttcccacctgcacaactctgccccactgttctctccacctagaaggcctttcccacggatccaaaccagcctctagccacaaggccacctcttccaggaagcctgccctgactggtttgtcttagccctgaattctgagggcagtctgggcctggatcaattgctgggattttcctgggccaagtttgtctccagccaaatgtttgactcctctgagacacggccaacgtttcgctggtttcttcctcctttctgttgctgagcatgtggggaggtatatagtagaagctcaataaatgcaaatgcctactcattttaaaaatgggtgggaagggcagggctccaggctgccatggccccattgcaggcacttgggccccttttctgcctgtataaactttcccacagagccttccggggtggcacacactgctcttacgaacaggaagttctttcccgtttctaaccttagtccttcctgcagcagcttcatctcattctggctcctaagagctggacctgctcaccctgccctctcctcctaggggccaggagaccatctcttagtaagtgaaagggatgcagtggtcctgggggatggcggcagtgggatggaccgctgatgttacctccactgtcataagcaaggaaactaagctctgaggaaccacccagctactgagaggtggagccaggatttgaaccattcaggtgagcccagggcctcggactggctcccatggctgtgagcctcacatttccctgtgcggagaccctcctgcagtgggttcctcccctactcaccagggctgacccctacctcccaggggagccctgggcaagtcccagcctgtctccttcccgacctgggtctgtccatctgggcagtgggggtacaaccccagcgaggcggtggaggagtcagggccactatttatagaggcctgctgcctctgccgactgcctgccgccctggaggagtgcgcgggaatgggaggagggaagctgttgttggcggggtaggttacgttccggaaggctggtgccaactctcccggttggcaagcgggggagggcgctgggaaccgagcaaaggggagtggatggcacccgccaatgggcggtcccaacagggtaggcggggccctggcgggggctgcagaccagatctcacgtgcctctgctgaggccccagcccaggaccccgaaatccaaacttctctgagacagggaagcatttaggtaggtttgacacaagctcactcagccgcgtaaactgactggacccaacccgagggtattcagcatccatttatccctcccggtgggcataccaataaggctcgtggcagaagtatcagtgtgtgtggtggaggtgcttcccagaccccatggggtgtatgtgacctccgctaggtgcatctcactgtctttctaaaatctgagccagaccctgaaatgcacacagcctcaaaagtttctacaagccactgtgaacctgattgtctcctgcattttacagacgagaaacctgagacttggagaagggaccagcgggtggccgggacctgccctgggggctgagacgaggactccttgggatcggaattccagcccttgctggtggggcccagtttgaggttgtcccaagagctatggagtctctcactaaggaagtaccttccctgtctctgctaccccctaaaatcggcctgttctgtcctgagcggtcttcctggaggcctcccaggggagctcagcccccactggcagccctggctctgcctagttctgaacccctaccggctgttgttcactgtctggggcacagaccctctctgcctccagccccatgggtgctgatccaggaggggctacctcctccaactctgtcactgctcctccagggtaccagctgaggccaggtcctcaggtgctttggaggtgggagtgagaactaggctcaaagtctaagccccgggctcaggtcccagcatggcccctgaccaaggccagggtttcgtggctcagagcctcagctggctcacttggagtcaagagcattggactctgtcctgaccaactcgtggggccatatggggggtcaagtgtgaggcctgggtcagggctcagcctgtgaccagggtcagagttcactgtgtgaccaggatcagggctcaggctgtgactagaaccaaggatcagtgtgtgaccagggtaggggaccagtgtgtggccaggatcagggctcagtgtgtgagcgggatcagggctcagtgcataagcgggatcagggctcagtgtgcgagcgagatcagggctcatcctctggctggagtcagcagtcagggtactcaacccgatgcaggttaccccccatctactctggcccccttaagaaggcctctcatagaccaggtggccctacgtagggcatttctcatgacctctgcgccttgtcccggggtggggttggcggtcctctttccagtgaggaatagggaggtgctcaaagtcccctcccaggcgctccccacatcccctcccaggctctccccacatctttctcacagtagagctgctggggtctgggatccagcaggcctgcccgtgcagggccccaggccacttcctgcttatgaggcgtgtcagaaggacagagagcaggcccggaaggtgcttagctggtgggggcggctgggagccgccgaagctcaggaagaggtgagggagcctgggtagggcaggcacattcctgggagcggctgaagctcagggaagaggtgagggaggctgggtagggcaagcacgttctcaggctgcagggtggctgcccatggccggggtgcttttggatggccagctccccggttcccatcctgctcgggcctctgcttttgaagagggtcatggtgaacgtctggattttgggccctgtgttccctctgatgagctggactctgggctccagtccccactccccccgccccccaccctgctctcaggaaatgagccttgtgcccagactgggcgccttccctgaccctgcgactcaggcccttctctgtggggggcgtgagagccttgagcctggcaggaaactaggtagcagatccacaaacacaaagggacaattggccgtcatgatagcgatggtggtgacggcagtatcttcatgacagtggccccgcagcagggcacggagccaccttgtgctgttcctcacaagggccggccatggggtgcaagggctgcaagtgagaaactctgcagaccccagccagacctgggggagccccgtctccaaaggccctgcttggtgtggcaggtgggattaaggttggcggtcggtggaggagcaggtggggcttcctggaggggagggaggagagaccccactggtgggtggtgggaggggcagcaggtctcaggcgggagtcacggctaaaggccagttctgggtggggcctcctatcactgcgggcaggggcaggacagctggggatgggctactgagggatcgtgtctagaagcagatggttgctgtgtcccgcctgtgggtgtctggggagtgggcagactgggcatggtcatgggtagggaagggggtgtggccctctcagacccagcaaagaccctggggtcctggccaccagtccagcctctgtttctaccagacacctgtgtgtgggacaggtggacagtcaggtcatttgaaaatattctccaagaggaagctcttagaatctttcgtccctttagctggggtgggtgggggggcaacatcctttgattcagagttttggatctggggtcctgggcagctccaatggcttcacgaacccctagactttgtgtgtgtgcaactgcccatgtgtgtgccatgagggtccattgggactgtgaagggtctgaaaacccacgtgggttagaaccacggtgtggtccggccccgttcagtgcagatggggcaggcagcccccaaagccacgctgagagttggagagttagagccaggtcagctgttgggaagggcttctctgcccccatgccccagaccctccttcaggggcagatttctgtcagagagactgggatgggcctcagatgagccccatcaacatccaaagagaaatggattgtggaagatccgcctcacttgtccagctgaccatgtgtctatctgtccttctccaggaccctggcagagaaggctgccggggggccggccaccaccgtgtggggttagttccaggcagcagcgtcccggtggctttcatccttcacctttgtacatcctggccgtgtttgacatctttacggtgagctcgtgccgttctataaacatacgtccttttcttccttaaagaacagcaaaaagttgcctggagtgactggaagcaaccctcgcaggacattagcaaggattagttctgggcgggagaaagcaggtgactgttaatttcttctttccactgatttgtatttattattaatttatttaaaaattttaatacagaaacccctctgctctctaattgttcagtcacttgcatatcaccatcaggcctgtacatcagtagaggcagaaatgtgtagcttaatgccaacttcccttcccaggttgtgggtgcagggtgacaggaggagagaagccctggcgcacgcctgcctcatccctggctggtcctgggcaggcgtcaccaatcaatgaggctcttgctccccaggagcctggatggacaccccctccccggccctctgggcaaccggcccagtggaccagcagagcaggcaacatggccccgactggattgggtccagactccttaatttatccatgaagaacctgaagcccagaggcatagtaattgccaaagtcccacaagtgttcagggccaggctgcccctggctcagtgttcttcctgctgggagctgggccatgggctctgcacttcctcactctgcatttgggtccatctggttgggactgccaggcagggtgagggaagcctcccagcactgtccaccgtccgggggaatacttaatgtgtcatgtcctccacctgggcaggggcagggcaggggtgaaacacctccctgcccaccagagctgcctcccccagagtcccagacccaggaaccagcccccgccccaccctgaagcctgccaggacccagcccttaccaaggggcccaggggttgtagctcagaggcgtgggatgcggacccccgaccacctagctggcagggggcagagtccggactcagacccaggaccacccatgccagcacacagccccttccccacaggcgcctgtggagcaagtcaggaggcaggacacagccttgaggactgcaggtctgatgaggacagtatctgccctggggaccctgatctgagggaggaggcaacaaaaaatgactcatcaacggggtgatggggacattttgggatggcaaatttggatctcaacccgggccccaccgcctcccaccagaagcagttacttagcctccctgtgcctcagtttccccatctgcatagtgaggacagcaatgtttggggccgtgtgaggagtaaatgaggcaacagttgtggtttgggtctggtccgtggctgtgtggggtcaagtgagcccgtgtgtgcccatggctgcctgtgcatcagaatcaccgggagttcccatcaaacacagacatccgggcctggcccagggaggctgactttaatggtctgggcagagacctggtcatcagcacttttttttttttttttttccgagacagagtctcattctgtctcccaggctggagtgcagtggcgtgatcttggctcactgcaacctccgcctccagggttcaagcaattctcctgcctcagcctcctgagtagctggaattacaggtgcccgctactatgcctggctaatttttgtatttttagtagagatagggtttcaccatgtttgccaggctggtctcgaactcctgacctcatgatctgcctgcctcggcctcccaaagtgctgggattacaggcgtgagccaccgtgcccggccggtcacagcattttaaggactctgccatgattctgatgtgctgccagggtggctgtgcctgagccggcctttggctcttgcgcacacactgagatgccggttcgagtggatacagggggtcagcccacttgtttcccacggccagcctccagttgggctcacattgagtaactgtctgagcccagtcccaggtagacatcgtcagtttccacgtgttccttcattcactcaggaacaaatgggctttactttatccgaggccttgtagataattattttttccctctgtaaaccaagtcctgcttaaatcccatccaaatccctccagccagagcccatgctgcctgcgagcctgctccccatctccggctgagcaggtttgtttaaggctgggctgacacttcttctccccgcgccttggtgtgtttacactggggccatcagcagaaactgcaggtgcggcagggaggctggagacagggcagggaccatgggggtttcagggcgtcctttccacacagtgtctcaggtcgccctgttcccagcctcgtcctcgttctcgttcccacaggcgaggccttggaggtcactcaggacaggggaagtgctgaggcgaggcctcaggctgctaagtggagtgagcccaggaaggctttttgagtgggggacgcccgaattggttttctgtgaagaccagggagcaaacgtgcctgccatggagtgaacggcaggacccgcagggaaaacctcaggcagcggcttgaaataccatggccgtccatggagggggctggtcagatgctggcggtgtgggcagaggaggctctgggccactgcctgagtgtgagtcctgccaccaccacctgatggctgagtgaccttgggcacgttacttaacttccccatacctcggttgcctcatctctcaagggagtaatcatattaacttctcagggtcattgcaagggtgaaatcatctagagacacagagcctagaataccatactcaggagtttgtgctctgccctataggcagtggggagttatggcgagtggttgaatagtgctggagctgggctttctgagggtctgagctcccaaagccttttctgtatggctgggttgtgaggcttttatattgtcactgctgaccaatcacagattggctacccttcctcctggccagtgattggtttagggtgggttagcctagccagctttgggccaatgacaggtgaccagaggcttattgtgggttctgagctccctcctgtccccggatagacaggcagcctttttgtgagcatgaggggaacctgcctgagaatgatggtggggaaaatcttagagaggcacagctgggtgtggtcaccctgtcctggagcccacagtccctctgcacttcccgttatgtgagttcctaaatttcctcactgggaagcctgggattctgtcacttgcttctcaaagtacccagtgtccacatggcagagtgtcctcctagagcccacatctgattgcatccctccctgctgaaaaccgtcaggggctcccaccccttgatgaggaagcacagtgcttcaccccatagcctgtgcctcccactgcgggttctgccggcccctgactgtccttgaacacaccaggcacacatctgctgtggggccttcgcgctgctcctcccttggccaggagcattcttcctttaggccggtcactgctcacctcattgagggccgagctcaaatgttggcccctcagggcaggtgggtggccaggaccatctgggtttgctgcagccacacacacccctgattcttctgtggccttattgatggaggtgtgggtctcgctcacgccatgaattgctggtcggtgtggtgggggatgggtctcttgctccttggtggctcggggacctgaatgacagaggctccgccattgcctgcagccggtgctgtctcaacacaaggcctcaggtcccctgtggtgggggagagtggaagaacagggcaccagttcctaaaagctttgtccctgaagtgtccatcacattcatctcttctactcgcattccaaggaccacagtcagtggtggtggccatgcctaatatgagggggcatgaccccaagcctggaaggggcctggcacacagcagtggcttcctggccatccagtccccgtgagcggtctctcccctccacagcggcgtcctgttcttattcgggaaaaaatgcacataacacaaaattcaccatgttaaagtatgcaacccgccttcattcacagggtggagccccatcacctctgcttccaaaacatttccatcacccgaaatgggaaaccccattcctcccgccgagccctggcaaccaacaatctgtgctcatctctatgatgtgcccactctgggcattttgtataaatggaatcatgtgatatacagtctgtcgtgtctggcttctttcactcagcctcattttctcaagaatcgtccacactgcagcctggatcagagtgtccttccttttcatggctgcatgctattccactgctgagatgtgccaccttttctttgtctgttcatccagtgatggttgacggacatttgagtgtttcctggctttggtcattgtgaacagcactgctacgcgtgttcacatacaagtttttgtttgagtcctggcttttttttttttttttttttttgagatggagtctcgctctgtcacccaggctggagtgcagtggcgcgatctcggctcaatgcaagctccgcctccctggttcaagcaattcccctgcctcagcctcctgagtagctgggactacaggcgcccaacaccacgcccagctaatttttgtatttttagtagagacagggtttcaccatgttggtcaggctggtctcgaacccctgacctcgtgatccacccacctcggcctcccaaagtgctgggattacaggcgtgagccaccacacccagccaagtcctggcttttaattcttttgggtagatacctgggcctcatcccattgcattccttctataactgatccccctccgcagttacttgctcccaacgtgcctctgtttccctctctgtgaactgggcatgttgctgatctccagttatgagcagtgtctctcttaggtggtgtgttctgcagggaggggaagcagccgctgcccctgcacgcgcctggccatgctcacagcatcttcccgtcgctccttgacttgttcactgacccctccctgatgtggccggaggacggggcctggtatcaccttgtcctgtgcaggcctgacacgtagaaggtgtttggctgatgcttgctagtataggaataagctagttctctaacctggagttcctccctgtgaggttttgtttgcaagaaaaaatctgctgctaagccagctgtggaggcacatgccacagtcctagctactctggaggctgaggcaggaggagcgcttgagcccgggagtttaaggctgcagtgagccatgctcgcaccgctgcactccagcctgggcaacagagccagaccctgtctcttaaacaaacaaacaaacaaacaaacaaacaccctgctgctaaaacatgtggaaagtgtgatggacgccacactggcagttttgcttcctcagccagcacctcccacatgctcccagggtcagaggtcagggatcaggctggctcctggtagggggctctgtgtgccctggcaagtcgcccctccctgggccaggagcgaggtgagggtgtccacagcaacaggctgtgtttggacacaagcggggtggggctgcaccacacggggctcttcctgtgccttataaatcagctcccaagagcattccccaaaaggagtttcagctgctcccgagcccaggacagcaggctggtctcccctccggtgagaaatctcctctcccgtctaccaccccaggagttccccagagaggctcggttatcctccaaggaggggatactcgctgccttgccgagatcggaatccacttttgcctgttctctaagccctgctggagatgtgggagtgcccctgccccacagcctgttccgaactcacttgggccatcgcccagctccagcctgtctctcagtgtgaaccccgagagcatcttctgcacccaggtggatgggtggctaacagcatgggcatcaggggctcctggctttgcttccccgcgcctgcatttccttgctgtttggctttgggtgatctgcaggaaggaggactgccaccgccatggcacgcgcctggcctctccactggcaccttcctgttgttccttcccttgttcgccaacccctccctgatgtggccggaggacagggtctggtgtcgccttgtcctggcacaggcctggcaggcagaaggtgtctgactgatgcttgctggatagaggaataaactagagctagatcttggggctccctgtggggttttgtttgcaagaagaaatccccttctctgcagctccctggggctctgtcattgcagagggggactgggatgactggggaggcacgcgccctgctgagggcagccacttctccagcccagcaggctgtaatccgacatccacagggattatcctggtaactggtggtgcatggcccctgtgctgagagggctgcagtgtgcacgccccgtttagagcatcgtatgggttcagcatgtgtccgcggatgggtgcttgaggagcacctgtcagacgggtgcctgtcaggccatatttttggcaatggtagcttcccgggaatgagggatttttcctgggataaaggcccccgtggagggtggtcagcagccctgaggacgtggtatgagacccacagccttccttgactccagagcggccaggaagctgggactccagcaagctgtgctgcccccaccagtgcctgtgttccctgcatctcacatggagcctcactcaactcctgtccctgagtgcccactggtggggacgagggagatggcaactgtggatggatcccaggccagtggagaagacagacccacacgccaggaggatgaggggttgtcaggttcggggggcctggaggctgcctcctgcaggccctgtcccacgtgagagggtcgggacctcaggttcctcagcctggacctgccgtgtcttgggcagcatccagtgtttgggccccacgacctccagggagggtcacttgttctgtggctgccctctgtcccccaccaggctccccatggagggctcagcatgcaggctcagcacacatcaggcatggaggccctggccccacgttccctgctgctgggcagtgcacagcctgcctgagcctgggtccctgggtggggccagctgcccccgccctcttctgggcctggtggggacatttggaccctctgcattgttgcatccctagattcagccctgctctgctccctgtggggacaccaatctcccttcctcagcctcccaacaggcctcatctgctgaggaacgggaggcgtggggcccaggcaccaggcccgtctcttgtcccttcccagaacatcttctgcctcctccccttctcatcttccccttcacctcctccctcctttctccctccctctctctctttcccttccccctccctccctctttttcccttctccctcctccccttcttccttctgttcctcgctctcctccccctgtctcctctttgccttcctcatcatctctcctctctcgtcctcagctcagggaccttcactgaatctggaaaaaacaggagaaacagcctcatcacaaattctccaaattgttcttggattgagggttgggaacttcaatgccagaaacagtgtcattttcctggtttggcaagggtctctgagccctgtgggcccctccagggtctaagaggtccccagaaaacaaggtgggatgaaagccttctgtcaatacccttgcccagaggtacacgtgagggcttcaggacaggaggcaggagcctcactcctgggtccctggtgggccaggggtacaggggagagcggcgttctgaacctgtgtgggtcggggggttgggcaggccccggtggaaggccactccccactctccctggagacctcccgtggggtctccccctctgaagatacaggttttcctaagtcacactgaggggcgggcttgctgaggcccagctgggggtcttcctgcagaccagcctgtcactccccacttgccagtggtctgggctgcagctggggagggcttctgctctgggtctcaggacctggtgggggcaactcatggagcaggctctccctgcattggtgggggtgaaaggacaggcccttccaggctgatctctgggggagggtcctgacccctgggagccctgggtgctgaggaggcctctcccagggccatagtctccatggatggaagtagggggtggtggctgggccagcccccgacacccaccagctgccaggcctgctctgagagtccccgatccctccaccacccttgaggccacacccagctgtggtgtcccaaagccctgctcttggggcggacagggagcacggttctactttccccaccagccgctccaggccggctctgctggaccctgcagtgcagagaggacggagctggaccccaccttgatgggccacaggatgggggcacatcagacgcacgagaggtctccctttggccatgccatgtgtgcgggagcctcagtcaagctgtgaacacactcagcctcaaaggactgagcggagggccccgcgcttgcagatcgcatcctccttcaccgggattgtggggtgaggagcagaccccggctgcggctctgcctcttgccctgaatggggtgctgcagggctggcatgtggacgctttttgctggagtatcccctgaatcccagcagatgaggaagccaggtagggacccgcaggcaggacctgatacagaatttcagggccctggggcaaagtggaaatgcaggcctctcattcaaaaatgttcaacgtcgccctacagcaacagcagagcattcaaccgggctgagggtggtgcccgtgacctgtgcccagctcgtacccagtgcagcggccctgccccacaggccccacgagggggcgcccgtgtggcgtgcctgaggcccgctcctcgcaagcttgcctgccccgaccctcccggcatcctcaatgccgcagcgtgggtgtcccggcctcctcactggcggaagcatctatggacggtggtcctccaggagctgggggtcacaagtgcaatggcaggtgccagatggggctgaggccagcagggctgtgtgtggtgggacacctggccacggtcacccccagggaggccccgtcatccccaggagacaccctagctcttgcctgggaccccagcaccaggccacagggtccctgctgactcccccatcctccctccgccaaggcgcccctcctgcctgctgagctccagcctctttcctccaggaagaacgcttggccggcaggtccctgctcagatgcagtgcctgggacgtgcctcctggatgcccccacgacagtagctgcagcactgtctaggggggctcccgctgcaggtcccagtgatgcctggcacaggtgctcaatgaaagtttgccaaactcaggggcagggggagccaggagcgctttcagctgccaatgggcgacacagctagagcatccaggcttagggtagccccactgctgcaaaggtcccagctcagtgtcccaccaaactcccacaccctacctcactggtggtctcagaagtccaggtcaggcactgccatacctccaccccagcccccaaggggccggagctcagcctgcagtggccttccctcatccttgtaggtggcaccagctgcaggcttgggaagccgccccaccctgcccacaccaagtcagggcaggcctgggtgccccacagaacacagtgaggtggcactgggtggcctctgaggtcagatcacacgtgtcttgctctcctgggtagctccttgtgggggaggccagccccagcactgggaggacacccaagcatccctacagaggggcgtcttgaggaagactctgaagcagcagctaataacctgcatggcctggccagctgggacagtgagagggttccgaaggggatcccccagccgcagtcgggcccttgcatgtctggaaccctggccatctgactgcatctcatgagaccccagccagagaaccgccccgcccagccactcagaactcttgaccacagacgcggagagagagcaggttttacaggcacaactaatacacaaatgaaaatgtcaccatcacagtagcgtggctgcattaacgaaactaggggaaggagggaaatgaaaatgactttcccagctcctgcacgccaatcccccgagtcctggcctccctcaagccctgcttcctcttcgcatcaggggcgtggctgcttacgctggttccctcgatagcagagcctgagatagggacattggtgcaggtggtttatttgtgatgaccaggtgagggagccaacacaggtgtgttatggaggtctcagctggtttcaggacctcctgagaagtgtgccggacacctgaggaaggtccttctgcagatgggaggcaggtgtatccgccagagccctgccacactgcggagggctggccctcctctgcccttcagggcttggtacacacggaaggcaggcactgaggaggagggtccaagctcgctcagaatgggccactgccactgaaatcagggaacagaggggacgtgaagtggcccagagagcatcgttccgcacacttactctcttcctagatgtatactcctgcaccccgctcctgtttacctaactaaccactgaacaacaagctcttttttattttgtttgacgctcagggcttgaggaggattcaaaaggacagtcataaagacatctacttctgcgcaggcagaagcaacgcagcacttgacagccaccatcttgtgggtcttcccaagagccctgtgaggttggagctattactatgacatttatagatggggaaactgaggccaggagaggtcaaagtgtgcagcccagtgatgggggctcaagagctgctgctggtgccattagcccacccatgccctccgtggctggatctaggtcccccagcctgggcccctcctgtagggccctgctgggctggaggaggctttccagaaatccacttaacgctgacctcgtctttgtcctccttggagctaatctgctaatcctgccagccccagtgggcctcaccactgtctagatcgtcctgcatggttggcatccctctccaacaatcccccacctgcgggggcctcctcctggccatgcctccagggctgggcaggtccagtgactggggtaggtggagctgggattctttctgtggaacattcctcaatcctgggggagattctggagtctggaattcaggagactgggcctggcttctgaccccaccttttcacggctcagccatcatctctgaggccccgttttctcctctgtaaaacacgatcactttgagctctcttccggctatgaaatcccaggattctccccaagcctgttcatgcccggcccattccactcacagcagttggacagctctggtttcaccgtgcctgggtttgaatcttgattctgctttcgcttagcttctgcttcctaatctgcaaaatgggggtgtcagggattcctctgcagggctcagtgtggacttggtgggtgggtgtaagtccctggcatgtggtcagcactcggtgaatgtctgagaactgaaatgaatccagcatggaggagcctcctcctttgctcccgactccctgcaggatggtaagagcgtggggaggaaggaggctccagcctctcgggagcccactcaccccagcaaatttgggtggctgggatagaaacctctctgagattttgggcaggagaggaggaaaatagcatgaaacaggcagggggtgttggtgctgctcaggctagatgaagccaaacatttatttattaatgctttttttttttttatcttttttgagacaggctctcgctctttcacttaggctggggtgctggcgggatcagggcttactctagccttgtcctcttaggctcaggtgatcctcccacctcaatctccaagctgggactataggagcatgccaccatgactggctaattttttattttttgtagagatagggtcccactatgttacctaggctggtcttgaattcctaggctcaagtgatcctcccgcctcagcctcccaaattgctgggattatagtgtgagtcactgtgcccggccttaagctaaacatttaaaaaataagaattaaaatgcagccacagtgaaacgggaaggggctgcttttacaggtgctgaacttcccggcaatagaagcatttaatgggaggttccctttttcctaggacctcaaagctggagtaccagggatgttgccttgaccttcccatgtgtggatttctgcttgaacacaccaagtacaggacaccctgtttagcagctaaacgtgggaattgcaccagctttactcccaacttgctgggcaatcttcgggagttgctgaccttctctgtgtctcatcagcaaaacagggagaacactagctctcccaacatgggctgtgtgaggaccaaatgagctgaggagcccagatttgaacccgggtctgcaaggttatgtcctctgagccatccccacccctgcccttaaggaccaggggcctctggacaccatcagcttgcccacctgtccaggatttgcacgcacctgctcggtgccagatgctgggcactggggacaaaccaggtgaggtgtggaccgtgacctgtgttgtcactgattgggggactttctggcagagtggagagtgcagtgggctgagagacaggatggccagtggagactgagctctcagaggcggcggcagctgatggggaccatgcaatgggaaggatggaggccctgggatagtctgcggtgaacttccaggcagaaggaacagcaggtgcaaaggcctttagctgggaaggaaactctgggttggaggaatagcttgcaggcgctctgagagaggctggcagccaggtggcagggaggcagcccagtcaggtggtcttgggacagtttagggtctctggccttcaccagtgaggtggtgtctggagacttttgcagacgaaggcagctctcactcccatcttcccggggtccctctggctgctgagggtggatgggtggaaaagcatctttcagggaagtggaggcagggctggagcagttgaacatctgactgggccaagggtccagggactggcatggaacagggctgggtgggtgaggccgcctgggagaccccagcttgcctctgtttccccctgtactggggcctcctgcgtgaaccagcactggtttttccagtaactggagccacaagcctccctaggaacggctgacccataagaggacgtcctcaaggtccccaagggctagaggctgagatgccgccttcgcctgggcgggcctcgcagcctggaggcaggcggtggtgcagctcgggcaggccccgtccacacgcctccccgctcttctgagcaccacgcgtcccgtgggctccctacccgtcctgataacacggcggtccgggggcctcgaagccggtctgaccccaagtacccgggccaggcggctgccgtcttgtcgccccagcccatcccctcagccagcccgcctggcggcacgggacctagccccagtcgacttagggggaaactgagaactccagaagtttcgtgaactccctggcttcgtccgcatcccgccctctgcctcttcgctcgggcttcaaaactgcccctccgacgcccgcctgccccaggccgacctggcctaggcgcccggcaggcacaggagccaaggtcagtccccgaggccgcccgcgcgaccggagccgcctcctcccagcccaggggcggcctcgggggcggcgggcgcgcggccgcggcgtggggagcgctcccattgggccgtgcccccacgtgacccagcgggtccggcgcgcgccctaagccggtggagccgcggccgcgcctgtgcgcgagggcgcgcgcgtcccgagccctccacccgtcgtgccggcgccgcccggaccgccaggtcagtctcctccgcgcccgctcggggcgggggcgcgcggcgctttgtggaggcgcgtggggggccgtccgcgcgcgagcccgccgcccgctccgggcacggcttcggggccgcgcagccgggagggccgccgccttccccctgcccgcgcgtcccgggaccctgcgcctggcggccgatccggcgggaacgtgggcctggaggctgccacgtgccggggccgagcctcaggaggccgctgtttccccaggcgagccacagaacacccctggctggaagggggtgacccgctcccgtttctgggtgcgcgggagacctcctaccctgagttcatcctgcgcagggtcccgcccaggatctggctctgcccccattcacggctcattttcctcagctgcacagtttggggggctggaaccccacagccttccgtgcctccagggcgggtcgtagatgtcagtggaggtcaggggaaagcagagcgtcaggtctcaggccgggtggagtccgcctcagaccataccagtgttgggactcgggcggcgcctcagccctccaagcacaccccggtagaatcaggtcagcagccttgatccacgtgcctcagggattaaacgggtgactcctgacacgcccctgggcagctggtggcccaggggtggggtggtggcatgcttagctccaagtgggcagagcagtttcaccctgccggttcccggagggaagccctttatgagggaggcttccctggccctctgtgatagcggctccaagggcagcgtgaggtccaggctagctggtcacagtgtgtgcccgggcaccctcagccaagacagaaaggcacgtgctgcaccccctctctctgcctgcgggctctggggtgtgccccgcacacgatggtgggtgttgggcatccacctagtctgtggaccctgggggccctgctcccaggttggagcagtgtcctcggctgcagaccagaggaggtcactgaacacagggtgcctgtggccttgcacagacagaagccgcctggcagccctgtgcagagccgtgcttcactgagttcctgcaatcctcccaagaagttcgttaaccccatttctcagatgaggagactgaggcccacaaaggtggagttggtgcagcccctagcctgcggggctaagcagagccttgttgtccccatctgcaaagggggcgttggagctgctgtaaatgggccccgaacctgtcacctgagtggaattaggcattggggatctccccatcaccacgccggcccccctcactgtggttacgaaggaggagaagctgccctgtgtaggaattcctgggctgtttccaaatagccccgctagggagctggtcacccctcaacacccccaacgtgttctccaagcacttactctgtgccaggcccaatgctggacctggagatggggcatggctggctggctgagcggggcaggttgcggacaggcccccgcaggcagtcggcgtgatgggagaaaatgcaggcggggatgagatgcagcctccaggtggtttcctcagctgcctgctcctctctgcctttgccctcctcccggaagcttgcgctgaccactggagtaaggctgggggcctcagctggtcccctctctgtcccaagtaacagcccagaacatggtgagggtggctggctgatgcagtcaggcactggacatgggaggcaggaggaaggccgggaggtgggcagctttctcagacaagtgggcagtttggatggcgaggaggtcttggaggcaccatgggtggctgggctcaaagatgacatgagggcatgcttaacagatgcttaaccaaatcctgaattggcattggccaatttctgtggtgtaactactcccaagctacacagacgtgactttactggctgaggacttgggcagaggtgcacacagtcagactgagaggggggcataagctggtgtgagccctccctctcaccgccagggtgggcagagtgtccgctggtgcccaatgcctatgcacgtgacctccttagggacttacatccagatggcggtgatacagcttggggaggcctctccctggttggcaggtcctggcgaaagggtgagttaagtggaaagtgtaccaggctggtgtccaggtggcatttggccagaggggctgagctgggagctcctgggcctggggctggcagatagtggtgatttttcgccccccaagaccttgggcttgccttgttccatgaaggtcccaaatctgaccaaaggctgtaaccagatggtcactgtcccagaccaccccagggcgctttctcacctcgagagcaccgtttctccccacctccaccctggccgcccttgctgtcacctactccctctggtccctggcacccctccctgcctgcagtggtgtttcctagcaagtgcagcagcccgaggctgggctagaggcaggagggcctggcctcccagtgtcttgctggatacttggtttcttgcccctccgtttccacacctgtaaaatgggagcaatgacaggtcttcctggcaggacagtggtgaagcttggtcacacgggtgaacatgtgtgaggtaaaaaagacttcccatccctccttctgacctggaccggctcgcaggacccataggcagggacctgggcaaggtccgagggccgatgagccccgtcctctctgcacagttcagagttgggtgggagtggctgtgggctgcaggaggaggtactgcacttcgcacagttacgtggtcgggttggcatcgccgccgcctgacttcggcgccccgcgagttgggtgtgtgcggttgggggcggcccagagtgtgccccacgcctgccagtcgggtaggccagcctccctggagagaggggggcctccccaaggtgggacggggacagggacgggtgcttccttccacccaggagcctgagcagagggtggagggtcctggcagctacctacggcagctgagagctgcgctctttagccgagcgggatcagggctacgtggacacagcccgtgccagtgtgggtggggcacgagctgtgggttccgatggcccagtaggcgttcacctggcagagagtgtgcgcgtgtctcccctccttggggcgcctcaggtcaggaccctgagaacctcacttatcctttgagctgcgccaaggctgttgtacaaaagacagttcagaaaataaggacaggctgttcctcccagccaagggtgtggccctaaggacccctaggtggggcatcgcttcccgccaggcacgtgccactcagtcttgggctgctttagtggcagcctcctggtttggaagcggaactgagggtcagggatgaccacatggctcagggctcagctggggtcctgagagtgggccctcaggtttaccttcctcctggaggggaactgggggccattgcccagtgcacccccacttccccttaggtgcgtgggccacccctccctcctgcagcccccgttcatctacccaggataggtgcatgggccacccctccctcctgcagcccccgttcatctacctggggaaggtgcgtgggccacccctccctcctgcagcccccgttcatctacccggggtaggtgcgtgggccacccctccctcctgcagcccccgttcatctacccagtggggatgtcccctggctcctctcctggcatcttcccgggatgtaggggtgctcccatgccccccggctcctctcctggtgtcttccccagatgtaggggtgccctcatgtcagggcttatgcttctagaaggagtggaaatgcagcacagtcattgctgttgcctgccaagggccaccctggctggggacagatggggctgcctcccctctcccaccctgtcctggccacctgcccccgccaaccctgccactggctcagaggaagcaggcctaacctgatgtgtaacccccacccctgccgtgactgtaaccccgtgccatgtgaaggtggggctccttggcagtgcctggtgattgcggtacagccagaaccggccccattatctgggctgtgggtgccattggtcaggaccgtgatggactcatacgtaaaacttgatgcattttaactcccttcatcctagaggattgagacctctggcgggtaagtgttcatattaccgtcctgccctagagccagggaaggaccctaggggagaagtgacgtgccagggtcactgctgggaggagagcaggaatttgaacgctggccatgcctcctttttggggaaaggtcagtaaatgggcaggggagggtgctggtcatttgggtgatggtgccagtggggtgagcagctccaggtcatcaggtggtatggaatctggccccgggcagcccgtccagcattcctctctcaccgagcccacagccctggagcacctactgtgtgcctgctctggcccactgggaacaggacagtcccgagccctgccccgaggagctggcgccaagtggagcagctgcaccacaggcacacgggggacaaagggcaccgctgatgatttggccaggaagagatgaggtggggatgggggctacagggtggggagacggtggcctcgggaagggctagcttggccacgccagcttggtcatgtcaccttctgagtctcagtgttcccttctcacgtgggacaagaccacgcataacccgaggggctgcatgtgtggagccgacaagctgacgtgcgggtcctgagtgcactgagcccgctggggttccagacacagtggatgaacgatccagggaaggaaacagcctgggctgtgctctctgggacctgcccttgagccaggtactcctgtgggagggtagccgggctggctgggggcctggagcccacagcctctcctcccttgctgttttcccggccagggaggaagccaggctggaagaccccagagggctagggggatgaacacaggttgatctgtgttgaatttggctctagccacctcctcagggccagagcggctcctggagccggagtgagagctgtgttacacgcagggaagccggggctcggggaaggtggctgccagggtgtgcagggctgtgccaacctcatcctggtgggtccctgtgacaacaggacaggctgcctgcccattgtacaatgagaggctgatgctctgtcacttcatgaggtcacacaggctccaggcagtggggggctctctgaaggaggtcccagtgacctgaatggagcccccgggtgggctgaaacttctgcctgtaaggcctgtcctgggttggggttgggtgggagagggcaggagtcctgctgggaagggcctctgccatgcccagctcctaccacaagtacagaacaatgacaactccgccacctggctgccccacgctgggcacatgctccccgctggcctcagttgggagtccagtgagtcaggaggtgaaggtggggtgcacgtcccctgcagaccctcacaaggcaggtggcggggcgggtattggtcatgagaaccctgccttggggcctgagtgcctcggtggctgtggagcctggtttcgacctctttgggaccagtgttcttgtccataaaaggcagtgatctttctggatagttcagagagattctgttatctttgcccatcagagctggaagggagttgaacaaaatgttttgcagaaattggacctgagttgggcattgctcctcctgctgcccctggttctgagggcttggcaccactagcccgctctctgtccagggtcggcccggctcctgcctttatcatgtgtgagcctcgctgtgtgtggctcagtcctggacgggccgagacctggatgcaggaccctggacagtcagcgcaggcggagcagggagggaggcgtctgcctgaggcctgcttggaggtgcccaggctggagcccttggccctggaagatgtggtcagggcccagtggtgttgggatggccaagaagagggcccctgtgccttctgcccagggcttggcctagccagtgctcagggtttatttgctggatgaggggtggagtgggccagtggggcccaggtctcctgctaggtgaccctcagaggtgggcataacatcccttggagtctctgctctgcacttgccaataagaggctggaccatttgagtggttataagttgggaagcactccctgattgcttggttctgcttgaggcacagcctccaactcccagagattccagcacccctgcaggagccagcgttgctgatgtgggcagacgggcgtctgggaacaccccagactcagcatactagggttcaagtccctgactcccatcctggggcatggagtggcaggaaccagggaatgttctagagtgaggtggtgaggtggagcagggcctgcggggatcagatttccctggggtggggtcctggaaatagggcatcaagaggaagtctctaaccctgggagttggagggtctcgggtccatggctgagggtggatgtgctagaactggactctggaacctgaagacccccggatgagggtgctcagggcctggctggggagactcttgccttgttctccccagtgtccaggcctgggctgcccaggggacacttcagttgatgacgtcattgtccaggaggcttttctcttggacctcagtttccccttctgcaggatgggctggacccactctgtctagctctaccaccccctagtccctctggggagctgcaggagcctgttcccacggcctcgtcctcacccgccacggagacctcgaagccaggcctggcccagctagaggaggtgacgggtggccctgccctgtccctgtccccatctcagtccccttcccacgggaccggtgctcccggctgctctcctggccctgggtccctcctgtgactcaggcttcctggaagaggctcgggagggctcggaggattccccgccaccccacccagggtttctgcccgcctgcctcaggtccctgtcaccacccctcctgtggcacacggtgtgctttacctgctcatccactccgcccttgcccctagagccggtgcctcttactcctggcacccccactctggcatcttctactgatgcctggaacgctggccccctcctctggctcgcctggtcctggggcccctgccaaggcaaacatcttctcctttaatctccccgtcctgggtcagccgcagaggcccttcctcccgggctttgcttccctctggccagctgcccagaggcccatctgctgggaattgccgtgtggagctcagggggtccctgggggtgcccggggctcccggctgcccctcccctcggtggcctccctgtcccctccgcatggccctggggagctacaaggcctggccctggctctgccgactctccctgctcctgccctttctgggcctccgtttttgtgtctggagaatggggagcctgggggagaccccggcccccacagcagatgggtgggatcaggacaaaggcctggcagctgagctccagccacctgagccaggctgcttgcttctgagtcggtgactgcaatggatggacggggtcctggtggcatgccctttactctcttccaggcctgtgacctgggggagggctgtccatgggtgcctcagtttccctacctgccaggttgtgttcttggggcaggctggggacgtgcaatggcagcactgcgggacccacaaggagctcacatgggggagaggcgacatttgaacaacgcttcaaacatgtagttattgttttctcttttttgagacggagtctcaccctgttgtccaggctggaatacagtggcacgatctcagctcactgcaaacctccgcttcccaggcacaagcgattctcctgactcagcctcctgagtagctgggaccacaggcatgcgccactatgcccagctattttttgtagagatggcatttcaccatgttagccgggctgcttctcctggactcaagtgatcctcctgccccagcctcccaaagtgctgggattacagtgtgagccactgcgcccggcccaccactgtgcctggcctgcctctgcgcctggcccacctctgcgcctggcccgcctctgcaccttgcccaccactgtgcccggcccacatctgtgcccggcccaccactgtgccaggcgcaaacgtggttattgttttagacacacatttggtgatgttcattataaaaattcaaacagcctgggaaatacacggctgcagtagctctgggcttctgcttcatttcacaagaaccgtgccggcctcgggtgctgttttacagtgtcacttgaaatttccctgggtgttgactggggtcctctcccgatggcacccttggaccctggtctctgggtctggtcagatgcttgtttattaaccagccatccccccacccccatgatgggctctcctaagtgaggccatggacagccaggatgtgcgtctcggcaccggggtgagtctttcttggcccgctggcagaaccctgggtcagatgggagggttgttggtgcccggctgtgtgtctgccagccccttcatccctatcctggctgctgtgtagctcctgcctccccataactcttggggggctgcccgggtccacactggccccgtggggatggcagtaggcagagaggggcggtcctgaccccagagaaatcccatgggtgagtaggacttgtaggagatggcagttccctccctggagcatgtgtccccaagacttagaggtcgtggtggggcaggaagcaggtagtcagggtgggcttttgggaggagatggcatcacagtacggagggagtcatgcacgaggcaccaggaaggggcaagccgggtgaggacaggctcctcctggggacccaggacctgacggaacggcatcactcttaatggcaccgtcgcgagcctcttctgggccagcagccggagctcacccagggcacatccttaaacctcagggtcccctggtggcagctgccatggtcgtcctgtttcccagggagggaagctggtgtctgaggctggcactctgctaggtagcacagttggggagtggcagtgctgggatggaagacagacaagctggcacctgcacatctgcacgtcctgtcgttgaggtgacctctagccagccagctcatctgctcctttgcagatgaggccagagagacgggagtctctggtgtggaggggagggcactgggtttggtgggctggccctggggtaacttgcctgcctgtgcttcagtgtccccctctgtaaacagggtgtgacgtccccccggccatgtcggaggctccgagagggcagcgggtccatctcagcagatgctctgctgacggatgctgctggctggcccctgctcccaccctcccctcctttggtagcctccctgggccgggctgttcccacggctgcccagccacaggaagccatctggaggccttgtttacccctccccctggcctccctggcaggaagtcaccggaagggccgtcccgaggggccccgggcctgtgaggacagccatcggctcagaggtctgtgctgtggagtcccaggatagcatgcgggggcagggagctcagagaacagcaggtggagcggggctccaaggcactggagcacgtgggccggagcatggacagaaccatttaccgagcgcatccatctgtccatccacacagtcacctacccctcccccgctgtggccccagcagggcccagtcccatgaagctcacagtctcaaggcatggacgaggccactccagcttcagcccaggggggccccgtgatgccagggccattcctccagctcccgggatcccacacctcccctgatatcacacaagccaccctgggtcggggctggaggaggagacctgggcagcagctggggtgtccaggagaagggagttggggagaggggtgccagcagagggtgcagcctctagaaacattggaggccgccctgggtgacgggtctgaggctgcaaggtgtgggtggagcaggtgaagggagaggtgggcaggcacagctggcaggggctgaaggcatggatgggaccagtcggggtacttgtggccctgcagaacccctctctccaccacctcctccagccctctggcgccctgctcagggagggctcccccagataaccctgtaggtctggaccctcctggagtgggctcaggggcctgggtttccactccacaggatgggtccagctgccccggcatttgtggcagccccagtgcccactgacaggcctgagtgtagctggctaggcccagggcctttcccacagacactgccagcagggactacctggccctagggggatctttgacctccgtggggccttgcgccctgtgttcttggcggcctcgcgcctgtcccggcctcctgccttcgggagctgggtggagtgggggcaggcagccctgcccccgcccacatggggaggctgaggattggcccttccgcctctggctacccctcttcccctcccccatacctcctgctcccctttttcctcactttccccccacccctcccccctgcttccgctttctcatccctttagaaggtgcctactcatgatcgtcttgagtaaagccctccctgagagtgtcttggggtttcgggcctggcaagcatccccagcctcccctgaagaggaagtgagcgtgagaaccgggcctttggcggatccaggtgcctgcgggcagcccgggggcttgtttgttgggtgcctggccagcgggccggtccagagcaggaatagatgtctcaggagggtccctggctggtcccaagcacctcctgtgtgcaccagggccgctgttcttccgtccagcctcccagcagccctggggtgtgggtgcctctgattcggagggagtgacgggacttagggttagccagctccccaggtcagagacgcagagccctgggccaaccccaggatgagccccatcagcctctccttcctgactcattcaagatagtaagtgaaagagggcatgcaaccagcacgcagccccagaggaaggctgcagcggcctcgcgcggggccaaggaggctgggcaccgtgtgtgccgtggcactgccctccctggtgttgctgatgctgctgagatgggagaatgttgtgggattctgggggaggctctggtctgagagtcccgagcctggggagatggcctggctgggcccaggctggccacaggggcaccccagacttttttcctgggcatggtgtacagtaagtcctcacatcacatcatccataagttcttggaagctgcggctttaagcaaaacgatgccagttttaagtgaaaattggtttaaggacactagtgttcccataagttgatagagatagataagagttaagttcctgccaggtatttctggtcacaaaaacgtcaccaggcttccaatgaagaccccaaacacttctaacattaaacactgaagtaaatgtgagctacacatacatgtaagaaaagtgaattaaacagggaagagaattgcttccccagctttccgtgggccagtgagtggtaacggaacacacatctcacggcaaccatggtcgggagctcctcctgccaccacgcacttcaaaatcaaacgatcacaaacgtggcggcttcctgtattgccacgcattcgtctgactatgtctatttgacgaatttttattttgcaataatttttattcatttattcattcattttccaacccactaattccagtgcagggtcatgagtggctgagcctgtctcagcagctctgggcacaaggtgggacctgactctgctcaggacaccatcccctctcggggcacactcccatgcacagccacacccactcagccagggccacggcgacacgcctgttcaccggatgtgcacagcactggggtatgggggagccggaggacagggagaaaacccacacagacctggggagctcgtgcacatgccacgcaatggccctgaaagggaagcgatttttttttctcgtcagcgttatcacaaaaccacgttgaaagcaacagtgttatttgaggagctgctgtacttgacggatggtgcaggacaaggtgggccctcttcggggcctctgcgcctctccccctttcagggggttggggtagaaactggatcaaggataggggactctcataggattggagggtccattggggcagggccccccagcagctgagggcctctctccccctgtcctggggtcctggggtctctggcccccatgagtccagctcctgattgctctgccaagtttgctgtcatgccaggaactaagcctttctcctcgtgagctctcttgcacccacagtatagccatggtattcagtaggtgcccagtaagtgtgggctggtgaatgggcctccagggaggtgggatttggatggacagaatggacgggtccttgggaggtggtactgagtcagcagaggcttgggggcagagcatctctgcagaggcaggggctccatcctcaaggaccccctgagggcctccaggaggaggcagccatggggtgcgtggggaagtaggagtggcagctctgagtcagcttgtcccagctctgagctccctcccgcacctacctgtctccactgtgggggccacacagcctttacatataaagggcatggagcagcgcctggcactcaggctgccagtaccaccaactggcagcactcattgggcactgactgtctacattgccaggagtgttcaagaagtaatttaaactgccagaaatcctcatcccacggcattaactgacacctgctttgggcctgaccctgtgcctgatcctggggacctggcatgggtcagtcaacgctccctgtctgccgcccacagtccatgacagggacagacaagtcacgaacagggctgcaggggctgacccaggaatgagcaggacctctctgggactgtttagggctttggccccctggtgagggagcagcgaggctgtggggacccaggtcccttgggccttgcatgcctggctcctgatcctgtgggccccatgcagaagtggcccccagttctttctgggtgcttggcatgtccagtcttccttgggggctccccaggcaattttggctagacacccagcagacgctccttcctccaggccccccaacctccgggtccctgaggtcggagccagttttccccaagaccacccaagcagtgactttgggtccacccacagatgccctggtcactgtgttgctgggagtgcttgggtgagaaggaatggctgcgggcgggtcttcctttcttcatcctcagcatcctcatccatcactgaggatgcttgtctctgccttactcccactcacaggacagtcgaatatgttcacacatccactgagccagcacctgctgtgtacggtgcccattgagaaccagggagccgagggtggagctgtggccggtctcttgtcctgcgtggggagagaggctgacaagctttgccagaagggggacagatgatccctactgtgtgtgggggacagaggacaggtctcggtggctagcaggaggaacaggaggatgctgaacctgagatccgagtggtaagaaggggccagcaccggacgatgtggggacagagcatgctcctggcctccagcacaggcagtgcaagggctcggaggcaggactgtgcttggcaagttgcaggaacagctgggaggcaggtgaggctacagcagatgaggagaggggagtggtaggaggtcagagggcagggagcagctcgcgtggggcctttagggcgataaggatttttggctttcctgagtgacgcgggcaccactggaggctttgagcggagggggctatgatctgacttaggtcgaggacactggtgggggcagtggtggggatacccaggatgccagatgggtatcccagattcttggtgaccctcggtagcccctctgggcggtggctttaggcatctgggctcaggtgtcaccatttcacttgtcggccacccacggctgcttcctgccccatctggggattccggggactttccatttcctcaccttgcacttgattctgtgatgtgcctggactggggattgtggaggcctgtccgtgccctgaagcacttctgagaagccggggagcagttccctggggtttcccctgggaagtcctgccgtcctctttctgctgccacccagagcccgccctttccggagagcagttccctggggtgtccccctgggaagtcctgccctcctgcctctggcccttgctcaagccgcgcccccatctggatgcccacttcttccactctgctctgttggaccaattaggccaactctggggatatgtgaccccagtgtttgtgatcaaacggggcccagactcattgacatcctgcgtgaactacagttttggtagaggtgcaagtggattctgtgtggcacagaagatggcgagtggtgacggctgtgttgcctgcatgccaccgacagcccgcctcttctttccatcttaatccatcttgccagctctcaagggctgtaggcacttcgccctgaatcctcctctgagccggctttgcctcctgctgttcccactgagcgaattaaataagtctttgccctgtgcccactgtatgtgcaaggtcatgcaggttatgctttgaacttccaaaaatgcgctcagaaatctttcctgtcctctagggcccatctctgatgccaccttcaccttctggattctctccaggggaggaggtcaggcccttgggaggtaccctttgccctctctgctggggatcctggagagtccctccccaactcccctggccactgggacctctcttcctccctgacctgcccagcatcctcccttggcagcctggcacagcccggacagaacctagaaggtgtggattctgcctgcctgccctgtgtccccacagtccacatgctggcctggactctcaggcctccccacctccagtccctctcctgccctctccattccttcacacacgtgggcacaaagctggggcttctgtaagggtgcatctggtaggacctcaacctcccgtacccaatggggtcttgggagaacagaagttgtgggtgatggttaaggtgtagccctcttcccaaccttgcacagccccctggctcagtccctgagggtaaaattcagacagagctggaaatgacccaaatgtccatcagctgaggataaacgaaatgtggcaggcccacagagtagaacaagcttgcccagccagcagcgcggcccaggacggctttgaatgtggcccaacacacattcataaactttctattttttttttttttttgagatggagtctcactctgttgcccaggctggagtgcagtggtgggatcttggctcactgcaacctccacctcctgggtttaagtgattctcctgcttcagcctcccaagtagatgggattacaggtgcccgccaccacacccagctaatttttgtatttttagtagagatggggttttgccatgttggccaggctggtttcaaactcctgacctcaagtgatccacctgcctcagcctcccaaagtggtaagatgacaggcgtgagccaccgtgcctggccaaatttgtaaactttcttaaaacatcatgaggttttttgttgttgttgttgttcatcagccatcattagcgttagtgtattttatgtgtggtcctaaacaattcttccagcgtggcccagggaagccaaaagattgcacactcctgcagtagaatataggcggccaacaggtggagcgggcacagactcaggctgcgccgtggctgagcctttacgacgccaggagaagcgaaaggaaccaggcgcagagggccacgtggtgtgtgaggccattcacagcaaatgtcctgaacaggcaagtccacagagacagaaagcagacttgtggttgccaggggctgggggaggaggggtggagtgactgctggtgggagggggcgatggaagtgttctggaattagtggtgatgattacacagcactgtgaatatattaaaaacactgaaggttacactttaagatggctaaaatgactgggcctggtggctcacgcctgtaatcccagcactttgggaggccaaggtgggcggatcacctgaggtcaggagtttgggaccagcctggccaacatggcgaaaccctgtctctactaaaaatacaaaaattagccggttgtggtcatgggcgcccgtaattccagctacttgggaggctgaggcaggagaattgcttgaacccgggggcggaggttgcagtgagctgaggtcgtgccactgcactccagcctgggtaacagagcgagactctgtctgaaaaaaaaaaaaaagactaaaatggtggatttcatgtgttatgaattttatctcaaaaaataaattaggatagcacccccgcctacacagactctgtcctgagcagctctcagaagtccgtaaaatagggtgaaagtgtcgttgccctgcccccgggttcccagtgctgtggggacgtcaccagctgctggggaacagagggatgctggcacccacccagggctcagggcagggcaggagcttggtgtgcgctagagactagagtgagaaggcccttccccggccctcacagagtgccttgccactggggagttgagtgaaggcacagacaaggttgtgaggtacccacgctgccgtgtagtgtcaccacgccctgatgtgtataacctgttttctttgctcatctgggtggactggtggggcatttgattctggagggtggggttccagtctgcatggttccctggggatccctggccccaacatgaaggcagtgtggcctgagggcctctcagtccccaaggtgctgacccaccgctgcctttcccgagtcctccctgggccctgctaggggaggcctgggagctgcagcatccaacaggcccgtgtgaatggcctggccacagcactgccagacagggcaaagttcctggcccggggctgtctctgagccctggagctggcggggtagggatcagctcctgtgagctccctccatccccagatccacccttcaggtccagggctatttggtggcagctcctggtggggcagggggatgggagggatgggagcctccatctgtggacccggcacccagtctgcctgcaggcctggtgattgtggcccgacctcctgcccaccccttctgggcaccacggcgatgcccagagcccctgaggggctgtgcaggcagggcataagatggcagagggctccacatagcccctaggctggcaggatgtgttctgagctgaggtcctctggaaagcgcctgtggatttctggcccctccctggtgtgttccccacctgcctgctgagccttcagatgcctgggagagcaggtctcccttaggtccgctggttctgatggttcccctccttctctcctgggagctgggcaggtgctcaaagcgggcagtgcaggctgcccagcgtgcccagctcccaggatgcaccatgtgacccaggccccctcctgccctgcttgcgctggcgaggggccgtggctgggtgcccagcggtgcctgcgggggcccactccctggggcagtgcctgcctgccacccacctgggctgggcatccagtctggccttggctgttgtcatggcagccaatgcctgcagccgggagctaaacttgctaccctcaagccactgtcaccacggctgtgacgaacatggggacatacagcctgggtcggggaggtgaccaggcctggctctgcccagcccctgctgcggacggtcaccgcggtcacagcccacatggcctgcctgccaccccctcatgccatggcctgggctgtctgaggttctgtgtcatggatgaggccccaggatcacagaagtgcccacagccacacagacgggcaggagtcgggaggccccggcccccaggctcccagccagactgggggagtggggctggcccaatctggagttgccaaggtggggttcggtgaggcaccattgttgctagtgcctggtttcaaaaacattccagaaatgccctgctggccacctgcctggctctgaggtccccacatctgtggaggaacaggggctttaagaagccctgcggggaagaagccccatccacgcaggctcccctgagggttctgaggcacctgctgggaactgtggtcttcttggggcgctcggtgtcctcacagcccctgtgggtacctggcaaagtgccagtgttccagggactcaagcgaggcctcttggaaagggtaataatgtccctcagatcccaggagaaaaccaagggcaggtccatgaaggacagccttccagcgaacccatcctacagacgagcacactgaggcacagaggacagccttccagcgaacccatcctacagatgagcacactgaggcacagcgaggttgagggatgtacccatcacacagctcacaatggggagccaggaggggaaccaggtcacacagccctgtgtgaggacagtggccatgggctgagcaatggccaggccttgcgggtggaaaggagctgtcccctcccctggaccccagagaacccacctgccttggctttgagctgagctttgagccggggtcactggctgagtctcgcaccctctctgagcctcaggttccccatttgtcagatggggaaggccaagacccagggtagatggagcctgagtcagtgctggcagcactggcgttgtgggctggcaaggcgtggggcacctctgtgtgcatggggtggacctgtgtgtgcctagcagcctccctgccacaaaccaccctcctcctgtatgccagggtcacaggagctgaagacagtggccgagccccgctttttctgccccctcttgattgtttcagggacgaggtctggttctttgtcaacccaagtgcccagcacaaggcttggcatatggtggtggcctgtaaaagccagtgatgtgactatgaaaccaatccactcatagcactgcacgtgctttttgggagggagctggctcagagaggaaaggccatcagcactggtccccccagtaggatctaggcaccatggggaacctgcgggcccctccagcccctccaccatgtgtcctgggggtagccctatccccctgggcctcagtggcgccgtgtgcactggctctgggggtgccaggctgcgtctcaccatcgggccagcccagaaatagctgtgaccttccgcagccagcttggcagcgcttggggccaagaggcctacgtgcatgccggctgagtcccctcaccgtgcagggctggctattttggacgtggcctcccgaggccaggtcagagctctttcccgcggttcctcaggcccctctgacgtgcgtccactagagcctcggccagtggccctggctagctccatgatctcgatcccccttcctgtccccgaccccacgggccctgggtggcacagaggaagggatcccagggactgagcacagggtgaccgcgcctgctggggctgacatggagtgtagggcttggctgttttaagaagaaaatgcagagaaagtgcccaccctgggtaggccctgaatcctgtctcagcctctcagagctctcgctgactgcacagcctgagcctcggtttactcatccacaaaatggggtgatgggcgccttccaggactgctctgaggatggacatgggcattgcctgtgctgagggcaccacgcgaggccactacacagaggggttcttgggccttctccgccttccatgggactggacactgggttcagggaggggcgtcatgggtatatgggggtgctgcgctgggcagtggctaagcgtgggctcttccttttctgtgacacagcagaggtgtacatgcctgctgccctgtccagggcgtctgggtatggtggaagtggccccaaggtccagccaccctcagggaccacaagcttcctggacaccctgctgacagggtcccactgtggaggaacaggccggcccagctccccacctcccaagtgagcatgggtggctgggtgggcgtgagggattggctcccctgctagagggcagaactcctgttcccgtgaaggtgctgggtggggtgtgagtctgctcctgggtttggggtcaggcatgccaggaacagcaagcaggggctgcctgcctgcctagtgctggctgcatgctcatggccctcagggccctgtcccctggatggtccaggggtcccgaggaggagccatggcctcttctccgtggagaggccctgtgggcccaaggcctggctccatccaggcaggcacatggaattcagccaaactctggatcctttctgcagagcaggcttagcttgagccctcccacagcgagctcgcccactgcccaccctgccctctcagcctctgtgacaactctgtgggcactgccaggggcagttcctgtgtattctcatctggtgatgggttcataattctcatgttgtgtgggtgactaacaaggtctgggagctcaggagaggggcccagaggcacacagcatgcacgggacggttttgcagttcccagggggcacctggggtggaggcttagccaggcccagtgggctcagggctggcctcatgcccttcccctgttgtggaccactttggggcctctggctgatgctggtgggtgaggaccttcctgggcagcctcctccggccagcaggagggaccatcaggccatgcggacccttggagagcttgggggtcggttcctgccctggagtcagctgtgtctgctgagggtccactggtgtgtggcacagaaggggtaggggctgtgcctggtgtgccagggaggccctgaactctccgggaggccagatcaggggcctcctctgggcctgctgggggcctctgcattcttggcagggcctcagggactggggcggggagaggctccttctcagaggctgtgagctccgaatgaaactccatgccctccgggacaccatgcccacttctgggtactggccttcaggggccttggatgtgggtggcatggcactggctaaatggggcccaggaggaaggcagcaggaccgtgggcatgcaggcctaatgccagggccagggcaggcttcatgtgggcttcctcctgtctggaatcctggagccgcacaatttccgacccaacaccccgtactccagagcgactggctcttaacggaagctgctgctggcaggtgtgttataacagagctctggggtgggaggctgggggcagggagggttagggccgtcagaacacggctccctcctgcccagggcaaggtggggccacgtgtgcgcatgtgagtggggcacctggtctgggtgtggcctgggaacctgcatgttacagacgccatggctttggaaacactcaggagtccagctgtgtctgttccaagatgggtcagggttgccgcagggagggcagtgactggtccacagctggtgtggctgtgccatcctccttccagcctgggcagaggccttccaggcaagatgaaagatgcggtatggacaggaggacatggaggattcagggctcttggtgtaaagatgctgtgtggacaggaggacatggaggattcgggctcacggtgtccctggaggctctggtgggcgtcgtggggctggactgctgcggggcaatggggtccccatcttcccggcacaggcatctgatctggtcatctgtttctgtggcgtgtgtgtgtgtgtgtgtgtgtgcacgtgagcacacatctctgtgtatgcaggtcagtgtgtgtgcttgccagagcttcccattgggcggtttccacactggcttctcagtcatcctgggaggtaaggcatgagcactggactgggagtcctgtctgagccaccgacttggcctgccattgtggagctgtcctgtccactcgctggacattaggccatttgtgtacaataatcccctgagatttgtatcctcccatggggagatcaaaaggggccgagtgtggccctagggtctgggggcccagcctggtgggtagacctggcttctgggactgtagtggtggaaggtggctggggcaggggaggttcactcactgggaggctggaagaggtggcccggtagggagagagaagggcagccagacagagggcacgtgggagcagcagcctggtggcaggtgtgtgagtctctgcacctggccggggtcttgaggagcaggagaggttcgggcaggtggctgaggagaatgcgggcactgagcttgggaagagccctggactggggggggggtagggactgttgggcagccccagactggcacaggtggatcgggtgcctaggcagggggtggtgagttatggcgcagctgtcttggtggctggggggagcagggataagggtggacttcttagtgaccgctctctgccccaggaggtagagtcctgggggctgggctggcctgagagacgccccctcatcctttccagggtgaggtacgagggctccgccccctcctgatatcaccaggcctagggcagcatcctgatgggggaggggcaagtgacccgggccctggactgcaggaacagcccctcctccactggtggagttcccacttcctgcggaaggaactatgttagaagttgtgtatatggggtgggggttgggtgtgggtggcggggggcctgggtggggtccactgagtcgcctcccctgtctccctgcacttcctcctggaggaaatggggacaacaggatgaagtgagggcctgctgagcccagggctgccacctgggagtgaagccggggcaggctgcagggtccgggcccttctgtgtgggcaggtggaagtggtggggatgcagtgaggctccctccagcgcggcaaggaacgggccctgggaccctcttcccagcctgcagcaggcagtggggagacaggccggagccctggacagcccccagtctttccccaccccaactacagggcctgggtctccgtgcgccatccccctcccgccccctcccgctcgctcccgctgttacagggccctagggaccgccctgtcccccgtgggccccagagcccaggccagcgctggagggaccctcctgccctctggccgggaccagggtgcccgccgcagccctgggaccctgcggccccggtccctattcgaggccccagccggagcgttccgggatccttcgggggagtgcccagccccgcgcccccgcctcccacatgactccgggtgggcccttttgacgtgcgcggagggcggggggcagggggcggggcgggggggcagggggcaggggtggtgaagggtagggggcgtggcggggagaggggatggggtggggtggggactggggtggggtggggtggggagagggtgtggggtggggtggggagagggtgtggggtggggtggggagaggggatgggatggcatggggggatgtggcagtgaggaggctgggcccttggagctgccgagtgcaggggcctggaggactccgggaaggcgtcctagtgcatcaagcgtgggcttggcctgcttgggtctcccctcctggcccccctagcaatgggcggacttgggcccgctctgggaggattccaggaacggctcctgcctggttataaatagacttctccgaaaggcctggggctgtgccagctgcagcaggtgcctcccaggcccggccagagggccccaggcaagggggtggagcccgggtgggggtgatgaggatgctggggtccacttttgtagcgccagaggcgacgggctctgtctggttgtagcatcacagagcttgatgggaactttcactctgagaccccttttatggataagaaaactgaggctggggggcaggagcagcttaccccagaggtcctctctcccagagggctagggtggggataagcagggtctcgggggcagcaagacccagctccaaatgtggtttttctgccttctggctgtgtgactcagaagggttgctcagcttctctgtgctgttatggtttgtcagtgcagtgtggcaggtgtgtgtcttgcttgtggaatgcagtgtctagcctggtatccttagaaagtggctgaggttggagattggtggggcagagtccctgaagctgacccattcttgccttcaaccttcagggagacgctgctggaagtggtgagctgagagcactgggcaggagtcagagcctagcgtctccctgtggagctgggtgcacccacgtgggtgggtgcccttgccagggagctcacacccttgggggtccatgagctggcaggcagggctacctggcttggtgtgcccttgggtggaggctcccatggggcccttcagactgggcacagccctcctgtcctctgctccccagcctgcttgcccacctggaggtgggaggaggcgagggttgccggcacagctgggccaggctgatggtgatgttttctggaagtgtgggtggggagagcctggcagggggagggggggtcgtgctctcagctgggccccttgatgacctcagattgcagggaccaggttgtttgagagctgcaagcagggccacacctccagggaccctgtgctgggggtaccacccttgccgctccaccctgctctgagggccctgggtggccagggcgggcacagagtgggtggtgatgccagctgcatccctggggttcatagtctggggagcacatgagttcccggcacaatgctcccaggaggcagagccaggagtcgcagggaggcgtttgcttgagagggtctgggagggcttcctggaagagggggcatcagtgccgagcctcagagtttgtggagcccgccgcctggctgaatcctgcctgccggtgttacctcagggtgttcctcgttgcagtgcctcagtttcctcaccagtacgctaggagagaccagcgtagccagccacagcggggtcgtgaggattaagtgaggggacagcagtgtctggcacggtgggtgctgagtaaattcatggaggagtgcccgggcggtggggctggtgggctgggcagggggtctgaactggagggactcgggcgccctcctcctcagggtgcaggacagcacctgcacggcggggccgcatttccatttccaaagctgggcgcgctctgtccaggcctccccaccaggagcgcggcccggcggctcctgccctccggacccccagcccacaggcccgtgcagccccatgagggggccagggggagctccgaggttctagggagggcgcgcaccgggagagggcgccgggccggccggcgggaggaaggaggggtcccgggcggcagcgcccccggccctcgccgcgccccgcacttccctttcctggctgggcttcctcttccccgcgcccgccctgcgcggcccctttgtttcccgggcagggcgcggctatatttaggcggcaggtgtgggagcccccggcagccgggtcgcccgccggtcacgccccccacgtgacgcccgggcgctataaatagccgcaggcggcggtggcggcagcgcctggagccggctccgcggcggaggggcggcgccccgacccagggccagcaccgtgggcaccgccaggccggcgcgtatggaggcggtgggacgcctgcggcgcgggtgagcctggcaggtggggacgcggcggacccaggccttccgggaccccagccccgccggggaggaggtggcgccctccggagggctgggcgggagccccgctggcacccagggagggggccgcgccccttaccacgaccccacccgcgactggttccccgggactccccagagcgcccgcctcagccctgaccgcggcgcagcttacttctcctgagacccgctgagccccgggcctccagcctcctcccccaaaatcacagggggcgccctgtctgaagcgggggctggattcaaacttcttaagctgctgtgccatcgggaaggagggcggtagcctccctgaacctcgatttcctcttctgtgcagggcgctgcgtgttgttcctgcctcctagatttgagccagagagaacccagttaactggacgcctggtgtggccctggtggagaatgttctcccctctccctggcttgtttcctcatctcgcaaacagggacaaggatggactctcccttaaagggtcttgagaaatagctgagggctctgggcctgctggcccgaggaggctgagccagatcttgggaagggttctgcagggcttggtagcaggagggaaggaggtagcaggagggaaagaggggccacggctgccagtgggtccccgtgctgtgggccgcgggcctggtgggggtggtagcgactcaggacacatggaggcaggggcaacctgtccccatttcgcagatgggaagcctgaggctttggcttcagggagttctcagtgcccatccctggggatccttaacccttgctctcagggccctacctggtgacctcactgggggcgtgtggttatggaggggttttctcccttgggggacagccaccaggcagggcagagccacatagtggtgccagggcatcattgctttgctctcacctggggcaggggtaggggccctaggctgcagagacaagtgggatgtgtggcaagaccctggtccagcctctccctggacccctaaccccattctagcctgggctgtgacccctgagcgtagcccaggctaaccccctgattccggcagatgtgtggcatccttaggccttcagtggggggtagtgtggggtggttcggagcctcctccctcccagtagcctgcagccctgaggacctgtgcagggccactaggcagcaggtccaggccacgtgctggtgcctgtggggtcttcctgggtccctggcagctgtaggtgtgaggggttggtcagcccctcagggagaggcccaatactgtggtttctctggtgcttttcttcctttctttctgtaaacatgagctcggctcccgtgtgcacacacacagggacatcctgctgccccaagagggacccaggtgtttgtgtgctgttagcacgtggtggcttccctcacccacactcagagcctgtgctccctccagtcgggcaaggtggggactggcgggaccagggacagtatccttgtctccacctttacctccttctgggggtcccaccccaccaccggtttttttttttttttttgagacggagttttgctcttgttgcccaggctagagggcaatggagcgatctcggctcactgcaacctctgcctccagggttcaagcgattctcctgcctcagcctcccgagtagctgggattacaggcatgcacttccatgcctggctcattttttatttttttatttttagtagagatggggtttctccatgttggtcaggctggtcttgaactcctgacctcaggtgatccgcccgccttggcctcccaaaatgctgggattacaggagtgagccactgcgcctgacacccaccgcccattttaaccttcccagaaccatgcagtggacagagcctgaggtgtggcggctgctctgagcccatgagcactggctgccacccagggtgtggagggcaggcagggaggagcccactgtcccaggtagccaccctctgagtccaggggcccaggcctcaagccctacctgcacctgggctgaagctccaagggcccagcctgcctggtgggcagctgggaagggggtgctggggctggggcaggggcacaggtgagagggggtgggttggggaatggagggctctgctgggcgaggggccctgaagtgcctttccttgggtagcaggcagtagtgacagggccgggcttgggttgagtctagggggctggagagtctgctaacagctgggtcacagccagggccagcagtgcggggacccctcagcagcagtgcccaaatacagcttgggtcacttgtgtcacccctcatcgtgctcatggggtaacaaagaggccggcaccttgctcaaggcctcccagcccttccgtagagagggaagggggctgcgtgctcctggaacccctttgcctgggagctttggggtcatgagacccagaaagggagagaggcaggcgtggaggtgccttgggttgctgtggccccccctgccgcctcccctcttcagggccctgtcatggtgtgaacccactcctggccacctgtgctgtcaccaccttggcatgtgtgcctgatggctggcccattggcgtgttctgtccccgcctccctgagctcctggaggggcagagctggcctgtttatccccgagcctggctgagacctgtgtgagcagtggagacacagtggcggggggacactggtggacagggggctgctgacaggcaggagactttctgcagaaagcaagaggcgattagggtggcccacggccgcgtgtggggccaggcccctcacctccctgtgctggcagcactgaccgagtgcctgggccccattccctgaggatgggccacccagagacacctgggctcagatgttcacagtggctgagaatcggaagaggagagggcagctgtcctggggtggagtttccgcagatcacagcaggtgggcaggggccaggctcaggcttcttaggaactcggcctctgtccccacagagggatctgtcatctgtgtgctggggttcatcatgtcctcgggggtgtgtgtgtccctgaaatccctgtcccctctgtcctccgtcatgccctgctggctgtgtggtggctaccctgtcgcctctgggccctgggtcagtcctggcaggagccgtgcttccttgtgctcccatataaggaaatagacccaaaagggtcattctctcagcatggtcaggaggagggctctgggagaggtgtcgcctgtgactgtgggctcatgacaggcatgaaccccttgtgggaggcggggccccctgtgatccctttctattcatttccttcgtctttccccacagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggtgagtggagacggaggtgtggcaggcaggtggcccaggtgtctgggaagcccggctgagctgccctcaggcctcgcaagaggggtccccagccccggctggccagacagggctcacagccttggaacaaagcccagtcgcctgttacaggatcctggaggagggagatgggggtgccccgggggttggggttgagggtgttgggggatcaacggggtcccctgggaggcctgcagggggctggcgtgtgataggagggactccacgctgtgtggatagaggcagggggtgaggcagggggatacatggaccaggctgtgcgtgctcagccgtggcctgggctggggccctcccgagccctttgctgtcccagatgttgctgggctctggatgaggcctcaggttagaccaggctggactaggggcttcagggcccagatctctgtgtgaggagggactgagcaagggtcagcgctgaccacaggagggagggaccactgtgccctggagaggcagcagagatacctgccgctggcaaccctggcagatgggacgagatgcgtttacagaagctttcttgggagtggagtctggagcgacctgcatggcctcctggaggagcctggcctctgcagaacgccctgctgtttgcaggcctggggccgtttgcagcgtctgcagttgtgtgcggggccgttgacagagcctctgactgtgccaggctgtgtgagaggctgcagctgtgtgcagggtcatttatggctgagtcctttcccctgtgacatgagataagccatcatggtcttgtcataatgaaacagatttgggcgtgagagggcattaagaactgtagagcagcaggaggcattgggcaccttgccatcagggagcctggaccctggacactgagccaggtgccctacagaagatggctgtccctctcgcagctgagacccctgagataacagcagcatctacagaaagattggcgagaacagcacggtgagtggccagggtgaggcctcagaatatgactgggatcagggttaagtctgtaaccaaggtcaggtctcagtgtgtgaccaaggttggggctcactgtttgaccaggatcagggctctgtgtgaccagggtcagggttcggtgtgtgtctgggatcagggctcaatgtgtgaccagggttgaggctcagtgtgtgtccaggatcagggctcagtatgtgaccaaggttgggactcagtgtgtgtccaggattagcgctcagtatgtgaccaaggttggggctcagtgtttgaccaggatcagggcttagtgtgtgaccagggccagggtttggtgtgtgtctgggatcagggctcagtatgtgaccagggtcgaagctcagtgtgtgtccaagatcagggttcagtgtgtgaccaggattgaggcttagtaggtgagcagggttagggagggctcatcctgtgaccagggttaacgcttagtgtctgaccaggatcagggctcagtgtgtgacccagatcaaggctcggtatgtgaccaggattagggctcaatgtgtgaccagggttgggggctcagcacgtgatcaggattagggctcagaggtgtgtgactatcaaggctcaggacgtgaccaggatcagggctcagtgtgtgaccaggatcaggaagggctcagcctgtgaccagggccagggctgagccgtgggctgggtggccattccctctgctgagggtgcagagggcctctgaggtaccccatggccacagagcccagcaccctgcctgctccctgcattctcagatagttgggtgctggcctctctgtgttccaggtccctgtcccgtgaccagcaagacccatcagctgattcctcacccctcccaaaatagctacgagagcaggtggggtgggaacagcccccgcacgtgacccctgtggagtggatcctccgcagtgggggtataactatcggcctggctgtgaactaccaccaccttttccctggtcgtgtggggcttccctgctggcgtacagggcccagcttcctcctggctgccatctgagcggtgcccaccctccctgctctgaggcgccccagctgatgcccgcccctcttagaccctaaaaactggacccatccctgcggctcagctggggtcgctgttcggatgcaggggctcacacgtgggctggggagtccagttcctgctgtggggacccagtagcttttctggaagaaatgtccttgctggtagatctggggtcctgagcaccccagaggagggagtggtgtgctgggcagctggggtcccagctgccagttaccgtgaatgtaggtggggacacctttgcctctgctgggtggcccaagggacctaggacaggctcttcgacagccagacactacctcgaccagtagtggagcctgaagtccactcttggtggacctcactgcatcagggtctgcctggctggagggtgacatgcccttccctgggggcttcaggggccatgaccctgccccaggggactgaggggacagggctccaccccgagaggtctgaggggacatgtccaagtcctgggtgactgtgggggacacagctgtgccctgggagccctggtgagtgggtcctgccccctgagccctgcagccccagcccagccctgcctcctccgtcctcccacccccaggacctgaagaagtacggggctaccactgtggtgcgtgtgtgtgaagtgacctatgacaaaacgccgctggagaaggatggcatcaccgttgtggtgaggcgcgcgccacggggaccctagtcactgctgccaccgggggagggtggggcggggggctccgggcctgcgcagagggtttggtgcccctcctgtggcagccctgggcatgtctgtgcctgggccacgtgtgtgtctgggtacatcaagggaaggccagggtgttgggccgtgtgacctcaagaaagtcacccttgcgcacccgtctttctgtctctagggtgggccagcacggttcgccaggcaggggtggcacatgcttggtgcatcggccaaggtggcgggtgggctcctctgcctgtctcaggccctcctctgggcctgtcttgggtgcatctcagtcttgctgcctgggcggctggggccctgttgccaggcagcaggctcctggggagggcccttgggcagtttcctcggcttctttggccctggggacccaggtctgggcggggggtggggcggttctgctgcgatatccttgggggggtgggccacagcagctgcaggcccagagccagccccaggggggtccacccccggcccggtggacgactgcccccctggtgcaggcctgcccagctgcgcctgggcctcagtctcctcagtgcggagcacccctcagtcactgcttttcatcccaggactctgcttttggctggggttgcagttttgtgacctcagcttggcggtttggaatggtggcagcgctggcggtttggggtcagacaggccttgggctgcgtcccgcctctgccctccccagccttgcgaccctgcaggtcactccgagccttgggttcctcacctcaaagcgaggctgcttggaagaatgggaggcaaaggcatgtccccgcttctcgcacggggtgcgcccacaccctccctccccttccacagcagcgggagggattggggtcagacgtaagtagccgtgacaccggttgtctctaggagttgccctgcctggaggctggggaggggtgagatgcccccgagggctgtgtgtctgcctcagtgggcccagcgggctctccctggtaccagacagccccatgcctggcacagtccctgcatgaacccgccttcccaagactgaaacgtgtccactcctactgcagcgccctggcccgggccctcccctaggaagactcacgttgcccaccgatctagggcgctgggggacgggacagtgggaagcacaggtcatcttccaagaccaaattaacccccaggagcaatgggccggggcccggtggaaccgcctgtttcgagtcctgccctcagaaatgtgggccctgtctcgccccacagccctgtcttcagtccttcctggcacctgggctgtgtgtggcatgtgccagccatctttgcatgccagcacaggggatgagaccctttgcaccagccgacccaaaacctctcaggctgccaccggcacacaggcgtgagggattgtgaccccagaaccagagctcgggctgacaggtgtggggattaggatttgtgcgactctggagcaggctctattcagaaaggggtggggtggtccaggaaggcttcctggaggaggggatagctgcagtgtacagggaatgatgaggagtctgaagcactcaccatggggtgcccataggcaagctgtgcccctcctgtgtgccctctgggtctgctgcccccaccctagtgggctcctggcaccctctgcctctcagagctccctttcctcgcctgagccccagagccgcctctctaccctccctcagccgggggtcctcatgtctgcttccctccgtaggactggccgtttgacgatggggcgcccccgcccggcaaggtagtggaagactggctgagcctggtgaaggccaagttctgtgaggcccccggcagctgcgtggctgtgcactgcgtggcgggcctgggccggtgagtgtcggggcggggtagggctcgccatgtcaggtggttgggcatctcgtggtctgacagcctcgcttttggatgtgggtcttgaacacacgtccacgcgaccttcccaggaggcccatgcccctagtgctggggctcccagactggtcctctcccagcatcacagagaggaagtgcttcccaaagtctaacccaacttcttcctgctatggttgaaaccatcctgacatcttgtgtaggaaagggctgccgtccccctctccagacacaaagatccccccacacacagctggggcctcagactccctgctgggagaacgggaggaagaatggcagctgggatcggatgacatgaccagtgggacacccccatctgcagagggagacccaggcgagcagagttgatagcaggcatggatccggctcttagcacttcacccgccagctcttatttaaccctcccccagcagatcacagagaggttgcctaggagggagccaggatttagacccagtgctcaggctgggctgtgaggctgtggcctccatgggggagcttcaggcaggggggattctgggccccttgggcccccgtgccctgcatcttcagcaggtgccctgccaaggggacaggggtgcgcaggctccgatgacccccgccctgctgtttgcccccagggctccagtccttgtggcgctggcccttattgagagcgggatgaagtacgaggacgccatccagttcatccgccagtgagtggccgcggtggtggggtgggctgtgagcgctgggggaggggagatccggctgcccacgaagggtggcggcattggctgtgtggttccgtcgctctgaggctgcgtcgatcagcacaagctgggccttgctgcagaaacggggaagcctgaggtgtttctgatgggtggggacagcagcccccgagtgaccatgcagccacacagggacacagcgaggccacccgccacgccgtcctgcccgccctccacagacagagctccttctgtcgcagccatcctgacgggggtggaaggacccccagagccagccagttcagtccctccatgaaaaactagaacctgaaaccccacaccacaccgtgtccacccccagggacgctgacagtgggctagtgtctcaggactactctgagtctagctgctcaccacccctccccccaaccccgagctctccagctcagcccctccccgccctccttagaggcttctaggccagctcgcctgccccatccctgtcacttggtggcctccctggggagggctgccatctgcccactgcccagggggtcctgggggagtctggccgggatggcagggccaactctggaggaacggatgcggcacctgaagcctgcccctgcccagcccaccatgtgtgtgcccgtgagtgtgacacacctgtggtactcctcggacaggcttggctggtggggccatctcttcctcccagaggcaggcttgttcccagccatgccagctggccctgtgggtctgtgtgagagtgtggcccgccctgtgggtctgcgagagcgtggcccgccctgtgggtctgtgcgagagcgtggcctgcaggtgctcaggtctccctggggaccatgggatgtgcacgctcacacacagacacgcatgggggtcatacaggcacacattcacaagcacatgtgtgcccacacagacccaggcatacgcaggcacacactcacaggcaggtgtgtgaacacaggcacatacagacaagcgggtatttgcacacatggacacacatggatgcactcaggcatgtacacacgtgtgcactcatacatgacatgcactctcacacatgcgggtgcacaccttccccgggttctctccccaccccacgtctcaccgagcaagggcttgtctctcccttgtggcttttgctgtgtggctccccgcacctgaggctgcgctggtcaggacaggttgggccatgctgcggaaacagccaggcctgaaccccaacgactcagaacagcacgggcgtttcttgcccctgttgcgtgtctgttggtgggggccctacccggaggcgtggctgagggctgcgccttccccagtgtgccggctgctgggcgaggaaacgagcacggtggagccacacggggcacctgcagctttgctgggcagagactcctcgcgctactgctgctcccacttccttggccagggccagcctgtggccacgcctgaggtcatggcaggtggggatggatgagcctccagaggcgctgggtgggcagcccccgcccctcaacgcctgtcacctcagggcctctcaggtgtggctgcagcatcctctccaggaagtcttcctgttcaccccagccaggtacatgtggtcaaggaccaggtggcggggcagggtgagcacatagcccaggtccctgctgtaaggaccaggtggcgggagcagggtgagtgtacagcccaggtttctgctgtaaggacccggtggcggggacagggtaagcgcacagcccacgtccccgctgtaaggaccaggtggcggggacagggtgagcacacagtccagtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggacctggtggcggggacagggtgagcgcacagcccacgtccccgctgtaaggaccaggtggcggggacagggtgagcgcacagtctgggtccccgctgtaaggaccaggtggcggggacagggtgagcgcacagtccgggtccccgctgtaaggaccaggtggcggggacagggtgagcgtacagcccaggtttccgctgtaaggaccaggtggcggggacagggtgagcacacagtccgggtccccgctgtaaggaccaggtggcggggacagggtgagcgcatagcccaggtccccgctgtaaggaccaggtggtggggatggtggggacagggtgagcacacagtccgggtccccgctgtaaggacccggtggcggggacagggtgagcacacagtccaggtccccgctgtaaggacccggtggcggggacagggtaagcgcacagcccacgtccccgctgtaaggaccaggtggcggggacagggtgagcgcatagcccaggtccccgctgtaaggaccaggtggtggggatggtggggacagggtgagcatgcagcccaggtccctgttgtaagggaaggtcgcgcagctgggctggaattctgggctcagcccctcccttactcacaggccccccttcctggatggtggaggtgcccaggcaccacccttgttgtctgctcatggccttggggtgggtcctaccgagctagggaagcctgggggccgtagggagcccagagtcagcctggaggaggtggcgctttggtgagtttggaaggcaagcaggggtgagctgcagggggccaggaaagggtgactgtgactctgggagcagccgtgccaaggccctgggacaggaggggcttggccagcctcaaggccttactccagcccactgcactctcagattccagctccctggggcaggtgagatggccgagccaggtccttggatgatctctgttcctgttcccctcttcccaggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcc

SEQ ID NO: 356 - DNA, 17429 bp, Homo sapiens
aatcccctaatggaagaaaaaagatttgctctcaatttttacaaaacttcttttttttataattccttttttattattattattttactttaagttctggggtacatgtgcacagcgtgcaggtttgttacatatgtatacatctgccatgttggtgtgctgcccccattaactagtcatttacgttaggtgtatctcctaatgttatccttcccctctcccctaccccacgacaggacccagtttgtgatgttccccatcctgtgtccaggtgctctcattgttcaattcccacctatgagtgagaacatgcggtgtttggttttctgtccttgcgatagtttgctcagaatgatcgtttccagcttcatccatgtccctacaaaggacaggaactcatccttttttacggctgcatagtattccatggtgtatatgtgccacattttcttaatccagtgtatcattgatggacttttgggttggtcccaagtctttgctattgtgaatagtgccacaaaaaacatatgtgtgcatgtgtctttatagcagcatgatttataatcctttgggtatatactcagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcttgactttttaatgatcaccattctaactggtgtgagatgatatctcattgtggttttgatttgcatttctctgatgctcagtgatgatcagcattttttcatgtgtctgttggctgcataaatgtcttcttttgagaagtgtctgttcatgtcctttgcccactttttgatggggttgtttgtttttttcttgtacatttgtttaagttctttgtagattctggatatcagccctttgtcagatgggtagattgcaaaaattttctcccattctataggttgcctgttcactctgatggtagtttctattgctgtgcagaaactctttagtttaatgagatcccatttatcaattttggcttttgttaccattgcttttggtgttttagacatgaagtccttgcccatgtctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccaacaccatgtattaaatagggaatccttttcccgtttcttgtttttgtcaggtttgtcaaagatcagatggttgtagatgtgtggtattatttctgagggctctattctgttccattggtctatatctgtgttttggtaccagtaccatgctgttttggttactgtagccttgtagtatagtttgaagtcaggtagcatgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggcagtatggccatttccatgatattgattcttcctatccataagcatagaatgttccttcatttgtttgtgtcctcttttatttcactgagaatggtttgtagttctccttgaagaggtccttcacatcccttgtaagttggattcctaggtattttattctctttgaagcaattgtgaatgggaattcactcatgatttggctctctgtttgtctgttattggtatataggaatgcttgtgatttttgcacattgattttgtatcctgagactttgctgaagttgcttatcagcttaaggagattttgggctgagacgatggggttttctaaatatacaatcatgtcatctgcaaacggggacaatttgacttcctcttttcctaattggataccctttatttctttctcctgcctgattgccctggccagaacttccaacactatgttgaataagagtggtgacagttttcaaagggaatgctcccagtttttgcccattcaggatgatattggctgtgggtttgtcataaatagctcttattattttgagatacgtcccattgatacctaatttattgagagtttttagcatgaagggctgttgaattttgtcaaaggccttttctgcgtctattgagataatcatgtggtttttgtctttggttctgtttatatgatggattacgcttattgatttgcgtatgttgaaccagccttgcatcccagggatgaaaccaacttgatcatggtggataaactttttgatgtgctgctggattgggtttgccagtatttcactgaagatttttgcatcgatgttcatcagggctattggtctaaaattctctttttttgttgtgtctctgccaggctttggtatcaggatgatgctggcctcataaaatgaattagggaggattccctctttttcttttgattggaaaagtttcagaaggaatggtaccagctcctccttgtacctctggtagaattcggctgtgaatcagtctggtcctggacttcttttggttggtagcctcttaattattgcctcaatttcagagcctgttattggactattcagggattcaacttcttcctggtttagtcttgggagggcgtatgtgtcaaggaatttatccatttcttctagattttctagttgatttgcatagaggtttttatagtattctctgatggtagtttgtatttctgagggattggtggtgatatcccctttatcattttttattgtgtctatttgattcttctctcttttttcgttattagtcttcctagtggtctatcaattttgttgatcttttcaaaaaaccagctcctggattcattgattttttgaagggttttttgtgtctccatctccttcagttctgctctgatcttagttatttcttgccttctgctagcttttgaatgtgtttgctctggcttctctagttcttttaattgtgatgttagggtgtcaattttagatctttcctgctttctcttgtgggcatttagtgctataaatttccctctacacacgctttaagtgtgtcccagagattctggtatgttgtgtctttgttctcattggtttcaaagaacatctttatttctgccttcatttctttatgtacccagtagtcattcaggagcaggttgttcagtttccatgtagttgagcggttttgagtgagtttcttaatcctgagttttagtttgattgcactgtggtctgagagacagtttgttataatttctgtccttttacatttgatggggagtgctttacttccaactatgtggtcaatattgaaataagtgcaatgtggtgctgagaggaatgtatattctgttgatttggggtggagagttctgtagatgtctattaggtctgcttggtgcagagctgagttcaattcctggaaatctttgttaactttctgtctcgtggatctgtctaatgttgacagtggggtgttaaagtctcccattattattgtgtgggagtctaagtgtctttgtaggtctctaaggacttgctttatgaatctgggtgctcctgtattgggtgcatatatatttaggatagttagctcttcttgttgactggatccctttaccattacgtaatggccttctttgtctcttctgatctttgttggtttaaagtctgttttatcagagactaggattgcaacccctgcctttttttgtgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttagaatttggcatgtttttgcagtggctggtaccagttgttcctttccatgtttagtgcttccttcaggatttcttgtaaggtaggcctggtggtgacaaaatctctcagcatttgcttgtctgtaaaggattttatttgtccttcacttatgaagcttagtttggctggatatgaaattctgggttgaaaattcttttctttaagaatgttgaatattggccccccctctcttctggcttgtggagtttctgccgagagatcagctgttagtctgatgggcttccctttgtgggtaacccgacctttctctctggctgcccttaacattttttccttcatttaaactttggtgaatctgacaattacgtgtcttggagttgctcttctcgaggtatgtctttgtggcattctctgtatttcctgaatttgagtgttggcctgccttgctaggttggggaagttctcccggataatatcctgcagagtgttttccaacttggttccattctccccgtcactttcaggtacaacaatcagacgtagatttggtcgtttcacatagtcccatatttcttggaggctttgttcatttctttttactcttttttctctaaactgctcttctcacttcatttcattcatttgatcttcaatcactgataccctttattccagttgatcgaaacggctattgacgcttgtgcatgcatcacgtagttctcatgccatggttttcagctccatcaggtcatttaaggtcttctctatgctggttattctagttagccattcatctaatcttttttcaagatttttagcttctttgcgatgggtttgaacatccccctttagcttggggaagtttgttattaccgatcgtctgaagccttcttctctcaactctcaaagtcactctccatccagctttgttctgttgctggtgaggagctgcgttcctttgaaggagaagaggtgctctgatttttagaattttcagcttttctgctctggtttctccccatctttgtgattttatctacctttggtctttgatgatggtgatgtacagatggggtcttggtgtagatgccctttctgtttgttagttttccttctaaccatcaggaccctcagctgcaggtctgttggagtttgctggaggtccactccagaccctgtttgcctgggtatcatcagtggagtctgcagaactgcaaatattgcagaacagcaaatgttacttcctgatcgttcctctggaagcttcgtctcagaggggcacctggccgtatccggtgtcagtcggcccctactgggaggtgtctcccagttaggctactcgggggtcagggacccacttgaggtagtctgtccattctcagatctcaaactctgtgctgggagatccactactctcttcaaagctcagttggaaatgcagaaatcacccgtcttctatgttgctcacgctgggagctgtagactggagctgttcctattcggccatcttggaacctccctcctctcccaaagcgctaggatttgaatgccacaatacatattgattcatgtttttgtccattagtggtccgtgggtatctataaatgaagtctattttagagtccatagatatcagcgttctgcaaaactgtcagggatccgaggctcccagcctacagagcttcttttacttatatgtagtatagatatttaggttcagcaaaacttggttttctgataaaattagatctgttaaggaatgtacccccaaaacttaacatgaaaaaccttttcaaacgacaagtaaacctggcacagtggctcgtgcctttaatcccagctatgggagattgaggcaagaagatcacttgaggccaagaattcaagactagcctgggcaacatagtgagatccttatatcttaaaagaaaaaaaaaataaatttagctgggcacagtggctcacttccaagtagctgtagtcgtagctatttggaaggctgaggtaggaggatcacttgagccaaaaaaaacttctctttttatgtagttagagtgagctataatcatgccactgcactccagcctgggcagcaaagcaagacccctgtctctaaaaaaaaaaaaatatgtaaaagataagtagacagtgacagttttcaaggtggtacttgaaaattcaaacatatagaaattatcatgtgataagatataataattataaaaccataattaacacccttctccatgcttaattgattatatcttccttgtcattttgttccttctttctgtttaattagcaaaatggtgtcttataattctggaacagcaaacaaaatttttcaagtcagcctacttctaacactaaataatttcatattttctctaagtaccttatacctgtgggtccaattttacttctattaataaaggcagaatagatagatttttccagaaggcacttaagtgtctgaattctgcccatggcagagacacaattttatctgaaaaaggttaaagagattaatacttcctcattaaatttccaaataatttatttaagtatatattgccaattttcacataaaattaaagaactttcttttattcccgagaaggcaagtcatgggttgtctcaaacaaaatatgaaaagaacctgggtcaggtatcagtgctcgttcaattaccttggctttcttctttacgtcaagcccaaataattctaaatgttgtgcttaggttttcaaagggcttacgaagaagcaattaaaagctcattcaaatgtagagagcaaacaaattaaaattatataattccatcaacctatctaatgctgagattcatctattcattaattacacaaacatctgttgagggcctataatgtaccacacagtatagcaatatggggatctgcaaatgaataaggcacaatccctaccctcaagaagctcatagtcttctaggggacactaaggagtaattagaaaacaattatgaaagtggattataggcacacaggaatgatagaaccatcaatccaggaacttaattcactctgggatgggagcatggatggggacagtttccttgaaaaagtgacacctccctgggtcttaaagaagcagcagtcaggtaggccaaaagcaaagaaggactgtctagaaccgagcattcagcattcagccagcttgcacggagacaaaaggctaggacacagcatggcacacccacaggaactaaaagcactgctgtgcccaagtggccacttcaaggcaagaatagcaaatgatagacataggaaaataagcactagtcacatcttggaagccactgtaaaccgtgttagggaattggaactttctcctggaattaatggagagctaccaaagaatcttagttagatcagcatcagtgtcagagagaatctaaggatccacagaactggaggcagggaggccaacccagagactactgctgacacccaaatgagagatgttggcagtgggagcagaaataaagagatgggtcagacatggtggctcacacctatcatcccagcacttggggggccaaggtgggtggatcacttcaggccaggagttggagaccagcctgggcaacatgggaaaaccccatctctacaaaaaaaaaaaaaaaaaaaaaaaatacaaaattagccaggtatggtgccatgcgcccgtagtcccagctactctggaggctgagaagtgggaggaccatttgagcccaggaggtcaaggctacagtgagccatgattgcaccactgcattccagcctgggcaacagagcaagaccctgtctcaaaaaaaaaaaaaatctgtccttgccaaaaaataaaaataaaagagagagaaatgaagagattaactttagaaatatttatgaggcaaattaggcaggagttggtgattcaatgtgggcagtgaaaaagaggaaggaatcaagaataacctccaagtttctagcgtgggtgcctaggggattgtgatagccttttcatgttaattgattatatctttcctgtcacttacagcaatctttcttcttcatctaataaaatactttcattatgaaatatgtttcacaaattcaacaagtaagagagcctccatctgcctatttccaatagtttaagactgattttgtattttctgccagtgcctcatagtgggttaaatgctatttctattaataaagataaaatatgtagactagcaaatatagaaggaaaatccagttcaggagggaagatgattattttcagttgggacaccttgagttcaaggcaacttgcagaggtccaaaggtagttgagtatacaagactcaagtgtgggcaaaaatctgggttgtaaacacagatttaagtctcatcaggccacagagggtcactaaagtcatgagaatggtgagactatcctgagagtgtccagaatgagaaaagctgctcagggcagggctctgagcaacaccaatactcaagggctgagtagaagaggaaaataaaatggaatgaccaaagcagctcaaaagagagccaggactgctgggagtcatggcagccaagggagtggtgtcaagaaggaggaatggtctccagagtcaagtgcaatctaaatgcccatccagtgtgagaaggaaggaaaagtgcccattggcaatcaggagttatctggtaactttagtgaatacagaggtggcatattttgtttgtggttaaaagatatctaatggagaatttttatatcattaaaaatgggagaattgcctcatgaaatgtatagtcatttaaaatgatatgcaatattgttttaaaatgactgctataaacttatctccagtctcttttcccaagcagttgcccttagtagttccaatcccctctgtaaagtattattattagcaaagggtcatccaccacacattgaatcgcaaaataaagctcagctttcttcccactctgtgagaggagtaagagaaaatagactcaaaactatatagcctaaagatgaacaacccatcatttatgcatttagtatctatctattaagaacctcctctctgcctgagagaatgtcaggccttcaggatgcaaattttgagacttgagcagcttttatgcaatcaagaaaggccaataggataaatatggcagagcaaaaaagtgagaaaaagctggataatatttctgagctgggaattaatcaaccctggaacaaccctatagttaggcttcttattatgtgagataataaatcccctttttgtttaacttttttgagttgtgttttctttccttgcagccaaaaacatccacaatgatacaagaatgattttaaattatacaaatatccttaatagagaaaggaatggaatgatacatgtgatagacaaattgctcataggtcgccatcttatatttacccaacattacttctcatctaaaattattttcaggccagtcatgggggggtcatgcctataatcccaacattttgggaggccaaggcaggaggatcactttagcccaggattccagaccagcctgggaaacgtaacaagatcgtgtctctacaaaaaatttaaaaattagctgggcatggtggtgcacacctatagtcccagctactcaggaggcttaagcaggaggattacctgagccccggtgtttgaggctgcagtgagctgtgatcgcaccactgcactccagcctgggtgagagagtgagaccctgactctaaaaataataataaaataaaaataaataaaataaaattattgttagacctattaaaacagtcttttccagtctgattccaaagaaattagaatttaaaggttttttccaggttactgaaccaaaccccctcaatgtccagggatgccgcagttgccaagatccgcttcatcgctactattttctttcttgttcaagctctccctatggtggctgtggcagcagtcactgaagtaaccaccaagaagccctccaacaaacctacctacttccactcagtcaaaaagaagagaatttaatattggggcagaaggagtggaaggtttgaatacaaagtatgccacagagccaaaggactcattcagctgtcaaccacacacatgaagacacccagctatacactccaataaatatttggttcctttcttgagcataacataatcaaaattaaagattgggaacctatctcacttccaaattgctggggtatattcataattcttcagtacatccgtactttcaatatcatccaacccctgaatgagattgctggcataggttcccttatgatttaaggccctgctccacatttataaagaatcatcccattgtgtgtaacttctttgcgacaggttgggttttaggtgtccacaaagccaaagcaagattcctctccaaacacttacagcaatcttgacgttcatctgagccatcatcacagtcttgatcttggtcacacacccaggagttggggatgcattgtccctcactctggcacttgaaatagccctgctggcaggtcacaacagctaaaacaaaccaaaagaggactcattatggcaatcatcctccccattatactagcaagcaatgcttgttccagaagagtgtatcatgtaaactcctgctcaatttatttgaaggcaaatagtaaacaacccttatactagagtctgtggacgccagtcagagttcactgtcaaataagctcagcaacagcatcacaacaaactcatgaaccaaagcaacttaaaaacacagagaataaaacaaacagcacacatacacacaaaaaaattatgataaaggtattagattaaaagcttcattcaagtaaacattaactgtgagttactgttaaactatttgtttcataataactaatagtaaagtatcatgatgaactggaaaattcatgagatttgggaaagaaaacccaaaatcaaataattattatttccatgatttacttcctttaagatctttggcaggttctctgaacctcaatgtatgcatcataaaatggggactatactcatctcactgtttgttgtgaaaaataagttaaataatgtatgtgaaagcgccatgtaatgttacttgctatcactatcgtcattgatattgttgttattgttattatttttacaggtcaataaaatataatacaggtaacaatctctgaagagttgttggcatagctgttcacttattcctttaccccagatacactgcccttgcctttttgcttttattgtttaatcaaaatgaactcagtaagcccagaggaggcaaatagttagcacatgattgtgtctctacaaatatagtttagtcccttgttcaaagtgcagtccacaaactagcagcatcaacatcatcaggaagtttatagaaacgcagaagctgaggtcccacctcaaaatatggaatctaaatttgcactttaatgagctcctgggtgatccatttgtgcatgagtatttgaggagcactgtacagaaccccatccttacccttcctcccattttcaaatgcgttgtcatctaaatgacacaccaaagtttgactgctatggtatgccataacatggccaacaattcaaaacaaaaatttttcacctgctttcctgatttttgaaagataaccctcattagttcacctgctgggatgaaggaaattgcagatgtatgattgatcacctatgggaagttgggaagagcaatgggatctgtgcatagacttaccaactgtaagaactttaataaatgacttaacttctccgagtctcaatttactaatctgaaaccgacctcagaagattagtgagaaaactaaatgacaaaatgaatgtgaaagtcattttataattaattagatttgaagtttactacattatcgtatttttcaaattttttaaaactagaatttttaaaaaacataaatcacactaaccaattctgtgatttctttatggtaattgacacaagttattctacatcctttacataaaaatggactcctctttgacttacaaatcacagtagttcagataacattattttttgtttgttcttgtgggtacacaaaatttacagagtgaatattagaaataatcacctacagactccagaaaactgcacccaaatatgtttccatatcaaagttgtggtcaagggataagggtgagatagaaactgatgctctatcatcaatgtgaattgaacccctacctcagaagggagtgaaattattgttaatgccatcagttctctattcaaccacacagatctcaaaagacttgggcccagacctggctctgtcactaaaaggcatagctcttctctttgttacagctgaaatcaccaggaagcacttaggttactcaaaatagaacttagcctggcccctcctcacttaccgcagccaatttcatccgcgtcatctgaacagtctttggtcccatcacacctccagtctgcagggatgcaatgcccacttccacagcgaaaatgcgcactgtcacattctgcaataatagacagaaattttaaaaacttatgccatgcagatatttaaccgaagaaatataaatttttgataaaatgaaaaattattcaactaattagataatcaaagaaatgcaaattagaaaattaggtaaacattctcccaatgataatataaaaatatttatttgaacatccgtgggaagaaagtgattttcatacacagttgattagtgtgtatcttgatggaactcattgggaaagcagtttgacaacacgtatcttgctttttaaaaatacttgatctttaatttagtacttttacttcaaggatttttttcctaaggaactaatcaaagaagtagacaaagatttatgtataaagattttcatcgcaacattatttataacaaaggaagttgcaaacctcctaaatgtccaacaataaaaggattaaatttgtttacatctttatattgacatattagtaacttaaaaaatggttatggagaaattctaagtacttagagaaatacttataatttaatgtaacaaaaacaaggacgtaaatttttactgataacagagttacatatgcaaaaaaaaaaaaagcgtaaaaaagaccagaatgttaacagtggttatctctgattgataacatcgtgagtaacttttcatttgcttgactatactttcttgagttcctcaccttattttttaagtgattttttattactaaatcatatatagcaagttatggcctttcattcttagattcagactaatattttgtcttaatttttaaaaattaaattataacttgccagatctataagctcatctctgcaaacaattttttttaaaccaaagagccaaaaacaaaacaaaacaaaatctctgcagccaacaagagtatacaaacttgacaccaaaagttgacaccccaagtggcagtgatagtccctagtgatactggaaggacaatataacttaaacaagctcacttcactgaactaatatatcctgtgattttcctaggtctccccaagggacaaagttccccaaatacctggccagtgaccttcccaagcattatgtgccacatagaaaaatttttcaaagaaagcagccactaccagccccacttagagaagactcaaaattattttattctttcacaaacccaagggataaaggagaaatttttgcagttggaagaataattatatcttccccatgtatttaagcaatcatgctaaattacccatttcaatttttggctaattaaccaaaattaggtaaatatacagatcaagtacctactcctaaaataaataagcaatgtgctatcctgatttgtgtaaatgcaggcatatcaacagcatgacataaacatagttaagtgatctatttctagggtatataggctactttgttcatggaatgttcaaatctgattgtctggtagtgacatcctgatttataatgtatgctgcaaatggtcagaaacttcgcttggctaaatggtggtaccgagtggtacaggagtacgtacacccaaataccttctatagactaatgcatgatggtggttggtggtgcaggtctggggttggtggtgcaggtctcttatcaactacctttaaaacacaacaacctcccttgcaaaaatgcccctaaggaatgtacaaattcactctggaatcccagaacttctcattggattttgttctacaaagcaatatttccatgggagattaggggctttggaggtttagctattaacacaacatatattaaatcacttttatcaattaggtctattgttagtaatccaacataatacatttgtaagttcagtacatttgtctcccttagtatctgaggttgtaaaggtagtatcttctggttgaaaaattataacaatcataaagaacagtcctcttacagacagtttcatattgctatggagaaaagaaaaatataaatttagagactgagtatttaggaggaaattatcagaacaatatatattgcctgttttgaaaatatatataattaatgctatttcttaagcaacttttattacaagtcccatttttgaggagtggggtggggggatttgtttgtttttgccaaactaaaataccaagttaaacacatcatgaaaagaacacaaaatagagactcaaaagtcattttataaaacacttcaaagtcaattatttaaaatcacacatatgaaaaatgaaactgatggggaaatgttgcaattaactaatttttataggtagtgattttcacacttgatctcctcactccattatctaatatatcaaatccaatttactcaatttatcaacagatctataattcatttgtcaaattcaccttttcagtagtaacttcgatgcctgtttataactcccaaacgactattgtttggaaatatctctccagaaaaaacaaactgatactttatcattgctgggtgacctctcagccatcagccaaaatgcttcactggcctcagaagctcattctctcataaagggaatatgtgttgtttaaaaataaaccaaaaataaaccactagtgaaaaggtctagattaggtctaataacaattgcaggtgccccttacttcaattagtctatatgcaatttattttgagtgttttgttttaaataagtagcctttactcacaagccctccaaaagttttatctagatattatctacattttgttatttatttgaagatttaaaaaaaaaaaaagctaaggggatgatttcatacattggagccacccacagggagaaaaaaaaaatctacatagaaccagctttaaaactttgttcagaaaatagtctcaaaactgccacattcaaccaatccagttttagccaagaagtaatcttgcaaataatcatttatgtaactttaaaacattctccaggagcctctctggtttgggggctgcctgattaaaaaaaaaaaaaaatccctctagtaaaaaccaaggaggaaaggaggaaaatacaatccacattgaaataaaaaccttttgttaagaaccaggcaatcatcacaaaggaaccatcggaaccaaatgaacaccctatctctccagcactagcccctgtctgtcccatcaatcagaatagatggtgcaaagatgaaaagaagtactcatatagcacttaaatggcacacaccattctaagtgctctgccaacattagctcatttaatcctcataataaccctatgaaatagatactgttattatgaatattttacaaataaataaattgaagcacagagcaattcggtaacttgcccaagatccaacagcaaatatgtgcaaagcaaggatttgaatctgacagctctgattccagcattcgtgctacttgaccactactctatgttccctttcaccaaaaaaaaaagtttattccactaaactcaagaatgaatgtaaaaatctgatttttttcccccaaagctgctctcaattaacattaattgagttcattattgggctggcatagaatccatagtgcttatatacttcagttggagaaaaagagtagtttacttggtgactaacatagcattaaaaaattattgggcttaggaaaaattgcagcaattgaaagcaatgcaaaaaaaatttaagcgttttgaaatcggtagtaaaattttattagacataggaataaacttgttttccaacctcataaagagcccaaagctaggggaaaaaaaaaaaaaaagagtaatcctttcttcataagtagccatatcccaagcttcctgggtaagtgttggactaagaatgtgttaagataagatattagagtaacagatagcgcccagagaagaggagtcatttgcctgtttgttttccacagcaaggaacaacactggattgagagcattcctctgtgtcatttacagcctctggcacagcaccgggtgcttatggaatagctaatgcatgttcgtcaggaagtgtagaattctctttgtaaaactcagcctgctgagaccattatatatcagagatatagaaagctatcagagcaaacaatgagactttaaatagaaatttaccatcttaaatccatagaaagaaaaatggaatctggaataatctgaaaaaaggggaatatctagaagtttttttcaaaaaaaaaaaaaaagaaagaaaaaaacattgagtcatattaatagcagtttcattcttttacccgttccttgtaagtttctttctccttccataaattctattcttataagacaaagacaagtggtagtcaatggaacattgtccaaagttaacagagtaaggtaatttctgtggcaaatcctatttccccgctagatcctcttaacacatgctggtccttccaaacacttggtctacctgaggaggtacagtcctctttttaaaaatttgtatgagtaaatcacattttaatagttccaccttcactgaactcaaagaaacaaacaaatttaagaggcaattccttaacttatccataatttttgcttcactttttctatacttaattttgattcctttggtatggatagacatccttctgatattcataagttggctgacagttcactacaattcccataccttgcccacataaacaaggccagtccccttttgaagatttagagtcacctgcttatttcca

SEQ ID NO: 357 - DNA, 5216 bp, Homo sapiens
ttcagataactcacagggaaacaatgtttatttcctctcccactaacagtcacaaaaaatcataaaaaagagtagcgggggcagttttgatggctaacccctctttccatcctttgggggaaaattgctcatctccctataggtggaactctaaagacaatgtattcctaaaaggggccatctgggcggtgtcctcttttcccagcgccctgatttctattcttagatctggagataggcggctttcatttttcctgctcccagttcccagaccttccgtggggccgcaggatccccggctggcgggtcgcggagggtggccggccgggctgcgcactgcgcgcctccgctgcggggctccgggcctgtggactcagcggagtccgctgagtcagtttcttcccgcgcgactcccggccgcgccgccgctgcggtggaatctggtcccaggaggcggcgtccgcccggggtccggtctaggcgtgcgtgggggccacggtcacggtcatcccagccaggcccggctccagcagccccacggccgccgccagagttctgcgcggcccgtcgcctcggcggagcctctggcaggcccctgagctcgtttttggggcctgagtgggggaggaggaagccgagcaggagggctccggagagggagggcaacgcggggcggggagctgcctccttcctcataaacaggcgggcgtgggcgccgatggggcccgcggggagcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcggtaatcacttgaaaataaactgtgcttttatttttgcaaactttctccccctccttacatttgcaaattttgtcctcctccccttgaccctgctcaaacccggactcttaaggagccgcaaactcccatatcctttccttagggcagaaagcagctgagaatttcaggaaggtcttcacctttttgacttttctccccgtttcagactaaaaaggagagggggtgctgtggattgtgactttgcttcttttccccacccacttgttttccagcctccaagttatttcaaggcaaaaatatccatgtgcctctgttgatcgtcttggactcctatatgagagtcgcgagtgtgcagcaggtaaaggcattgttttcacttcaactcattctcccttctgtttggaaggagacgttttactggcaatgttaatatagccgagagttcttggttattcccaaaatttggcttgaggaacctctgactgtgattttaagatgggaatattgttaaatcattacgcaatgtaaacgggatgaagagccccagtatgtgttccctgagtgtctttaagaagtaactttataaaaccaacagtatggatggtggtagaaggaggataaaaatgggttcggttttagtctcgttattggcaagatgaattcattagtgtttagacttgactattccaagtatcttcccaatacagagcatgtcctagatgagaagattatgaatagtttggaaaaggggaataattaatagtgataaaatgcaactttgtcactagcaaactcttgtagagttcagcactttttaaaattcaaagatttctagcctttagttgtagtataccttgtagtatctaaagaaagtgatgtcttatgagaccctcatagtttgcaactgttgtcatataaaatgcatgtagaagtgaaacttttacaatctgtaccataggaaacccagaaatttgctatgtatcttggatttttttttaaagggggccttaaaaatggtaattaagaatgatttacagtcaaaacaaaattataggccaaggtgataacttccttcggagcacttagagatttggggaactgaaatcagttttgtcatctgcatgttaactcatgcagagaaagagaattggactttgaactccttggaggtgcagtcagaaagccaatgtttcttaatggttgagaggcttgacagacatgaggcatctcaatctttaaagtggtgtgggtctatctttatcttgatgtttatctctgtatctagctgtatctagtctgggtgaaccatctagcttctttgatatgaggacatttacatctggaagaaatattttaatttgttttcaactgtgaaatattttccatctgactattatagattttcacgctgctatcaaaccaaaccaagaaaagatggaggcataataaagatgctgttcttttaagactcaaagtcggaattttgcctgtggaatatgagtcactttttgggcactggcctattgtgcttcctgctctgcacccacgtcatcccttcttacttgtctctgctttggtgttcagaagtgcctgattctggccaccttcattccctagactctgtacttgatagagtcactcctgcttgatactgctcaggacagtcagatcctgggtaggcgttttggtctgcagggtctagataaggcagtgctatacttgacaacccaggggagcctggaacatacttcctaattcttaattttagaaattgcccaagcctgagcatacttgtccggagtagttatgagtgtcacttagtatttctgcctagagagtaccagaggcaaagtatgctggaaaataaggaagagtttttttaaaagtaattaattacttttttggatatatcatagttgtatatattttggggatacatatgctatttgatacatgtatacaatgtgtaatgttcaaatcagggtaactggaatatccgtcacctcgaacatttttctttgtgttggcaacgttgcaatttctttcttctagctattttaaaatatgcaatgaattattaaccataatttccctgctatactattaaatattaacttaattgcttgtatctaattatatttttgtacacattaaccaccttctctttatccctccccatcctttcatttccagtctctggtaaccaccattctactctcttcctccatgagatccaccttttccgctcctacatatgagtgagattatgcaatattttatttctgtacctggcttatttaatttaacctaatgacctccagtcccacccatgctgttgcaaatgacaggatttcattttttatgactgaataatattccattgtgtatgtataccacattttcttttatttttagttaagtaattaatttagagacagggtctcactctgttgcccagactggagagcagtggtgtgatcaaagctcactgcaggcctgcaatcctgggctgaagtagtcctcctgcctcagcctcccaggtagctaggactataagcatgtgccaccatgctcagctaatttttttttctttttttactttttgtagagatggagtcttgctatgttgcccaggttagtttcaaactcctgacctcaagtaatcctcctgcctcggcctccatattttctttgttaatctgttgatagacatataaggtgattctgtattttaactattgtgaacagggctgcaataaacatgggagttcagatatatctttgatatactgatgttctttttttggatatatacccagcgatgagattactggatcatatgaaaattctctttttagttttttaagatacctccatactgtgtttcatcatggctgtgctactttatattcccatcagcagtgtaccaccattcccctttttctgcatccttaccagcatttgttattttttgtctttttgataatagccattctgcctgtggtgagataatatctcattatggttttgatttgcctctccctaatgattagtgaagtttaggatttttttttcatgtacctgttagccatttgtctgtcttcttttgagaaatgtctatttggatcttttgtccatttaaaaataagacttttttttttttttttttttttgctaattgagtttttttagttccttatgtattctggttgttaatcttttgttgaatggatattttgcaaatattttctccctttctttatgttgtctcttcactttgttaattattttctttgttgtgcagaagctttttagcttgatataatcccatttgcctatttttgttgtaattgcctgtgcttttgaggtcctaccccaaaaatcattgcacagaccaatgtcctgtagcatttccccagtgttttcttctagtagttgcatattttcaggtctgagatgtaagtctttaatccattttgaaatgatttgtgtatatggtgaaagctgtggatctagtttccttcttttgcacagccaatatttgattctcactgaaatctcactgccctcctggaaatattaccggatgttttactgtcatagcgaagtgagagtaagctgctcactgaggatcaaagagcttgtgacagacctaagactcaagtcttctcacaccttcaaaatctctttccatcatacaatctactagctgctgaattcgcaagctttttgtgcaagctagtaaaaagcaaaatggtttgatacaaatactgtggccatgctaggtacaatgacatcaatttaaattatcattggtcttaacaaggggatgtagaaaggggtctcctactgacattttaatactcacttaaaagtagtatttttccttcagatttctttatattattagtataattactgtaagtatcctttactgctttatatgttgaattagctggaagtgccaaaagaaaaactcttaatgataaatttaaggtattaaggtaaatttctccttcatttaatttaatagtaattcttaattactatttaaaataaagattaaggtttgtttctagatgccatttaacatgatattccagactgccagttttattttcaaagtttgtttcatattttattaatgtttcttcataaatgacagtctttagaaaattgacggttaagctaggtgctttatatttttctt

SEQ ID NO: 358 - DNA, 178106 bp, Homo sapiens
agtcaataaggtcaccttaattaagatgagatttttctagagcgtgaaaaagtgcaaacaagctgcagaaagtagcgaggcgccacgaggggtctttgggacctgcagcaaccctattccacccgctttctcggccccgcttgcttctgctgagaaggggccctgcgagaaggctgggaccgccgggcccgggtgggcggcgtaaggagtccacagtcaagcccctcggtcactttcaaggtgacagcgacgagatccgcatccgtcccttccgcaggctctgcgctggcccacgtgagacccgcctccgctccgccggcgctgccgccccctttagccctcagcttcggcccccaggcccctggaacgccccctcccctccccgaggaccggtcccgtcaccctgggcggcgcgctcgcctgtcccctccccaccccggccgccgggcagcgggaacagattccagcgcgcacttacccgcagctccttcaagcgctccgggagcaaagacgcagaggcggggagggctggcgccctttgcaccactggcggggtcgccgagaacccgccccggaggtctcgggggcggcgtctgcacctgggggcgcgcggcgcggcaccaccccacgcctgcggcggctaccaggcgggacccggagccccggcctccccgcctccccgcctccggggccgccagggggtggagcagggcggggagttcgggaaacttgtaaatagccgaactcgggcctcccgccccaacccggggcggctccttccgaaggctccactccagcggctcgctgcgggagaccaaggccagccgccgtcccaggggacggccctcggggaacctgaatgacgtgcgaggccgtacctcggggcgctggactccgctcgggcgctcccgctctccgctcccgctctcgggtcccaatcccgacgctccgcgcgctcccggactaagtgcggacgcgccccacgccccccggcgccagcccgggacagcgctgcacctgttgccacgtgcgacgcggcgctcagcggctgccactgccgccggcgcacctggctgcaccgcgcgtcccgggaccacgctcgtccccgcaggagcccggggctccgccgcacccagcgctagggcccaggccgggccgcggtaggtgggggatctgactcctgcttgcctctggccacctgcaggccgaggggcctcgcaccgcggggcgtatagaaggtgggaaggttgcagaattatcagggcggaagcttgcaaggaaggagtcgtgattgtctcttagaagggctgattcgcagtctgtattatcttcatgcttctagcaagtttactagcaagtgtgtattaaaggttaaagaaagtagctttccagctattagagcttgagatacaacgtggaaaggagtctagaaccccagggagataaactaggctcgacctacttttctctaaacacaaacacagtccttgctgtttgctaaactgagcaaatttcatcgacagctgtcttctaggtccgtaaaatattttcttctataaagcatatttttaatagaaaacttgtccgaagatgctattctgcctgtgagagatgtcacattgctgaaccgtgaaatgtcagacaacctgagaacaaaattttaatatttcctttttaattacctggattgtggtttgctaaaagcttttaaagagaagtgaacttttttggagaatagacgtaaggactctgtatttcacagttttctataccatgaatattagaataactgacagatgtcttgccattgatagttgtaaagacttttcatatgtacaatgatccattatttcctgactacaaaacccaggggtatataggtcagattatctccattattcaaatgaggaattgaagctcagaaaggtcaagtgactagcgcaaggtcacacagccagtgagggcaagtgcaaacccagccagcctaactcctaatcttctcttttaattccattacataatgacacctctcatttgcttcagaaatccctgttgtaaagatagatgcaactagcatgatccgtgttgttaggaaaggcatgtgattaattttaaatagatatagtatttaacaccaccagatgagtctccctctgaaaaagcacacaaaaacaaaacaaaacgctgacatagtttccgcaagtcacgaggcaattatgctaattagcaacaagcctccatccctaagcagaatagttcttgtgtgaaacatatcatttaatctttataaccctgatgtgacctagatgatttggtctaaaccccacaatcctattgtgtggcttagttatatctataaatatagaacctgttttacttcatttttgtgtcaggtggtttgaaggggggaaacatacaatgctctgctaagtaattagagctacttacgcaggcattggggaatctgaaacttagcttctaattgtctccacataaaaacagaagttaacttctagggacatcttcagggactcctcaaggcaaatattcatgaaatggggcctattggcttttcttttcatcttggttctgggcatgttgccatgttcctgatctctgaactctgatgctgacctgctacagactccaggagcaatattaaggataaaataataactcacataactttgtggctctttattctaaaaaaaaaaaaaaaagttggctcaattttttttcctccataagaaaatgcaaattgcaactgtattgagaaaccattttttcacttatcagattgtcaaagattagaaagtttgataatcacagtgttggtaaaagtgtagactagcagtcacaatgaaaatgtaaatgtaaattataatgacctccctagggggaaggtcaggatacctaacaatattgcaactatacgtataagagtttatcttggccctgcgtggtggcacggtgactcatgcctgcaatcccagcacttggggaggccgaggcgggcagatcacctgaggtcaggagttggagaccagcctggccaacatggtgaaaccctgtctcaactaaaaatacaaaaattagccagacatgatagcaggcgcctgtaatcccagctacttgggaggctgaggcaggagaatcccttgaacctggaaagcgaagtttgcagtgagccgagattgtgacactgcactccagcctgggcaacgcaccgcgactctgtctcaaaaaaaaaaaaagagtttatcttacaacacacaggagaaatggtatgtatctacaaccttgtttatttcagcattgtttataataagatatatttcaaatacaaatattctttagtaaaggactgataaatcatgatataggcataaaatgaaatcttatgaaagcttttaaaaagactgagaaagctctttgtacttttatgagatgatcttcaatctatgtcatgtgcattttttaacacaaaacaattacctaatagtatgctacaatttctactaaaagggaggaaatgatacaaacttgtatagatacatatatagatatgtttgtataagcataaactaagcataagccaccaggcatggtggcttgcacctttaatcccagctatttgggaagtctaagggggaggataatttgaacccaagagtttgagacctgccagggcaacttagaccctgtctctataaaaaatacaaaaattagctgcgcatggtggcatgcgcttatagtcccagctactctggaggctgaggtgggaggatggcttgagtccaagaggttgaggccatcgtgagccatgattgtgccactgcattgcaagctggtgacagagcaagaccctgtgtcaaaagaaaacaaaacaaaaacccataaaatatctggagagatataccagaagcagataacattggttgtgtcttgagatgggagttggatagttaaatggcagcattagaagagaaatttgttactaaatacaattttgtactttttttggattttgagccatataaataacagaacccattctaatattttaaaatgttttaccgcatgaagttttgccatcaggaatgaccaaagtttctctgtgaacgaatttcacttatagataaaataaatgattggtcaggcatggtgccgtggtaggtgtatcacctgaggttcggagttcgacagcagcttgaccaacttggagaaaccccgtctctgctaaaaatacaaaaattagcgggggcatggtggtgcatgcctgtaatcccagctactagggaggctgaggcgggagaatcgcttgaacctgggaggcggaggttgcggtaagcagagacctcgccattgcactccagcctgggcaacaagagcgaaactccatctcaaaaaaaaaaaaaaatgttcaatagatgcttctgaccctatttcttctctagtttatctaaaaaagacaactttggtacataaaactctaacacaagtgtggtgaaaacgatgaattagcaaattgtaaattccttgcaatttgattagcagtgacatctcccttgggtagggcttccagataactttaccaaagttgcattcaatcagaaatgaaaaaagtattccaggccttaattctcaaggggaactccatggagtcattgcctttgttcccaatccgggtccctttttttttatttatgtttccttatggcaccatctcactgagaagggagttgaacatctttaaaagacagaaacagtacattttaaaaataaatatttcaaagtgtaagtatttttagtataaaatggtattcccggaaaagcatacaggtaatagtaaacatactattgagcaacgaattaaaacactgagcttcctgagacccaggtacgccaaccgcttacataattgtcattttcaaaagaggctgaaagtttctcaaaggaagaaaaacttttcctagcactgaattttaagaaaaatttttgtcactcattttcaattcaagactacaaaatggaaaatgacaatatactattaaaataccataaggaacttcatgtggctatttttcatagtgactgtgaataaaactagaagtttttttcttctttttttttaatagagacggggtctcgctatgttgcccatcctgggctcaagcaattctccagacttggcctcccaaagtgctgggattacaggcgtgagccactgtgcctggccaaaaaaacaaaagtattgtaataaaactcaacttgaggaagttactcacccagacagggaccggtcttataacagcataatgagatcaaggattggctgtaaatagaagtgtggaaagacggcagcttcttcagatatacttctgaaagtcaaatatgctcatggtaaaacgtgaacatctccacaaatcccttaccacagaggtaaacacagttgctttatacaacattccagaaattttctagtgagcactcattagacaggtgctgaagcattgtcagaagttgcggtaatctctggcaaagtcccagaatgctggaattttgtgatactgtcgatgaccttttctttgtttttgtgaagagaatgtgtatattacacatagtcatatgatttttttttttttttgagacagagtttcgctcttgttgcccagactggagggcaatggcgtgatctcggctcaccacaacctctacctcctaggttcaagcaattctcctgcctcagcctcccaaataactgggactacaggcatgcaccaccatgcccagctattttgtatttttagtagagatagagtttctccatgttggtcaggctggtctcaaactcccaccctcaggtaatctacccgccttggcctcccaaagtgctgggattacaggcgtgagccgccgtgcccggcctatgacttttaattcttgtgtccaaagatggtgagacatgtgtggtaagatacccaaactgaccagctgtagcaatggctgcataacaagaaagagagaacgtgagagcagtaaatggccctgatttatttaccaataactcccaggttcttgattatctattttttttctcagtggacttgaagacccaactggactctcctcttttttcttttcttttcttttctttctttttttttttttttttttttgagatggtgtctagctctgtcacccaggccagagtgcagtggcacgatctcggctcactgcaacctctcccatccaggttcaagcgattcttctacctcagcctcccaagtagctgggattacaggcgcctgccaccacacccagctaatttttgtatttttagtagagacagggtttcactgtgttggccaggctggtctcgaactcctgacctcatgatgcacctgcctcagcctcctaaagtgctgagattccaagtgtgagccaccacgcctggccttcttttttattttcttatttttgagaaaggatctcactctgtcaaccaagctggagtgcagaggtgccatgatggctcaaccgcagcctcgacctcctgggctcagttgatcttcccaagtagcagggaatggagtcatgtgccaccatgcccagctactttttgtattttttttatagagatgggatttcaccatgttgctcaggctggtggccaacttcttagctcaagttatctgcccacctcggccttccaaagtgctgggattacaggcatgagccactgcacctggccctggactgtcttcttaatgccccagaaggtgactagcagaatagaaatgttcttatgccggctgggcacagtggctcacaccttgtcatcccagcactttgggaggctgaggcaggcggatcatgaagtcaggagatcaagaccatcctggctaacatggtgaaaccccatttctactaaaaatccaaaaaattagctgggcatggtggagggcacctgtagtcccagctactagggaggctgagggaggagaatggcgtgaacctgggaggcggagcttgcagtgagctgagatcgtgccactgcactccagcctgggcgacagagcgagactccatctcaaaaaaaaaaaaaaaaaaaaggtccttatggcaaagtctgaagatttttaagtatctcaagaaaggagttttttgttgcaagttcaaagcagtagaaaaaatgaagaaatatagcttcctcttatcaaaatgacctgcagaagtttgaaaaactcttccatctccccatcccatggaaggcatcttcaacagtcctgttccatttatagactctgtagaaggaacagttcttataacatgatgccaaaattattctagttcacacacaaacaagttgtcctgtaattctgctgtgggcctcctcatattaggaagaaattaagaaaaatatagtaccaccagtttgttatgcaaccacttcgaaaatgtttactttgcttaaaatgtcatggctaaagaaactactcgtctgcataatccactcttgacagtgattcataactgtgtgacatttgggcttggtcaggctttactccagtcagattgagtctttccttaaaaaggggatatattttcaatttcagagtatttactgcttcatgacaaatattaataacaagtctgtggcttcgaggcctcatacctttgagactaccacagtctacttagcatttttttttttttttacttagaccttttgaatttgcttttaatttatacccctggccttgttctcttgaccaaataaaagccctaagagagcttccactgccagcagccttccaatttgctctgttcccccttgggccctgttgattgggcccagtgatcacctaaaaagagtgcaaagagtcaggaaggcttgtgggttcagtctttctgtgctaacaccaggccacatccaggcctgatgtactaactgatctccagttcattccttttgcaatttttggccttgattcatagttcctgattcttgattggctctgaaatcctccccattttcaaaagggatgcagtcaagcaggccaaagcgctccatgttagctaacaaatgtttgcaaatcataataatgtaggaagagaaccataaactaaatgaacaacaggcattagccctcatgctgtcacataagcattcctcaaaatataatcatgcttctaaacatgggctggcaattcaggaaagggccactgaaaatattagcctcgttcttttctctgtagagtgagcacagactattcctaaaccacattgcagtatgccaacattgtaaattaatgcctgattggttacctagaagtaagacaatcttacttttaggcatctagaacactgagaaatccaggatggacacttaacactaccaaagattgatctattttgggtaagtatacttctgatctctttttgaggactgtattagtccattttcacactgctataaagaactgcctgaggctgggtaaattataaaggaaagaggtttcattgactcagagttctgcatggctggggaggcctcaggaaacttaacagttatggcagaaggcaagggagaagcaggtaccttctttacaaggcggcagaagagacagagagggcaggggaaactgccatttttaagctatcagatcttgtcagaactccgtcactatcacgagaagagcatgagggaaactgcccccatgacccaatcacctcccaccatcccccgctcaacacgtggggatgacaattcaagatggaattgtgtggggacacagagccaaaccatatcaagtacctacaaaattatggtgactcttcactaatttgcaaactgattatctgcaaatcttaaatagggaataaaacacaaaaatatcattatccctccagaactgaggacgcaaattggatttagaagacttagctttgacacctagatatgttttcattgatttgacctaacttgatctcagtttctcttttatagagttagttctttagatcagaggtccccaaccccaggactgcggactgccactggtctttggcctgtcaggcacccggccacacagctggaggtgagtggcatcaagcaagcattaccacctgagctccaactctagtcagatcaatggtggcattacattctcataggagtgtgaaccctattgtgaactgcacatacaagggatctaggtaacatgctccttatgaaaatctaactaatgcctgatgatctgagctgaaacagtttaggccaaaaccatccctcctgcaccccattttgtcttccaagacaaaagattattcaaggttgctatgaacacctttatgtggacaaactagaaaacctagaggagatggataaattcctggaaatatacaaccctcctatattaaaccagaaataaaaataaatcagaaactgagcagaacaataacaagtagtgaggctgaaacagtaataagaaaaattgccaagaaaaaataatcgaggaccagatggattcacagctgaattctatcagacattcaaagaagaactggtaccaatgctattgaaactattccaaaagatagaataaaaccagtattaccctaataccaaacccaggaaaggacataacaaaaaaagaagactacagaccaatatccctgatgaagatagatgcaaaaatcctcaacaaaaggattctcaacaaaatactagctaaccaaatacaatagcatatcaaaaagataatacaccatgatcaagttggtttcataccaggaacgcagggatggtttaacacatacaggtcaataaatgtgatatacaccacatatggttgtcttatgaaagtttttgtcaagtagatgcctcaggaagtgctcatggaaacaatattccctgaatttttgcacagtgattacatttcgtatgctgcctttatcttggaaagctactgactcacattttctttcattgaatatcttaaatatgttactccatttttcttctacctaaatcattgctgttaaaaaaaatttgatggcaaatctgatttttttttcctttataagtggattttttttgcctagaagcccaaaataattttttcccctttaaaatgtgtaattttggtgggatgatcacttgagctcaggaggtcaaggctacagtgagctgtgatcacaccactgcacttcaggctgggggtcagagagagacactgtcttgaaaaatatatttttttagctactaatttcattataataagttatggtgttactagtcctgggtcagtttttccaggtatgtagtataacctttcactacgtagcttcaaatacatatattgttaatttgaagaaaatgttcttcattatagttttttggtagtccttctgtgccttgctttggtttttcttcttgagaaactcttgttaaacatatttttgtatatcttttttgcctgtctctaagtttgtttctttctctcaagccctttttattactttccttcaattaaaaaaaattttttctctttcatcttctcttcttaaggtattctctgtgtttatttattcttccattactttcagtttagttttttttttttttttttttaagagatggggtctcacttgttgcttaggctggtcttgaactattgggttcttgaactactgggttcaaaggatcctcccgcctcagcctctcaaagtgctggggttacaggcatgagccactgcacccagcctagtctctgtttttgactagtgtttctacgtctttttccttggcctagtgtctgtttttgactattgtttctacgtctttttccttggcctagtctctgtttttgactattgtttctacatctttttcctaagtatatctatcacctcatttctgatatttcccaattctcatttttcttgttttttccatatcttggatgatttctttaatgtcttctagcacacattgaaataataagtcatggtttgcatctgctctgtaggtatgtctttttagcatctttggcattgtctgtagggatgtttttcagtttcttctctttttttcctgacagtaattttgtatgagatttaatcttggtatttttttgctcatttaaaaaaatatgaaataattttcttaaactttcaggaggaggtaggatttgggaaagcatttccaatttcacaacctgatcgctctctttttttgttgtatttgtgtggtggttaaaactatcggggcttactttttttttttttttttttttgtttgacagatctcgctctgtcgcccaggctggaatgcagtggcgtgatctcggctcactgcaagctctgcctcccaggttcacgccattctgcctcagcctcctgagtagctgggactacaggtgcccaccaccacgcccggctaattttttgcgcccactaccacgcccggctaattttttgtatttttagtggaaacggggtttcacctgtgttagccaggatggtctcgatctcctgaccttgtgatccgcccgcctcagcctcccaaagtgctgggattacaggcgtgagccaccacgcccggcaatcgcggcttattttctgagatggtcagactctgttttctttccttgctttcatctggaccccgtctttccttgatctctatcgtcccagttccgtacaatgagcattcttttccaagaagtttcttctctgtgcagtgcttgtccaggagtggaaatttgggtggttagtttggaacattcattgtgcccgtcagacactttgcattcccctgactttggagtgtgcaaaactttttccagtttcagctgctgttcccaagtggaacctccaagctttccagcaattgcctgcttgctattttgagattatcagatttatcagagtctcatgaattccctccactttctattatacagttgctgataccacctagcccttgtatctgtctatggctttcctcaattccttatgttctagggttcgtggagacacttcatcacctaattttgttatagatgttgtccacgggttttttattttatcttttgtcctttgtctatatttgtggcagaattttaaggttaaaaaatgatgacccccggatacaggtgaccattgtaagggtacaaggaaaatatcccctttgtcctctgaagatttgcttaaaaatcaactcataaaagtcagattaattggagtaaatgtatataaattttattaacgtgtacatgagagcctttagaataaagacccaaagatatagagaaaattatctttttttgtttgtttttgtttgagacagggtctttctgtcacccaggctggagtgcagtggtgcaatcacaactcactgcagcctcgacctcctggactcaaggggttttcccacctcagcctcccaagtagctgggaccacaggaatgaacaacctactaattattttatttttagtagagacagggtctagctatgttgcccaggctggtcttgagttcctgggctcaaaggattcccccacctcagcctcctgaagtgctgggattataggcatgagtcctcgaacccagcctggaaattatttttatgtttaggttcaataaagtatggacaaccatgtagaaatgtaactggacaaaaagggtaccatctaatgttaatagacaaagtagggaaacccaggaaggcctgggttaaacggtaagcttagatagtaagacctgtgtattagtctgttctcatgctgctaataaaaacatacccgagactgagaaatttgtaaggaaagaggtttaatggactcacagtttcacatggctggggaggcctcacaatcatggcagaaggcaaaagagaagcaaaggcatgtcttacatggcagcaggcaagagaggttgtgcaggggaactcccatttataaaaccaagttttattcactactgcaaaaacagtatggggaaactgcccccatgattcaattatatcaacctggccccactcttgacacgtggggattgttacaattcaaggtgagatgtgggtgaggacacagccagcccgtatcagcccatgtgtctctctgagtatgtatgtttttcttttgcatgtagggcaggaccctttctagaatggggatcgtatggcctataattaaataaggtagctcagataatttttttatgaccaggttttacacagaaaggtgcaggaaaaattagagtaatatttttaggttttttatggctggctttggggcaaagaggttctcatttgtatgacccgccttggggaagagggattctagtttctatggcaagccttgaagcagaaagggaccttagtcttagaccagtcttagtcttagacaagaagacatgagaaaattagaaaaaaaagttttacttgtaagactattttggaggcctttattttgggggtgtgttttgagtccaaacaccatcagatagatcttggtagccaccagctatatatggtgagtactccttgacagcaccaagcatgaaatgctcaaacaggttggcagaagtccctgtgaatgctcagagggtgccatagagaggaaaaaagagcagaaggcaaccagcttttatctgagatctatgtgccagatattttgctagtagcttccacatatattatttgatttgatttaatctaataatcacccccatcttctgaagtagaatcttcaggtcttcctaagtcctatgctcattcaacatggaattgtgagaaacttaatctccctgatggaataggaatcagttaaagtgcgacagagtagaggcacctgagtcagcactaatgaaccttgtgaagtcctttagtgtttgtcaaaactactgtaaagatactacctgagactaggtaatttataaaggaaagaggtttaattgactcacagttctgcatggctgctgaggcctcaggaaacttacaatcactgtggaaggggaagcaggcatgtcttacatggcggcaggcaagagagaagtaagtgcaaccaggggaaatgccatcatatctcatgagagctcactcactctcatgagaacagcttggaggaaaccacctccatgagccgatcacctcccaccaggttcttcccttaacacctggggatgacaattcaagatgagatttaggtggggacacaaaagcctaaccacatcaatattcatcatggattcaaagatttcttgattaaaattacgagatattaagattaattatgatgattataaaaataataccaaaccttgattatgtaccatgcacgattttagtcattttacactttacatgtattaattgtttaaatattcataacaattctattaggtagatattattattgcattcttcttctttttcttttttaagagacaggtattgctatgttgcccaggctgctgctggcctcaaagccctggactcatgtgatcctcccaccttggccttctgagtagctgggactacagtcatgtgccatggtgcccagcaagtagatactattatattcattttataagtgatgaagttgaaacccagtctagttataaatatgcccagtgtcacgaagctaataaataacaggattaggattgaaatccaggtcagtctgaccttgaaccaccaaatacactgccttcttataactcagctctttggagttctacatttgatttacttttgtgtttcaaccccagatgtatagttcaaaaataatacataactttaaaaataaagataatttttaatgaaaagaaccagaattaattgtataatctgttgttagaaaaatcttttggccaggtgcgatggctcacagcggtaatcccaacactttgggaggccaaggcgggcagatcacgaggtcaggaaattgagaccatcctggccaacatggtgaaaccccatctctactaaaatacaaaaaattagccgggcatggtggtgcacacctgtagtcccagctactcaggaggctgagacaggggaatcacttaaacccgggaggcagaggttgcagtaagccaagatggcaccactgcactccagcctggtgacagagcaagactccgtcaaaaaaaaaaaaaaaaaagaaaaaaaaactcttaatgaagaaatacaagtcagaaacacttgagccaatttacttaaaaaacagaaacatacagagggtacccctacgaccactatcactaaacagagaatgtagaaagatttaagtgtgttttacatgttacatggttgcatacttaaaatgtcagcagaatcaaacaaaaaatagttatacacaactagaagacagaatttaccgtatcaataatacattaaataacccagcaataaaattaacttgaaacagatgtgtttcttaaaaaaattgattgaagggacagaaagatttcctgacaaagatgccaaaagcaattgcaacaaaagcaaaaattgacaaacggtatctaattaaactaaagcacttctacacagaaaaagaaactatcatcagagtgaacagacaacctacggaatgggagaaaaattttgcaatctattcatctgacaaggtctaatatccagagtctacaaggattttaaacaatttacaagaaaaaaatgaacaatcacattaaaaagtgtgcaaaggacatgaacagacacttctcagaagacatacatgtggccaacaaacataagaaagaactgattattagagaaatgcaaattaaaaccacaatgagacaccatctcacaccagtcagaatggctattattaaaaagtcaaaaaacaacagatgctggagaggatatggagaaataggaaggcttttacactgttagttggagtgtaaattagttcaaccactgtggaagacagtgtggtgattcctcaaagacttaaaggcagaaataccatttgattcagcaatcctattattgggtatatacccagaggaatagaaattattcttttacaaagatacgtgcacgtgtaaaaataaaaagatacgtgtacacgtatgttcattgtggcactattcacgatagcaaagacatagaatcaacctggacgcccatcaacaacagactggataaagggaatgtggtatatatacaccatggagtgctatgcaaccataaaaaggaatgagaacatgtcctttgcagggacatgaatggaggtggaagcaattatcctcagcaaactaacacaggaacagaaagccagtcaccgcatgttctcacttataagggggagctgaaccacgagaacacatagacacatagacggtaacaacacacacgggcctctccaagaaggtgggatggtgggagggagaacatcaggaagaatagctaatggatgctgggcttaatacctaagggatgggttgatctgtgcaggtctgtgtagcaaactaccacggcacacatttacttatataacaaacgtgcacatcctgcaaaggtattcagaacttaaaagttgaagaaaaataagttgattaaattctaataaaaaaaggtaaacatacctaaataactatgctacattcttttttagagagattaaataagacatcaattaaaaatgtttaatatataaatttattgcagttataaattcctgtgagaaccaatagtgaaaaataaatggatgacattatcaaaacattttcattgggaataaggatgaactcagcaaacttggaaaactgaacacactgcaacaatgatcaaaatcttatggccttgggttattacagtcggaaaaaagaatccaacctatagggcaagggaaaaccacataataagttgtcttccaaatagttggctaacaggctggaaaaaacatcatgttagatacgtaaatacacggaaacaaacagtataataaattccagctgtatcaaaaagtaaaagccctttttaaaaaatggaagagtggtttatctatttcctatgagaaaaagaacatgcatttttattttcttttttgagacagtgtctcactctgttgcccacgttggattgcagtggtgtgatcatggctcactgcaacctcagtctcccggggtcaagcaatcctcccatctcatcctcccaagtagctgtgactacaggcatgcgtcaccatgccttgctaattttttaattgtttgtggagacacagtctcactatgttgcccaacctggagaacatgcatttctaatcactgcagaaaacaaaggttgttaccggaagcaggggtgattaattgagcagatttaaattttttaactttcatgcaacaaaatgtaaaataaaaatgctataaagaaaactttccagtatagaatagatatattacaaatataacgtgataatagctttctcccaaaatatatgaaaaaataaatgattatgtaagtcaataaccactttccacttgatgaatggacagtttgcagttaggaacatttagactacatcattgtgtttttaaaaatcagttttattaaaaaatgaaaataaaggttaattaaactcacatgaagactctcttacagatgcattaaactggaagacattttttattttttattttatttattttttttttgagacggagcctcactctgtcacccatgctggagtgctatgatgcgatcttggctcactgcaacctctacctcccgggttcaagcgattttcttgcctcagcctcccaagtagctgggtttacaggcacgtgccaccacacccggcctgtttttgtatttttagtagagatggggtttcaccatgttgtccaggctggtctcaaactcctgacctcaggtgatccacccgcctcagcctctgaaagtgctaggattacaggcttgagtcactgcgcccagcctggaagacattttttagcttgtaaaactgaacctggacaagtctttgggaggaaggcagacgtacattttgtatgttaatggtagaaatgtaaaatggttacatatttctggggggtaatctataacatgctctttgacctattacccgttccttcccctgagaaaggaaaactaacttataaagcaattttcattgcagccttacctataatggggaaaattagcttcagttcaaatgcccaatagtattaacatgtttaagtaaaccatggtgtattaccatatacaaattaaaatgacaagtaaatggaggatgtaatacatagatatgtttatgtgaaacaaggtgaagtaaacaacttgaacccatgataactttatacaattatatagacatatataaatgtaggccaggtgcagtggctcacacctgtaatcccagcactttgggaggccaaggcaggtgaattgcttgagtccagtagttccagaccagcctgggcaacatggtgaaaccctgtctctgcaaaaaatacaaacaaaattagccaggtgtggtggcacaagcctgtagtctcagctacgtgggaggctgaggcaggaggatcgactgaggttgaggctgcagtgagccatgatcacaccactgcactctagtctgggctactgagtaagacccagacatttatattgctttttccaggtatgttttttatatacacatatatatattacatatgttatataatgtacataatgtatattacatatgttatataatgtacataatgtatattacatatgttatataatgtacataatgtatattacatatgttatataatgtacataatgtatattacatatgttacataatgtacataatgtatattacatatgttatataatgtacataatgtatattacatatgttatataatgtacataatgtatattacatatgttatataatgtacataatgtatattacatatgttatataatgtacataatgtatattacatatgttatataatgtacataatgtatattatatgttatatacgtatattaatatgtatatacatattaatatacatattaatatatgtatattatatatgtatatgtatatagacataatgtatattatatatgtatatacatatgtatacatgtttattatatacgtatgttatataacatatataatatacgtatgttatataacatatataatatacgtatgttatataacatatataatatacgtatgttatataacatatataatatacgtatgttatataacatatacgtatgttatataacatatataatatacgtatgttatataacatataatatacgtatgttatataacatatataatatatgtatattatataacatataatatacatatgttatataacatatataatatacgtatgttatataacatatataatatacgtatgttatataacataatatacgtgttatataacatatataatatacgtatgttatatatgtatatatgtacacatatgtttatatgtatacatatatgtatatgtacacatatgtttatatgtatacatatatgtatatgtacacatatgtttatatgtatacatatatgtatatgtatagatctacacacatatacatatatatgtgtatatatatatgacagcatcagtcttaatagcttagatgatttctatttgctaattgctttaattgacctccaaattctggtccttacatctcatgtctacatctccattcatttctctagtgtgaaaaaaaaggaaaaaactgaaaatctcaagaggattccaggaaatcaaaacaatgaattattgaatcaagaatttgaaagagaaaatagatgcatactgaaaaaagaattttgtttagtgagatagatgtaataatgaaggcatgttgataacgggggagctatgtatatatgaggggagggatatattggaaatctctgtatcttcctctcaatcttgctgtgatcctaaaactgctctaaaaaatattttgagaaggaataatgatgtggtaaacatgttctgttatttaaaaagagagacttttcatagccgcctccctccccctctacacacacacagagtcctgtccgtcttcattcccttactcaataatttgtacagacacagccactgggctccagtaatcctaaagtttctagaaaatcaagcacagaaaaaggttaaaaccctgagggaataaaagaattcctttgcatccattgcatttctcaggaagtgaactaacaaattcactgcttttaaatgaggaaattttctcagtgaaattgattccaaaccttcgttaggtcaactgttcccagatttcttagctgatgcctgatctgactattccttatctttagtacagaaaccaaggtgaatgacctttaaaaaacatattagactgttgacgtgtcttctatgttgtactctaggtaaaaacgataaaccaggaaaaagaaagtaaaattcaaccttaggctcatggatccagagtggataattatgagtctgtagtatctacatgcatgtgatgaggttcaaggacaataaccataaagcaaagacttaaaaggttttatcattagaataattgtaattcacttgatctctcaatgtaacaatacttcggtctactgtctcaagccattattatgtcttacactcagcatattggtttgtctaccattaaatatttattttctacagtgctttctggaaggcaaacaaagcagccactctgctactttatattgattcctgagttgtccttcggaaacgctttcaggaagtttaataggtttgaaagatatttagacctgtgactggcaaatatacttccttctttttatttcaataagagagtactagaacttagatctttattgtttaatctagtcagtgctgtcattgtcaatcaagttctcaaatgacacttgtcctgagctgtaactgatctattcagaagaatatgaaaatagtaaagacggcaactatgcatgtttttaccggacacgattttaattgctttaaaatgaagttatgcaaccaatgaggaatggagcttttggagtggcctgaagctaaaggtttcaggtgtatttttgctttctttgaagaaagaaccaaatcattttatttaataaaaaggccatttatcaagaatttcttaaagctgttttaaacctgagtttgcaatttatagaatatgttcaagcagcctcagtgcccttttaattggatggttttcacagatttatccaatttgagatttatccagtgagaattccctttgttcaagtatatatgtcttctcttccataaagcagattcaaatgaaagagtgcaatctgatatatcagacatgtcagttatacatttgatgtggtaaatttataagagaggccaattattgttatgaaaaaatacaatgaaatacatgatagtcatttactgtttttataactaatctaaaagtatttactaaaaagaaactatttcttttcatatgtactttactttttactttaacccttcatatgtcctttaaataaagagaagaaaaaaagtcatttatatttatccacatattttctatttcaggtggtcctcattcattcttgtagatccaagttaccatctgttattattttctttgtcacctgaagaattttcagaactatttcttcctatatgtagcatgtatagatactctaaaaagtccattatatgatgtataaaacaaagcatacaatgtagtctctgccctaattatttgtaatttatataaaaccttttattttttatttttaattgtttattttattttgttttgttttatgtttttgagatagagtcttgctcttttgcccagactggagtgcaatagcgtggtcttggctcactgcaacctctgcctcccaggttcaagtgattctcctgcctcagcttctccattagctgggattacaggcagcaccaccatgcctggctaatttttgtattcttagtagaaatggagtttcaccctgttggccaggctggtcttgaactcctgacctcaggtaatctgtccgccttggcctcccaaactgttgggattacagatgtgagccactgcacccagcctaattggttattttattatttagactccacatatcaattttcttactatggcgatatgaaatagcaattaaccttgaaatatcatttatttttccctattattacatttcccttaagaactacaataagttattttactgaaaaacattgtccttaacgtaccatgagctaatcattcaagaattgtgactaaattatctaaattatttcagtgtaatcacctgaggttctaggtaagccctccttctcattctctgcttcacacatgccaatgattaaaagatcagattatcagccaggcacggtggctcatgcctgtaatcccagcactttgggaggccgaggtgggtggatcaggaggtcaggagttcgagaccagcctggccaacacagtgaaacgcccccccgccccccagtctctactgaaaatacaaaaaaaattagctgagtatggtggcaggcacctgtactcccagctactcaggaggctgaggcaggagaatcacttgaacttgcagtgagctgagactgcgccattgcactccagtctgagcaacagtgcgagactctgtctcaaaaaaaaaaaaaaaaaaagatcacattatctttaagtaaaaaaaagtagtcaactggagttccacttttggtaatggtagggtagctggcatcaaactagatctcctgcagatcaaaattatatactgtgaaaaaaatgtaaataatgtctatctgaaggcactggagggtgtctagaagcaggcagaaataagaagggaatcctttaaagaagggaactaaatatggtttttcagttgaggatactccccagaccttgtggtagaaagaagctagaactgaagctaaaaccacaattttaattgcttgaagggttaaaggacagaatttgggactgccaatatggctggattatgaggggagaaatttcagaaagatggtagccacagatatgggagcctctaaatccatgtgtaaactctctgcacacattcctgcagatctctgaactgtgtattgtgtaggagactccaaggaacccaaacaggaggctgaaaaactgagtagagatttcagctaatgccttgacaagggagaaaaaatttggggtttgagtccagctaggtaactgcctgctaaaacaaaactcaacactcagccaaaaaaataagaaaatcaagagtatgtaaaatgtctcatcaaatgcaccagacgcaatcaaaacttactagacatgcatgcaaagaaacagcatatctcttgacccagagtcaagaaaaattcaatcaatagaaatctattccaatatgtctcagatgttggaattaacagaaaagatctttttaaaactgttttaaatatatttaagatcttaaaagataatatcagtggaaaaatagaaagaaccaaagtaaattctagaatgaaaaaaatataataactaagtctttaaaatgggcttaacagcagattggaaacagtgaaagaaaagattagtgaattaaaaaaaaaagatcaacagaaatatctaatctgaaaaacagagaagaaaaagaaattgagaaaagtgagtaaaggatctatgaagaaacaacaaacatatgaacacagatatacttagagtcccagaaagagaggaggtagaaaacggggcagaaaaatatttgaaaaatcagccaggtgtggtggctcatgcctgtaatcccagcactttgggaggccgaggtgggtggatcacctgaggtcaggagttcaagaccagcctggccaagatggtgaaaccccatgtctactaaaaatagaaaaattaaccaggcatggtggcacacacctgtaatcccagctactcaggaggctgaggcaggagaatcagttgaacccaggagacagaggttgcagtgaaccaagatcatgccactgccctccagccagggtgataaagaaagactgtgtctcaaaaaaaataataataaaagaaaaatatttgaaacattgtggccaaaaatttcccaaaatttggtgaaaatataattgtacagatctaagaagttcaacaaacataagcagaaagaaaaataccgaaaattatgcctagatacatcatagtaaaataattttttaaaaaagataaacagaaaatcttgaaaatgtccataggtaaactacacatgagaaaaaggggactgattaatcaaattttgacaagtcaagagaaataatagattccaggagacaatggaattacatctctcaggtgctgaaagaaaagactgtccacccaattccacatccaatgaaaatgtccctcaaaaatgaaagagaagggccggtcgcagtggatcatgcttgtaatcccagcactttgggagtccaaggccagcggatcacgaggacaggagattgagaccacggtgaaaccccgtctctactaaaaatacaaaaaaaaattagccgggcgtggtggcgggcgcccacagtccctgctactcgggaggcggaggcaggagaatggcatgaacccaggaggtggagcttgcagtgagccgagatcatgccactgcactccagcctgggcgacagagccagactccatctcagaaaagaaagaaaaaaaaaaaacgaaagagaagtaaacacattctcaaataatgaaagtgagagaatgaatcaccaaccaacacacactacaagaaatgctatagaagattcttaaggtgacaaacgaaataatagcagatggtaacttggatctgcaagaatgaataaagaccaccagaaatggtaaatatatggatatatatatataaatgggtacattttttcttctcttatttaaaggacatatgaagggttaaagtaaaaattatcacactgtattgtaaagtttacaaaataagcagaagtaatatatatgataaaatagcacaaaaattgggcaaataaaattatgcagttgcaagacatattttacatgtaatgatgtaatattaactaagcagattgtactaaaattaaggatgtatactgcaatctctagaatcaccactaaaaaatgatgtaaagtagtagaactaaaaattcaggggccaggtatggtggcttatacctattatctcagtactttgggaggccgaggtggaaggatcactggaggtcaagagttcaacaccagcctaggcaatgaagaaagactccatctctacaaaaattaaaaattaaaaaaaaatagttgggtgcagtggcgtgtacctgtagtcttagttgcttaggaggctgagacaggaggatcacttgagcccatgacttcaaggctacagtgagctatctttcattgcaccactacactccagcctgggctgggtgacagagttagactctaaagaaaaaaaaaccaatagagaattgaaatgaaatactaaaatattgtattaacacaaaagaagccacaaaaagaggagcagagaaacaaatatcagactggacaaataagaaacaaataacaaaatgatagccctatatccaaaagtatttataattatattatatgtaagttaaaatgtagagattgtcagaatgaatttaaaaaagcaagaatcaaagatatgctgtctacaagagatgcactttaattgtaaaacacaaatagtttgaaagtaaatgaatagaaagtatataccatgtaaacagaaaccataaaaaagctggaaaggctttttttaacaattaaaaaaaatacactttaagagaaagagttttaccagaaataaagatgttgtataataatataaaagggtcattaatcaggaagatactatcatgaaagtatttgtacctagtaatagaccatcaaaatataataagcccaaattgacagaactaaagggagaaatagacaagttcacaattttgagtgagactttaacatagccgtctcagtaaacaataaggtaacaaaaaatcagtaaggatttagaatatctgaaaaacattatcaaacagcttggcctaattgacgtgtatagagcactatacctaacaacttcaggacatatttgcgtgtagaacattcatcaagatagaacataagttaggacatgaaataagtctcagtaaatttcaaaaggttgaagtcttacagaatatattctcggattataattagattataagtaaatatcgaaaagaacttccagatagttagaaattaaacagtatgcttttaaatgtgttgaagaagaaatcctaagaaaaattaggaaaaaatggaactgaatgatcacaaaagtacattccttccaaaaatctaaattcccaaatagaagtttgtgagactcatctaaagcatggtttagaagacaatttagagttttaaatggctatatcaaataagataaaactttcaaatcaatgatctttctacttaaaaagctagaaaaaagaggagaaatgaaaactatagtaagtaaaagagaggaaaataaataagactaaaaaccaacaacacagaaagcagacacaatagagaaacttaacaaagtcaaagttgattctttgcaaagataaataaaatgggtttgcaaagataaataaaatgggtatattctggtgagactgaaaaaatggaggagtgggacaggagaccataagagaaagaacacacattacctatgtgaggaataagaggtaataggagaatattataatcgactttatgtcaataaatgtgacaacttaggtgaaatgaaaaattactcagaaggccacttatcacacttgatacaagataaaatagaaaatttgaataactacatctattacataagctctttcagaaaacgggaaaaataaatacgtgtcaactcattttacaaggccatcaaaatactgttatctgactttggcagcataactctaacaaagacatgaacaaaggaaattagagaccaatgttcctaatacaagcacaataatcattaacaaaatattaaccaacttattcaataatatattaaaaagatattatatcatgaccaagtggggtttcttccaggaatgcaaagttggtcaacatttgaaaattagtgtaattcaccatattaacagaataaagaaaaaaaaacacatgataatttcaatagatgcacttgtgataaaaactctcaacaaactaggaataaaaagaaacttccaggtcaggggtggtggctcatgcctgtaatcccagcactctgggaggctgaggcgggcagatcacctgaggtcgggagttcgagaccagcctgaccaacatggagaaaccctgtctctactaaaaataaaaaattagccaggcatggtggcacatgcctgtaatcccagctacaagggaggctgaggcaggggaattgcttgaacccaggaggcggaggttgcagtgagcagagatcacaccattgcactccagcctgggcaacaagagcgaaactctgtctcaaaaaaaaaaaaaaagaaaaaaaaagaaacttcctcaacctgatatacagcatcagtcaatatcacacttgacagttaaagaggcaactcctcttacgtgattggaaaccaggcaaagatgcctcttctcctttaagttctattctattctataaacttctgaaccagtttgataagtcaaaaaatggaaataaaaaccagaacaattggatagaagaaggaactgattcctatttgcagataatataattctttatatagaaaatcttaaggaatctacaaaaagttactggaactaatgtgaatttagcaacacttcaagattcaagttcaatataaaatcaattgcatttctaaatactaacagtaaacacatttttaaatcaaattaaggttattactttaacaatagctttaagacataaaatacttagaaacaaattcagcaaaagatctgtaaaacctcaatgttcaaagctacaaatactaatcagtgcaattaaataacacatatagagataccccacgtccaaatgttgctagactcaatattattaagatgtcaattttccccacaatgattttaactataatcctagcaggcattttagtacaggtgacaatctgagtctaagacttattggaaatgtaaagggcctggaatagccaaaacaatcttgaaataaaggaacaaagctggaggatttatattatttaacttcaaaacttaacataaattatgataagatgtgtaatactggcaacaggatagacacatagatcaatgaaacaaagtacgaggcataaacagaccaacacctatctggttatttcattctgaagaaaggtggcaagacaattcagtgaggaaaggaaagtgtttaataaattatgtgggaaaacgagatatctatgtggaaacaaaacaaccataacttctacctcattcatccagggacctaaatataaaagctaaaactatagatggtctttaaaaaaaaaacctaagtctacagtgaaaacctcaggtaagtgaagatttcttaaaacagaaaacaaccacagaattgttttaaaagataaattaaactttatcaaaagttaagccttctcattaaaagacactttaaaaatgaacagaaagccacagactgggagaaaatgtaatgtacatatctgacaaaagacttgtattgagaatatataaataactgcagcaattcattagtaatgacaccaatgcaagaaataaagtaaataaaatctgtaatagacacacaacaaaggaaatattatgcatgtccaataagcacatgatcaagttctttcttagtcattggaaaaatgcaaattaaatcttcagtgaaatactagcttacacccaactaaaatggctaaaattaaaagtactgaagacaccaaatattgaccaagatgtgaagcaagtggaactattatacattgctaatgggaatcaaaaacaaaaaagattcgtaatttcttataaagttaagcatatacctgctctatgacccagaaattctacttctaaatgtttaccaaagagggattaaaacacaggtccaaaaagtcatgaatgaggacattcatggtcaccgaaaactgaaaacaaccgaattgctcattaataggtgaacggataaacagattgtgatattgtacactcaaacaatgacaaactatccacaggaaagaactcttgatatatccaaaatatggatgaatctctcagatgtgctgagtaaaggaagctggatacaaagagtatgttccatgattccacttacataaatttctcaaagaggttagaaaatatgtgttgaaaatctatggtggaaaaataatctggaatggaaaaaaaagaagagtttgcctctgccaggggtgttaattaggaagaggcattagggaacgtttagggtgaaaaaaaaagccctaaattttgatagagtgttatacagaatacacatgtgtcaaaagtcatcaaattgcacacttaagatttgtgaatttcatgatatttaaatgttacctcgaagacaaagaaccgaaaacaagtatcagctctagtagatttgcttttctcagtggattagcaattccaacaggagtttttgtgtattctaggttggaacaaatgtatgaatttattgaggataatgaaagccaggtttttaattgttcacggagaaagttagaaacattgaaaagggaaaccaagctgtagattggaatcagaggtacaaatatgaaataatgctttttagtatctagatatagatttgtagatagaggtagcaatagttatggaaatacatagatgtgtatatacatgtatttagatgtgtctatgtaagtgtatgtgattcctaaatctatccactcattggacctagaagggccttcagcaaagaacacagctgctacccagatcattgtctgtaaatatctttactctaataaatggaaccttgaagaaatgctgatcccaaaactagagcaggaaaagtggaagatgaatcaggaacatcttattgtatctgtaaggataggctcaaaatatgatagccacatatcaaaaggacacgggttggcttgaagtggttcccactaatccaaactggcaaaattgcacattaatataaataatagtaatactgggttaaaatctattgagtaaagttagaatgtatgagtccatactgatatgaataaaaagaaagaaaggagggagggaagtgggttagaccgtttttgcattgctgtaaaggaatacctgaaactggataatttataaagaaaagaggtttaattggctcatggttctgcagacagtacaagaagtgtggtgctgggcggggcacggtggctcatgcctgtaatcccagcactttgggaggctgaggcgggcagatcacctgaggtcaggagttcaagaccagcctgaccaacatagtgaaatcgtgtctctaacaaaaatacgaaaattagccaggtttggtggcacatgcctgtagtctcagctacttgggaggctgaggcaagataattgcttcaacccaggaggaggaggttgcagtgacccaagatcatgccactgcactccagcctgtgcaacagagtgagactccatctcaaaaaaaaaaataaaaaaagaagtgtgatgctcgaatctgcttatgatgagggccccaggaagcttccagtcataacagaaggcaaagggggaacaggtgtctcacatggcgagaggggaagcaagagagagatgggggaggtgccacatactctcattttaattttttaaaatttatttttaaatgtttaaatgtttgatgtttgtgggtacatagtaggtgtatatatttatagggtacatgagatgttttgatacaggcatgcaatacgtaataatcacatcatggagaatgaggtatccatcccctcaagcatttatcctttgttacacaaaatctaaatactcccttttagttatttagttatatgtacaattaagttattattgactgtagtcaccctgttgtgctatcaaatagtaggtcttactcattttttctattttttttgtacccattaaccatccccaccttccctccaccgctgccctcctcccagccctaccctttccagcctctggtaaccatccttctactctctacgtccatgagttcaattgttttgagttttagatcccacacataagtaagaacacgtgatgtttgtctttctgtgcctggcttatttcacttaacataaggatctccagttccacacacttttaaacaaccaaatctcgagtgaactcagagcaagaactcattcatcaccaaggagatggcgctgagccattcatgagggatccactcctgtaatccagttgcctctcaccaggtttcacctccaacgctggagattacatttcaacacgagcgtcggaagggactaacatccaaactatatcaggagggatggcgggaggaagggaggagggagggagggaaggacagaaggaacggaaggaggaaggttgtttactacactaccagcctcaaaaggaaaaatgttaacatagattgcatagggttttgcaatcatatacactcattttaatacctataatctttattcagcattttaaattaactgtatctatttcctatttatgccagctgaagaacatgtggctttgaattatttcaaatgcaaatttttttccccattttatcattttgttggctgtattggttttctatggctgttgtaacaaaataccacagatttagtgtcttaaaacaacgcaaatttattctgtcaccatgctggaggtcagaggctaacatgagtcttaaagggctggaatcaagctattagcaggactggttccatcgagaggttccaggagagaattctttctttccctttcccattccctctctccaatatgtctttggctttgccttctgctctaacagagtccaatttgtccctctgtttctttctttgaagaaaacctgtgattatatttaggacccatggggctaattcagtataatcttctcatccccaagtctttaacttcgtcacacctgtgacattcctttgccgtataagggcacactcatgggttctgggcattagaacatggacattttaagaggccattattaagcccaccacattgattattctaactatttagtctctgtccaccagaccactgaaatgaaatatttgtcattataataatttatatttttattattttactcttaaggtgaatttacaatactttatttcagatgaattagaatatttaaaaatatgaagactaaacttatacttaataagtaattagacatactttttttttttgagacagggtcttgctctgtctcccaggctagagtgcagtggttcaatcactactcactgcagcctctaccttttgggcttgaacaattctcctacctcagcctcctgagaaactgggacgacaggtgcatgccaccatgaccagctaatttttttttatttttcctgcagatgcagtctcgctatattgcacaggttggtcttgaactcctgggctcaagcgatcctcccgcatcagcctcccaaagtgctgggattacaggcatgagccactgaatatactatttatatatcatttataaataaatatataatatattaataataaatctgaacttcataagactattcaatctgaagttttttccgttagtttagttctctttatacttaagattctagccaaagagtaactatgaaaagtaataaacaagaatcagagttggaagatagtgtatcctattctagttgcttagtcattcattgaacaaatacttacttggtcccaagtgctattatagatactgtccagcaaagaagagtgtacttccatttgctcttctctgttatggcagattgtttttgccaagatggttataacaacacctcccgttctacctgctcatcttatcatgcaagttgtcactcttcactttgagagatggggactatattccctttcttcgaatccagacaggcctgtgatatagcagtttagccatgcgacttctaaggttaggtcctacaagttaacacagattctgcctggctctcttaggacgatcagtcttggaacccaactcccacactgtgaggagactgaggccacatggagaggtgactgtgttccatcacgtgggtgtcccaggcaaaagttcagtagcatcaactcaccagccagatatgtgactatggaagctttagagaataactccattatttcagttgaaccccaaaatcatgagaaatagtaatacaataatatagtttttcctaagctgctacgttttggagtgatttgttatatggtgacagataccctgaatatctcttacctactcattttatgaacatacacgaaacttacatttcataatataatatataaaattgagaatgagctcacttcctacctattttattaaactaaatgataccatgtatatgtcattctttcaatgtcaatgaaaaaataacaaattaaattcaaagtgctttctatgtgccttttagattgttattgaggagataaatggatataaaaaatcattcaagccggtcacggtggctcacgcctgtaatcccagcactttgggaggccgaggcgggcagatcatgaggtcaggagttcgagaccagcctgaccaacatggtgaaaccctgtctctactaaaaatacaaaaaattagctgggcgtggtggcgggcacctgtagtcccagctactcgggaggctgaggcagaatggcgtgaacccgggaggcagagcttgcagtgagccgagatcgtgctactgcactccagcctgggcaacagagtgagactctgtcgcaaataaataaataaataaataaataaataaataaataaataaatcattcaagcaagaatttcaagaaaaaatggaagcttcatgacttgctggggcaaaatcactattgcctttgtttttttcctttctgtctcatttttaagccatctgactttcaaaattaccctgcaaactctggtgctcttctaactttcctctcttcatgtgtgtcaccatcatccatgcagttactgaagccagaggttttagaagttgtccttgacctctctgtctttcacatccatatccaatctatcactaagtcctgaccagttcttcccaaagaacttcggaagttttctgctttccatctcccctgacatgatctcaattcaacagaaacctatcaattgttctccccaaatttctagtccccaccaatcctttgcatcagaatgcaaatctggtcatgtcactgccctgctttcctttttttgagacagagtctcactctatcacccaggctagagtgcagtggcatgatctcggctcaccgcaatctctctctcccaggttcaagcgattcttgggcctcccaagtagctgggactacaggcgtgtgccaccatgcccagctactttttgcatttctagtagagatggggtttgccatgttgggtaggctggtctcgaactcctgacctcaagtgatccgcctgcctttgcctcccaaaatgctgggattacagtcaagagccactgcgcccggccctgcttcatttcgatggcttctcaacgctctcagagaaggagatcaaatcctaaatgtggtccacgaggctttggatcgttggactcctttctccctctccaggttcttcgtggcagcttcttgccttgtattctagccataatggccttttgtcatttccctgtgtcttcctaccttggagtctccttgactaagatccctatgcctgaaatcttcttacgtcattttctttgttaatatggttctcatttaactgtccaagcctcccttaaaagattatttcatcaaaggattcttccctaaccccagcctaagtcaaattctctgcatttttacatctactgtactgtgtcactaaaaaatataacaggaacaaaaaaccaattcataagatttcatatttttttccaccaccacaatcactaaagaaaactctcgccaggaggtagcttcatttgcattgaggatagaacagatggaagaagaggaaaagataggagtaagaggtcaaagagctaagaacttctcgggccaacggtcaggaagaacttaggaaaattcatttttatcagtgagtaactggaaagagaaacactgagaatgtaagacacaggaaaagatgttaaagcttttctgttttgcaataagatggactctcttgggtattttctgaagagttgcaataaagtttttttctgctggactgaccaagagaggggctgctttatatagtttatgcatattgaatattaatttaacaacgctgtcctcctctcacctccacttacatacaaactttatgtggtcaatgtcttgttttgcttgtcattgcaaccttggtgtttacacaattagtagtgggggctgaatcaatattgattgaattaatgtgtgatttagggcaatttgcttaacctctccagacttcaatatttaccccctcctcccacctccagaagcctgggatagcctgaaacagctaattacagttctgatatttctctggagtttctttgaagtttcatgttttgtctaaaaaacttgttttatgattcattttacaactttaatgttaatattccataccattatatgtcagtatttatttaaaattaaaataattttatctcatgtcttctaacaaaaggaatggcattgtacctattacctccagtgctatacagacttcaaaccagtttgacaaactcaaggattcattaaataatcacaaaggctctctttgagccaaaagttttatgactcttggcttctaacaagtcgaacagctaatatttactgaattccttttatgttcaagtcacaggggagaatacaaggaacaatgagatgaactgccttggagatgcagttatgatgacaagtcatgcatatgtacaaaggtaatattgtgaggcagtacagactgccaagtgagtagagcagcttgttaatgcagaagaatccaggatgactgagccctctaggcctcaatttcctcacctgaaacatgggtaaccatgcttatgcttttatatcacaggatggctatagaggtcaataagatgaaatgtacctacatacaaattagaaagcatcttattctcggagggtttcgatcacatggcaaaaccttgagatggagtaggaaacaagttgatagacgagcatagcagaacggccttcatgaagacacagaaaaagaaatataccacaaagatacaggaaactaaaaatgacaatctttatggggtggaaagctcaatcaagtgagatagctctgaaaaagcaggatattgtgggccttgaattctaagttaggaaatttagaatcactactgtagatgtcattttcaaaagataaatcccttggtacataatttggttcatattttgagacagctgggaacatttggcacagacaaaagggctattttaaatgctttgactcctttaaagaatattaaagggacacgtgaagaaatcagataattgcttgcagggatcaagtgtcaggatggtaatattgctaaaagaggaaagaagagaacatggttgtttttttgagttaaaaatgaactggcattatgccagatgtgggcaaacagaatagaagtaaatttgaaaggagtttcaatataactcttgatgcttggaggcaaaaagcaaatggccttcagcgtaatttggaataaattctagcattattggatgaacaacacatggcttaaattttaatccaaaagctcaaccagctctctaagatgaaagtgtggcattggtagaagaatgagtttttggaaaataatatagaggaaatagtacctggtgttggtgataactctatatattcaattgtttaaatgagatttttgaaagtcaactaaaaagaaaatacattgttagtatacagtattagcatttgtttaatggaagaacgtaagtgcaaaacaaatctttattttaagaagtttccagaaagcacatctcttttgcaaaatgtggaaaagcccaccagtgttgaaaccatatacctttgagtgctcttaaagatggctgcatttgaacactgcatattgtgctataatttgtgtagaaaagaaagaatacatctacttgttactatgttaataaaataaccctggaaatatacaaaactaacctatcatcttggtttgccactaggacataggagtgaaagggagaaatttcttaggttttttttttttcgtttttgagacagagtcttgctctgtcacccaggctgaagggcagtggtgcgatgctggctcactgcaacctcttcctcccgggttcaagcgattctcatgtctcaacctcccgagtagctgggattataggcgcctgccaccacgcccagctaatttctatatttttgtagagacagggtttcaccgtgttggccaggctgatcttgaactcctgaccacaagtgatctgcccgcctcggcctctcaaagtgctgggattacaggagtgagccgccccgcctggccgagaaatttctttgtatatcattttggatttttaaagtttgaatcgtatattttgtagtccaataaacagataaacaaatcaaatgacctcaaataaaatgattatctttgatatggtttctagagtttgaagttcactttattaataaataagtcaacttaccctacgtactcagatgggtaagatgataatcctttttctccagcacattctttccaagcttctttagtgtgcatcagaatcacctggggactgttcaaaacagattgcttggcctcatcccccagattctctgactcagactggctggggcaagtcccaggaattctcatttcaacaagttcccaggtgctgctgctgctggttgtctggggaccaaaatttgagaaccacgtttttgtgttgttgttgttgtttgtttttttgagagagtcttcttgctctgttgaccaggctggagtgcagtggcatgacctcggctcactgcaacctctgcctcccaggttcaagcaatcctcctgcctcagcgcccctcgtaggtgggattacaggcatgtgccactatgcgcagctaatttttgtatttttggtagagaaggggatttgccgtgttggccaggctggtcttgaactcaagacctcaggtgatccactcacctcagcctcccaaagtgctgggattacatgcatgagccaccgtgcccggccaagaaccactgttctagcagtaacatcagcaatgagtcactggtgctgtaaaacgcttcacattccatagcagaaataaaaatgtatatgaattagaagtctgctgggtgcggtggctcatgcctgtaatcccagcactttgggaggccgaggtgggcggatcacctgagatcaggagtttgagaccagcctggccaacatggtgaaaccccgtctttactaaaaatacaaaaattagccaggcgtggtggtgggcgcctgtaatcccagcttctcgggaagctgaggcacaagaatcgcttgaaccagggaggcggaggttgcagtgagccaagatcacgccactgcactccagcctggacaacaagagtgaaactccacctaaaaaaataaaaaaagtcaccaggctctagagaacgtaagcaaaacttcaaaactttataaatctaaaatgtaacccgttttgaaggtagcatctctagataaattgctttaaaaagtcttctctgtgatcggtaaatcaatgccatgcccagcactctactgttatgattactctaatgacatagaagatacccctctgccatcaaggagctttgaatctagtttaaaccaatgagtccccttttgagacatgatccatttaaatgtttgttttaatactgaattacatagaaggtgtaactcaagaagtttcgtgaaaagttttagtatctcttgtatttatttctcattaacttttacccaaattcagacctgtcaatgctggtgaagagtaaataatttgcaatttgcacatggtgaattgaaagcccatgaaaatacagatgtgggccgggcgcagtggctcacacctgcaatcccagcactttgggagaccaaggcgggtggatcgcttgaacccaggagtttgagaccagcccgggcaacatggcaaaaccctatctctactaaaaatacaaaaattagccaggtgggtgcgcctgtagttccagctacttgggaggctgaggtggagggatcacttgagcccaggaggtcaaggctgcagtcagctgtgattgtgccactacactccagcctgggtgacttgtctcaaaaataacaaaacaaaacaaaaaatagatgtgggttgaaggacaagttctactgctaatgttatgtaagcttaacttttcttatactgtttcttcatctaaaactgagtataattttaactataccaaatgtgatactctatgacaataataataaaatctaacatttattgaacatttactaataatttacatgcattaattcattcactcttcccaacaaccctataagataggtactattattatcattttccagataagaaaacagaagctcagagaggtttaagaaacatgtccaaggttagttggccagtaagtaatagagccaggattcgaatactggtcccttccgtaatcaccatgcttgctgcttttcttaaaagttggagatgaaggtagaccttttttcacctcaaacaccttagctatctttagtgggtcatataaaggggcctttgtacttttaaaaacatattgccctggtaagtttctataaatgtggagaaaacacatgtacttacctgattgtatgatatggttttttgtgtgcgcacaaggtagtgctctgtgagaccattgcatataagtctgttaagttcaggtaatatcttggctgggcgcggtggctcaagcctgtaatcccagcactttgggaggctgaagtgggtggatcatctgaggtcaggagtttgagaccagcctggccaacatagtgaaaccccttctctactaaaaatacaaaaagtagctgggcatggtggtgggcacctgtaatcccagctacttgggaggctgaggcagaagaatcggttgagactgtgtctcaaaaaaataaataaataaataaataaaaccaaaaatcaataccaaaatgcctatcaatcccaacactttgggagtccaaggcaggagaatcacttgaaccctggagttcacaatcagcctgggcaatatagtgagaacccatctctacaaaaaacaaaaaagttagctgggtgtgagtgtgatggcacatacctgtagtcccagttactaggaaggctgaggtgggaggattgcttgagcccaaaaattcaacgctgcaatgaaccgtgatcgcatcactgcagtccagtctgggcaacagagtgaaactccgattcaacgaaacaaaacaccaagaggaactctggaaaatatgtaaatatatggaaattaaccaacatgctcctgaatgaccactgggtcaacaaagaaattaaggtgggaataaaaaaaatttctagaaacaaataatggaaagaacatatcaaaacctataggattcagcaaaaatagtgctaagaggaaagtttatatcaataaatgcctatgtcaaaaaagtggaaatgttacaaattagcaatccagcaatgcacctagaagagctgaaaaagcaagaacaaaccaaacccaaaattagtagaagaaaatagataaataaagatcagagcagaactaaatgaaatagagaaaaaaatcaacaaaaaggactggtgaaaggaaaaattggttctttgaaacgataaacaaaatcgataaaagtagactttattttttagggcagttttaagtttacaacaaaattaagcagaaagtacagagagttacgatatgtctcccaccttcacgcgtacataatctctcccataatcaacattccaccctcaagtggtacatttgttaacaatcaatgaatctatgttgacacatcattatcacccaaagcccatatttaggattcactctcgatatggtatattgtataagttttgacaaatgcatagtgacatatatcctccattgtagtatacagaataatttcactgccctaaaaatccttgggctctgcctattcaccccctctccccacataacccagtaatattttttctttttcttttttttttttttttagagaaagtctcactctgtcattcagggtggcgtgcagtggcacaatctcagctcactgcaacctccgcatccagagcaagagattctcatgcctcagcctcctgagcagctggaattactggtgcccgccatgacacctggctaatttttgtattttttagtacagacagatggggtttcaccatgttggtcaagttggtctcgaactcctgacctcaggtgatctgcccaccttggcctctcaaagtggtgggattacaggcatgagccattgctcttggccataaccaagtaatttttaatatgtttttcttatacaaataatatatagggaggaagaaatattttcatctaaataatatagtatggttaagaatgtttgcttagtatagacatgaaactaattatcaagaatgtcagacaagtctatcaagcagtataacttcagaatgataggataagccttcatgtgtcttgtacttaattcgtcctcttctatgcttaggtaaagatttcttaaactgctgtttaaaaacactaaccacaaaaacaaaactaataaatacgcaagaactacccatcaaaagagaatgagaaggcaagccacagccacggagaatatatttgcagagcttatatccgtatataaaggaaacctacaaacccttagaaaaagacaaacaactgaattttaagatgggccaaaagactcgaatagatccttcccaaaagaagttacccaatgggcgtaatggaatgagtatatgaaaaagtgctcagtctcttagttatcagggaaatgcctattattgagatgccatgatgtacccatcaagatgatgagttaaaaacaaaacaaaacaaaacaaaaagcctgaaaatacacactgttggaaacaatgtggagcgactagaagtctcatacgttgctggtgggggtataagttggaaagataactttgaaaaatagttttgcaggattaaactaaagctaaacatctgtatacctcacacaaggtacatatagaagagaagcaaatgctttcgtccaccaaaaggaatatgcaagaatgttccaagaatgttcatcgcaactatattcatcataaaccaaacctgaaaacagcccaaaagctcaacaatagtagaattggtaaatgagttcgggtatattcatacaatggattctactacaagcaacaggaagaaacaaacaattgttgcatgttagaaaatgtgtgaatctcactgaaaaatgtttagcaaaagaggccaggcacaaaagtacctactcgtgtgtgtgcgtgcgtgtgtgtgtgggtgtgtgtgtgtgtgtgtgtgtaaagttcaaatacaggcaaaatgatggtgatgaaatttagaatagtataacagtaattgcttcaaagttcaaggacagggaacagtaacggggaagagatgtgacagagcctttgggatgctggaatgttctatatcttgatttaagtagttctgcaccaatgaatacacatgaaaattcatcgggttaagattcacgcactttacacctgaataaaaaagaaaacaaagtcattctgtttaatataataaaatacgtatttccacgctaaatattacgtttacagctttgaaagattaaaagactgaaaaagtactgagtattaatctaggcagaagggtctgactgcctttgctaaatatggaattggcttggtaaaattacactttacccatgcagtggtgtgcaatgattccatcagtgggacacttggaggaaaatattattgaataactttcacccagtgaatatgctttttgttaagagacgcttgcttctaattgctttaaatttgtgagtcagaaattggaggaagagggggtggaaccattccccacccttctccccttggcacccctactgaccacagatctttcgctttgattcttattagaggttttctgtccaattttatggttttccgcgttctaaaacacacattgtataaataaatgacacatgcttagggcttgcagatgcctttagatgtttctcaaacttccctgtgggccagttctccaccttcctggtgtttgggcttgaattcacagtcaatagttggaattttactttggactttcatttgtctattgtcccagtggctctaggtaggatttgattaggattagcccataggatttcagtaaacgaattttagaaattgttggaaatgtcacatccaccaaaataaattttgtatgatgtccctaatgcatgttaataatccgttggtatatcatatgctgcattctgtaaaacttaactggaacatatcaaatataattggtaaaggtagaattcagtcagctcctaccttcaagttcaaggatacatcctgctggctaggcagaaaagagaggctgaaatttctgcatagcagcttgacttaaggtttctgcaaagacagcacactagaaatgataacgaatgtttgcaagctctttcttcacttaccactgactacaccagattaggaggagtaaaatatctaggatctggagaagatggagccttatgttatcttgatgtacagtatcagatgcagattagggctaagggcttacgtggtgaaacgtcattctgagattgtaaatattctcccactgctcacccagccatgtgcaggacgtaatagtttctaattgctctgagtctgtgggctcctgagtcctcattcatccatccgagctggggttttggtacagagacaatgatgataagaagtactttcttctctttgtccctgcagacggttgcaaaatgaatcttttcaggattttatcatcggggtgtcaggtcagatccatgaggcaggaatgtcaagttggctaaaggacattctaaagtgaatttattaaaatgattctaagagagaattaaaattgtgctaagaaatttttttttactgggtttacacaaaaccttcatgttggtagtcatttacctgtctttgaaaagtagaatttcgagaattgaaattgctagtgtgtgattccttagtcaattttctttacaattgccttgatttctttcctccatgactcatttctttctcttcagcttagagatactttgtaaagtgtgattaggtgttaagtgtgcggattctagagccaaggtaaccgaattcaaatcccagcctactagctgcatgatcttaggcattattacttaacctctatctgactgtttcttcatccgtcacaaggtgggggtgattattataaaacctagtcacggggtcactggtaggatgaatgagtaagtagagataaagctcctagcacagtgtctggcacgcagtaaacactgcattaaggatcaactttatctctgttcttgttgagggactcccctgtatctttcactgcatggcttggctcttcctgatgctctttctttcccagtcttaactccatggtttgctctacatcagcgtgccaactttgtttatttcttggtatagtttattcaaaagttttgaatcctaaaatctgggtggtggagaaggaggagattattattgaccttcattacatgcctccaaagaccttggtgtagtacgttaagactgtcacttgccaagtgactcattcattacccaatactgtcacgcactagtcataagacaattggaagggacagatgaaaagaacagccatctactttaattgctatgttttggaaataatgtataatattaaaaccacaactccaaatcataaagcctaaggtttggaagagaccgaaaatcactcagcctaaccacccaagtgatgcttgtgtgtatttgcaatattctgtatggaaggttcagcctcagttaagtatggtgatactcttatcaactcaagaagcagtttatcttttagatggctcggattctttggaggatctttctaactttagtcaaaattaatatactcacagtttccatctattatgtattttcttttattaatttactcttgaagtcttatggaataaatgttatgcatctttccattaaaagccctccagatatttgctgactgctagcatgtttcttctggagtcctctctggatattccagtcgagctaaatattactcatcttctccaatgtggatggtctgttctgaatgagctatgatttcttaatatccttttaatgctggtcccaaattgaacccaatactccatatatagttgggtaagctcaaagtagttactacctgtgtctactattctagcttctagatggttatacttctattagtgaactccaagatcatattagcttatttttggtagctacgtcatatttgtgaaaaatattgtattaattttgtccaaatgactttttccgtgccctaagacagacctaaccagcagcttattctttggagtttccacagcattttgtatggattgctattgtaaaacaaaaccaaaaaatttatctacagttatacactgcatcagaacatcttggtcaatggtggaccgcatagacaatggtggtcccataagattataatactatatttttactgtactctttctatgtttggatatatttagattcacaaatacttatcattgtgttacaatttcctgcagtattccgtacagtaaatgttatacaggtttgtagccatctagatttgtgtaagtatactctacgatgttcacacaacagcaaaatcacctaaagatgcatttcctagaatgtatccctgttgttaagtgatacatgactgtatattataatattgtgtttctattctaactattttattgtgttcttgcatttgactatgaactctgcataggtaaatttttcattattttgttgtagtggctaataacccatctgttactcaaaatatgtttgtcaaataaatgttgaactaatcccttgatagagcattttaaggtaactagttaacaaagaccactgcaccataatgtcatatgaaaattttgatatcagaggcccacagagattgatagccccatctccttttctagagtcctacttatacctaaaccatccagctaaaggtttgtagaactgaggtctaatggacttcaggaaaggggattattaaacccagtagcttagtcaagtgcatgccctatgtacgcctctaactatacaaccattggaagtattatgcaagagtgtggctagatcactttgcagtcagcactcaccatggcaaagcaatcagctttagaagacagaggccatgtgcgagcctgttccaaggaaacctgatcctggaaacttgcagtgaattcggctgccttggcagtgacatctcatctggcagcctggaacaggaaaacttatttagagaacaaacatgccttttaggagctcgcagtgagtccgatcttaaactgaaaactaggggcctaggagattatggttctgtttatgttgtttgtgttttacatatgctgcgtatcctcccttaagtggtctttggttaatacatattcctggctaacagttgctgtattgaacacagaggaacagacacacctctagaccttcattcttctggattttgcaaacccgatagtcaatttccagctcagctttgatagtaatatttccaaatgataaggaacaggaaatgtcgcaacaagttctcctgacaatgaggtcctgtgtgcctaggttttgtagaacatactgaaaaagtaggtggccatgtctttgatatgctttccaaggtgcatccaactacagtctccttcctttctgcccagtaattcccatcagtgaacttaggcccaaaatcaataaagctgttttttataaactattattaaagggcatttccactacctgagaaggaagggaagacgttctagctcacccttattagcaccgtaggaggcactcgtgaatcaatacctgaaaatgtacaagtcccagacaatcagtgctcagagcgagagcgggcagtggctgaacttggccccaggcccacctatgaagcctcccgaagacactgaacagcctgatgcagagaatgccaagtactggaggggcggatgcaaaggttccagaccaagctcaagggtgttccagtgcgctggccagcatcttagggaggaaggggtaaaggaaggaaaagaagcctagattcacctacaatttgatctgtgaggagtgttgtttatgagcggcatcctttgcaaatatagctttggagggaaaacaaatgcatgctataaatttccagtaacatcctgcctgaggtagactcagtcactctgtaagaccccactgtgcagacagggaaaagagacataactgcagctgattctgcaaacagtggccacagtgtcctaccaagatgacagaacagaggtcacagccaccctctaaagggcctcgggtctggcacccaccccctcgccaccgccttcttgccaaactcataaacacccaagctggaaaaagctgacaatgtatcttcctctcccacccctgttggaactttcttggatgaaccacttcataaactttccccctcatgcagaggaagacttcttatattttttttctcttactttaggaaatttgaacaaaatatttttttcaggtaaaatatacaaatatttatttttaaatatttgcatgtcaaaatacactcaggcccagaaagtactcttaatgggagactcatcagatcttggtattgaaggctctgtgttttggcaggttttatttatggttatagaaaaaaaaaaggagtaactgaaaatgaaaatggttgaatagactgccccacaatttaccaatttctttcttttattttctttttgctctgggcctgagaccagcatggaaaagttttagcttctaaatagactctttcaggaagatttgtatgctgatgaagatggtgtaaagaaaagtagtgtaccaccctaacttgagcttttttttttgagacagagtctcactctgttgctcaggctggagtgcagttgtgctttcttggctcactgcaacctccacctcttgggttcaagcgattcttttgcctcagactcctgagtaactgggattacaggcacccaccaccatgcccggctaatttttgtagttttagttgagatggggtttcatcatgttggccaggctggtctcgaactcctgacctcaagtgatccgcccacctgggcctctcaaagtgctgggattacaggcatgagccgctgcgcccaggcacttgtgctttgattaacattattttcctgtgaaacaaattaaagtgatcaatgagctccagggattcatttttaattaaatcatgaagcagctggcattcatggcctcttggcaggtagtccagcctgggcttgctgactggaggaatgagagtggggaacttaccagctgtctaagcgtcttggttccaggtaaatgatacttatcaggctgttgaagaatttagggagcacacctgatagataaatctgcacacagctttattgaattactcttttcttgctctgtttcagaaaactgtatgagaatataaatccaaacttttcacataaacttttatcgcttttaggtttgttcagaaagattgtccttgaactgaaatgaacacatcaaaactgctcagcttctctgaatgggaagtattgagaaatgatctttaaactttgcggtgaatcagatttatttatggaactttttaaaaatgaagcagcccaggcttaaaacttggtatgaaaaccagccttgagagtaaaatacccagttcctccaaactcctagttcctctgcgttacttatcctaccgcgtggtgactcacatacaaacaatatacagatgttctttgaacctggatttcaaaagatccgtattcagaaagaattctcaatcacattcaccatattcctaatagactccaaaagttctcagagttttctttttcccaatcctgctgatctctgagtcaacatggagcgcccttgttaaaattttattttaatttggcattgctttattttgcgtaatcattgtctaagtaaaagtctatctgcttctgacttttcagaaagagataattttatagaaagtgttatttatttcctatctgttcaacatgagtaaatgtatgaggacattaagattctttcgaacacaattattagcatattacacaagttgaaagggattggtgattttccaccccaaagcgacttcctgtagtttcaaatgtaactttcctgtaactagggaagcatgagctatttttaagctttctttttttttttaaatagtgattaaaaagctagtattctctataaaggattttctttgaagagcatgtgattcctaagaatctcaattagttggtcaccagaaaggacagggaaggctttatagctagcagacttttctaaggtttcattttacaattcaggagctctgtgttctaataccactcaactgtcaagagatgctgtaggtggaataaagcagggaaataaaagagatgaaacagctggcatatgttagccagctttaagagctccaaaattacccggtattctagaaaattatgacgtgcgtgatcattctctctgggagagaagctgctgcagaaagcaaacagtgacgtagtatgcaacaaaggggcatctgtgtggcaccctgaagaaaaatatcaaattacccccacatctagacagtctgggtaaggttatcatcttctaataaacgtaaaattctagttcttctaagatatgctcctggccccattccaattactgtatgaccttggagaaatgtcttttgaagtgtttctgtgtctgtaaaacctggataataatactgtctgtcccagatggttggaattgtatgaattaattagttcaagctggaaaggtctttgataatgttaagtgctgaatattgttattattatagatacaggtggaggcagtgctgcacagcacatctataattagaaaggcctagaaactgaaagtcgtgccaacaccgcgggagttaaggagacaataccttgtgtcattttctcccgagactcagtcagcttgctatgatggaatacttaattcgctcttatcctcttcgaaaggttgaagcttgtcttggacttgccaaccaagcaacatagtttttaccgggtgtatgtgctttttcaggcagtgttttgaatgaagtgctgacatttattagaacacaggatacagtcttgggtttacaacgcttgttaattgttctgagtcaagagaccaagaaattccattaccagaaacacctgtcatctgaaaaaaatgcagattttttttttttttttttttttttttttttttttttttggagacagggtctcactctcttgcccaggctgacatgtggtggaacaatcatagctcgctgcagcctcaaactcctgggctcaagtgatcctccttcttcggcctctcaagtactctcaggactacagatgcacaccaccatatccagctaattttttttttattgtttttgtagaaatggggttcttgctttgttggccaggctggcatcaaactccttgcctcaagctgtcctccttccctggcctcacaaaagcactgggcttacaggtgtgagccaccacacctggccagaaatgttcttgagctataaaatgaagaagagatctaaccttcttttagagattaaaaggctttcttttttcataaacaaactgcaaagtgttatgtggaatcaaaatacataaaacaggctgggcgcggtggctcacacctgtaattgcagcactttgggtggatcacctgaggtcaggagttcgagaccaggctgaccaatacggtgaaaccctgtctctcctaaaattacaaaaattacacaggcgtggtggcgtgcgcctgtagccccatctacttgggagactgagacaggagaattgcttgaacccgggagctggaggttgcagtgagctgagatcacggcactgcactccagcttggggaacagagcaagactctatctcaaataaacaacaacaacaaaacaagaacaacgtaacataggttaaaaactgagctgtgctgaataaaaggaaaaagggaaagattttccttgagtttgtaataaccctgaggaatgttgtcagaatctaaggctcccctgagcccactggaccataccatgtctaaaccaatttttaatacctcattttttgagtattctaaataccagcaacattaaaaacctgcactgctgggctcttctggaagatatagtttatgcagactgacaatttatttcatatgctatctcctctggaaaaccttctctgaccatctcgtctcgtcttacaagttcaactattggtgaaagtcacacagcactccaatttaccatttcaaattcctttgttatcttcttctctatcatcatcatagcaaatatttatgaaatacttatgtgccaagcatggtattatctcatttaatcctctcaacactaccatgggatagttataatattattcatattttagagatgagaatattcaacacagagatgtaaaagaattgaccacctaggaaatggtgaagacaaaaggtaaaccccaaagagcttgactcaaatcttcttgggcaatagcaaaacccaagatcatcttgtttatcactcagtatagagtaactgcctatgtgtttacttgtctttctccaaaaccagacctgtcggtttcttgagaggaggaactctgttatgctcacggctacatcactgtgacctcacacagcacctaacacacagtagttcttctttttttccccatagggtttgggggaacaggtggtgtttggttacatgagtaagctctttagttgtgatttgtgagattttggtgcacccatcacccaagcaatatacactatatccgatgtgtagtcttttatccctcattcccccttctaccctttttctcaagtccccaaagtccattgtatcattcttaacgcctttgcatcctcataccttagctcccagttatgagtgagaacatactatgtttggttttccattcctgagttatttcacttagactaatggtctccatttccatccaggttgctgcaaatgccgttatttcattccttttttttttttttttttttttttgagacggagtcttgctctgtcacccacgctggagtgcagtggcatgatctcggctcactgcaagctccgcttcccgggttcacaccattctcctgcctcagcctcccgagtagctgggactacaggggcccgccaccacgcccgggtaatttttttatttttagtagagacagggtttcactgttagccaggatggcctcgatctcctgacctcatgatccgcctgcctcggcctcccaaagtgctgggattacaggcgtgagccaccacgcccggcctatttcattcctttttatggctgaatagtattccatggtatatgtatatatatatatatatatatatatatatatatataccacaatttctttatccactcattgatagcaatcacactcctgggattgatagtagctgtgtggattaatactgggtatctgcccagaggaaaagaagtcatcatatgaaaacaatacttgcacacagagtagttcttaataattgttaaattatcaaactggcagcatgtttccttcaaaggataaaacaatttgcctatggttattcaaaagagtaaaatattaaataaattagagttatggttgaatacagtttaaaatgatgaaaaaatttgaaaagtaatttctaaaagaaaacactaatctttgaacatttgggatgaggctactttggtggccaagcctaaattcttattccgcccaagaaagtcaaattgacacaacatttgggaaaggtattcagcaattccacttctgcaagtttatcttataaataattcagaaaacaaaataaataaaattattgtgtagaaatatatttattacaacattgttataacaaataattggaaatagcctaaatatttaaaaaataattaaaagatttttgaatggtcaacaatcagaagaagaaccttatgataattttttttttttttttttgagacagagtctcgctttgtcgcccaggctggagtgcagtggcgcgatctcagctcactgtaagctccgcctcccgggttcacaccctttatgataatattttatagaaacttcaaaattatgtatgaaaatatattttaataacttgtagatatagttaaatcacagtactgcattaagtaaaagaaggaaaatacaatcctacattacataggattaaatgtatttaatgtacgtattaaatgcatttccctaactattgttagcaaagcaaaagaaaaaaaccgaagaataatctccaaagggtaacatgggttagctctggttgatgagtagtttttgctttcccccccttaaacatttctgcattttaaatttttctacaagaacatgtcgtgatcagatgaaaaataaactgtggttttttttaagtgttattaaagagcagccatctggtatcacaagatcagttaggttagatttaggaaactcatatgaaattaaaaaaaacctttagaggagcaaacttggttgtttaattcctagaggcaaattgcatgccactgtgtgtcacatagtgtatcacgtacacacagtcagttccccaagtatcaggagttaagaagatgcatttattgaaataagaattgatatgatgtccatgttactcttattttattctacaattgtttctgctaatattggaagtttttggctgggcgtggtggctcacacctgttatcccagcactttgggagtccaaggtgggcagatcacttgaggtcaagagttcaagaccagcctggccaacatggtgaaaccccatctctactaaaaatacaaaaaattagccaggcggggtggcatgtgcctgtagtcccagctactcaggaggctgagacaggagaattgcctgaacccaggaggcggaggttgcaatgagctgagatcataccactgcactgcagcctggacaacagagcaagactctgtctcaaaaaacaaacaaaaaatttttgaatttgggtggtgaggtaaatatctgggctcgtgaacatattaaatgcataattgttgcttataatttcatttatctctcttcagtcagattaaatatgacctactatgttgccagacacagtgctagatgctttttcactgtatctcataattcaactcacataacaactttttccagccagttttaatgtccacacttgacagatgaggaaactaactttcagagaagtgatcattccaaattcaagttgtttgttgggctatgaatgctgatcttcagcacctgagaaactttcgatagtatcagaagtagaccatttatcctattagaaaactaaaaagcaacaaacatatttatttaaaaaatttacaaatgataaaaaattaataataaaaacaattctcatttttaaagttggaatagtctctagggcttagtaactggaaaaacaataactgaatctccatccaaaattatgttctcatagccagatgtgatgccacacacctgtagtcccagctactcaggaggctgaggtgggaggatcactgaaccccaggactttgaggctgcggtgagctatgattgtaccactggcgctccaacctgggcaacaaaacaagaccctgtctctaaataaataaataaataagtaaataaaattattgtttcctatctgttttttatttctatcatatcagttccttctatagagtttgatgattggcacatactgtaatgtgtgagcaaatcgcatagtcttatggcacaaggcgtgcccaacatagaattcttctagactgtattcaaacctacataaaaagaaatgaatacaaacaagccatgcatgcacaaccagaaacatataatttcactaatccatagccactaggacttgtcaaaaccaagctggtctatgtgtgaatgtgtgtgtgtgtctgcaaattttaaggaacatgtgtatgatgaggttagaagccaccattcaaaaatctcttttgaaagacatacgcagctgggcgtggtgactcacgcttgtagtcccagcactttggcaggctggggtgggtggatcacgaggtcaggagatcgagaccatggtgaaaccctgtctctactaaaaatattttttaaaaaaattagccgggcttggtggtgggcgcctgtagtcccagctactgggagaggctgaggcggaagaatggcataaacccgggaggcggagcttgcagtgagctgagagcacgccactgcactccagcctgggtgacagagcgagactccgtcttaaaaaaaaaaaaaaaaaagaaagaaagacatacatgcagccaacaaatatatgaacaaatcctcaacatcactaatcatcagagaaatgcaaatcaaaaccacaatgagatatcatctgacattagtcaggatgactattgttaaaaagatttaaaaaaacagatgttcattatatcgaaaagataattacatacgtatggttatcacagcacaatgcatagttgcaaagatatggaaccaagctaagtgcccatcaattgatgagtagataaagaaaatgtggcatatatacactgtggaatactactcacactacctggccataaaaaagaaagaagtaatatcttttatggcaacttggatggagctggaggctagtattccaagtgaagtaactcgggaatggaaaaccaaataccatatactcttggttataagtaggagctaagctataggtaggcaaagggacatagggtggtataatggcccttggagactcagaagtggggagagtgaaaggggattgagggatattggacacaacgtacactactcaggtgatggccgcactaaaactcagaattcagcactatgcaattcatccgtgcaaccaaaaaccacttgtaccccaaaagctattgcattgtgtatatatatatacgtatatatatgtacatatatatacgtatatatatacgtatatatatatatatacgtatatatatatacgtatatatatacatatatatacgtgtatatatatacgtatatatatgtatatatatacgtatatatatatacgtatatatatatagtgtgtgtgtgtgtgtgtgtatgtatatatctaaaacacaacggatgttgatgaggctgtggagaaaagggagcacttatacaattttggtaggaatataaattagttaatccactgtggataacagtaagaagtttggatatttatttcttttccctttttttttttttgagacagagtcttactctgttgcccaggctggagtgcagtggcatgatctcggttcactgcaatctccgcctcctgggttcaagcaattatcttgcctcagcctcctgagtaactgagattaccacacttggctaatttttgtattttagtggaaatggggtttcatcatgttggccaggctagtcttgaattcctgatctcaggtgattcactcgcctcagccttccaaagtgctgagattacaggtgtgagtcactcactgtgcctagcctacagtttggagatttcttaaagaacttgaaatataactaccattcaacccagtaatcccactgctgggtatatatccaaaggaaaataaatcattctacaaaaaagacacaggcactcatatattcatcacagcaccattcacaatagcaaagatatggaaccaacctggatgcccatcaacgatagactatgtaaagaaaattggtacatgtacactatggaatactacacagccataaaaaggaatgaaattatgtcatttgcagcaatgtggatgcagctggaggccattgtcctaagcaaattaaagcaggaacagaaaaccaaataccacgtatcctcatttataagtgggagctgcacacattgaatatacatggacataaagatggcaaagttagacagtggtggctactagaggagggagggttggaaaactacatattaggtactcttctcactacctgggtaatgggaccattcatacaccaaccctcagtgacatgcaatttacccatgtaacaaacctgcatgtgtacccccagaagctaaaataaaagttgaaaaaaatctctttggaaccccttacaagagaatgaatgaaagacgaaagaatatctagcctttttctaataagccgggtaaatctattttgacatgattttacaatagctgtccctctttgtagcgacatctggggcttacaatagcctcagtattgttctataaatggcattttaaaaaggaaacatctcccctgtagggtgtaagttcttcaaaggcaaaccatgtttatgtatgctgtatttgcaacacttagcactgtgtttgataaatggtttacttttttaactgttggagcggatttttttttttttttttttttttttgagatggagtttcactcctctcgcctaggctggagtgcaatggcggctcggctcaccgcaacctccgcctcccagatgcaagagattctcctgccttagcctcccaagaagctgggattacaggcacccgccaccacgcctagctaatttttgtatttttagtggagacggggttttgccatgttggccaggctggtttagaactcctgacctcaggtgatccagctgtgtcagcctcccaaaatgctgggattacaggcgtgagccactgcacccagcctggatatattttttaaaaagaaaagtatatctagttttttaaaaacattaattcactcaatagtcacatctaaacagacatatactatctatgcagattgtaggcacgctgtatacaggttagatgaaaattctttggcattactgttcaaataaaaatataagacaagctggtaatgagagcaatatatgtaattttaaaatttctgtctttcttttttttcttttcttttttttttgaggctgtcttgctctgtcattcaggctggtgtgcaatggcatggtctcagcccactgcaacctccacctcccaggttcaagcgattctcatgcctcagggtctcagagttataggtgtgccccaccacaccctgctaatttttgtgtttttagtacagacgggtttttgctatgttgaccaggctggtctcaaactcctgacctcaagtggtccggctacctcggcctcccaaagtgttgagtttacaggcatgagccaccgcgtctggccaatatatataattgtaaagtgtctaataatggcatttaaaaagtacaaatacagagatctaattagttttagtaatatattttatttagcctcatccatccaaagtattatttaacaatgtaatcaacataaaaattattcttatttgtggaggtattttctctttttctgggatactatgtcttcaaaatccattgtgtattttatacttatagctcatctgaataaggactagccttatttcaagtaagcaggagtcacatgtgattggtggctgctgtattcacagcgcagcttgatagcaatttagcttcaggacttttgtttttgtttttgaaatgaactaaattgccaaacctacatgtaatataccagatacactcatgtccttaatgttatttgatttgtttctttaggacgaacaacctattttattcactttgtttatataaaaagtattattcttaaatatgtactatgcacatatgataaaacatttcacaacattaaatggtaggaaatataaaaaggagtgtcctttcattgcgtctccaagcccagtcccctgaggtaaccactatcacataaaatgcagattttttccacatatatatgagatatgtatatcttttttaagtatcaatgaggatataacttacttttcatagtcctgataaaataccaacaaaaactttgctatgtgcataagattatataggatatcttcatgtatcaattctttttttctttttttttttttttttgaggtagagtcttacgctgtcacccaagctggagtgcaatggcacaatctcggctcactgcaacctccacctcccgggttcaagtgattctcctgcctcagccccccgagcagctgggattacaagcgtgtgccaccacaccgggctaatttttgtatttttagtagagacggggtttcaccatgttgaccaggctggtctcgaactcctgacctcaggtgatccgaccgccttggcctcccaaagtactgggattacaggcgtgagccactgcgcctggcccttgtaaattctttactagcaatgaggaaagaaaaagcaaaagtaagtatctgggatcttaaatttgatactatttttagacactgattttgtaggatccaatattttgatattcatagaaataaccagtggccataagttctgtaatatcaaatgaagtagcactcttctatgaactatacactttacattcattatatggtttctttttttacttatttcctcaatcagtcagtcaacgaacattcgagatcctgtcatgtgtcagacactgtgcggagagctggagataaaactgtcaacaagatgaatgcagcctctaaaataaagagtttctaatccagtggattctctgttcatgcttcttgcactttctctacactttgctctatcaaaaaaaaaaaaattcaaaacactcacgagtttgttgaccttaaagtggaatcagctgatacaaattaaaagcattttgcatttcaaaaagtgataaagtctaataaatagctcactaatggtgaaatttcagagacatttattttaggctggggtcttcctaattcagaaaaaatcagtccagtttccctattttacatccaaactcctcaaatgaccaatctctattctctctcttttttattttttggatgagtctctcactctgtcgcccaggctggagtgtagtggcacagtctcggctccctgcaacctccacctccccagttcaagcgattcttctgcctcagcctcccgagtagctgggactacaggtatgcatcatgatgcccagctaatttttgtatttttagtagagattgggtttcaccatgttgaccaggctggtctcaaactcctgacctcaagtgatccacccacctaggcttcccaaagtgttgggattacaagcgtgagccactgctccaggccccaatctattctctctaactgcttttatttcctggcctagagctccctaccattccactgaaacggatttaataacacaaatagcattatcactaagtccgaagatatttcattagaacttctcttccattattttatggcattttaaatttttaaaatcactccttctgcattgaaaaactatcatactgaggtttgacgccataatttgtttagctcccctcccacttctctgtggaatcattttttttctcctttaaaagcttttcttcttttgatctcctaattgtgtgagttcttcaggctactacttgagcaattaagcccatatttaaaattgtcactgatgatccattatttatagcttaccaacgtgtgttttatggaacactgttcccacaagaccacattgaaaaacaatcaagaaccctggcaaacatttctcctttgcctgcacattctacagagatcataaaaataaatattctttctcctgatcatacttccagacagagtgaacatatgatacaattctgaccaacaaggcataactgaagtctgttgacccttcgcttttcttactgctttcaacacgaactcaaagcaggaaccgtggtagataatttgcaattttgaaggatgggctaaatgaattgcagggtcatcagcctccacgctgcactgaacataggtcagcaaccacttacctcctgagttctcactacgtaagatgaagaaatctttatttgtttggacttccgtagtcaggcaatttatacctcgcaccagaacatactcttaattagatataaaaatgctacatactatatgtccttcttggagcttcagaacgcacattagaaaaattagagaactgagaaattcccaagagaagaaacctgtggaattctgctgaatttgtcatctcctaaatttatttgatcaggcagcccttttcttctttctgtactgaactaccaatgtctcacagaactatggctctctagctttttgcttttcaaagtgtaatttctagaccagcagtatctgcattgtctggaaacttcttagaaaacccaaatattaggccccatcctggaagcagagttacattttaacaggatcttcagttggtttgtatgacactaaagactgagaagtgccgcttgggaaacactgatttagagaataaagtacaactaaccttaatatccttatgtggcctatgatttcaagggcctctatatcattactgtcccttaatgcctacttcacaagtcaacacacctagttcttattgaatgcttactttgtgcgaggcactatgccaagtgctatagttttataattctcaaagcacccctatgaggcaggtactattgtaatcgttaccttgtagatgagatagctagggctcagagaagttaagttgcctacccaacgtcacatagccattaagtggcagaatccttggcttaaggatttaaggatcactcaactatattggctttctaagcttttgttcccaagcactttcctgctctgtgtacttaacacacatgattccctctgcctgcaatatctccccacgtacaccttcttaaaaggtctcagctcaaaaagtcagttgttctgggaagcttttctgatctcctaccccaaagccaggtcagatcctcctggtaaacattccccaggcacatatctttacttcatacatatcagcttttataattatgtatattttgtgattctatgattagtgtatgtgtttaccaaaaaactaagctccgtgtgggctttaactgtatcctctgtgcctgacacacagttgacacacaaatattttttagagtatctttttttttttttttcttgagatggcttctcgctttgttggccaggtcggagtgcaggttggcacgatctcagctcactacaacctctgcttcctgggtttaagcaattctcctgcctcagcctcccgagtagctgggattacaggctcacaccaccacgcccagctaatttttgtatttttagtagagatgggttttcatcatgttggccaggctggtctcagactcctggcctcaagtggtccacctgcctcagcctcccagagtgctgggattacaggcgtgagccaccgtgcccagccttttggagtatcttttactctcatttgaaacgttctctccctattctgcaccaatccaagttctacccagaagaagctataggatggtggcaagatatttgatttagcatcagaagacttggatttgaggccttgttcccctactttgtaacttggagcagtcacaaaaactcagacccactgattctcagctctgttaaatggacataataataacctcacaggattggcataagaattaaaatgagccctgtgagagaagtgtataacctacataaacttcctaaaaatacgagtagcgttttgtagtgattaagatcctgggttgtgcttaaaagtttccactctgtaatccaaaacctgagttcaaatcccaactcataatatttattgtctctgcggttgattcggcaatccattatttgctggattttgtcatgtgttttgccaattgcattcataatttattatgcatttatgcttgtatctcctaagtcatggtatataatccatgctttttatgttttgtctgacataagctcttatcagagccctttgcacacagggattcaataaatattaacacagtctacatttatttggtgaatattgcatatctgctgtactgaaagcacattaagtaacaaaggcaagtgagaagaatgaaaagcactactcacaacagttatcatgattgcgcatggatatgttcagaatgagtatttttcaaatcactttaaacaaagctgaattgcagaaacgaaagcccaacagcagcaattaaattacatttggaataaaatcatttggcctaattttcataaccacagatttcagagaataccaccacccatgccaggtgtaccagacaatcccattgtctgttttagccgtgtaggggccgctgtagtatacaccattcaggtttgcagagtgacacctagtggaagggagaaaaaaaaagaaaacaacaatcagactggaaaaatattgttcagaatcccttttattttgctacaaatgctcaaaatttttgaactatgaattctgccatttttcagacaagtaaatatttactagtttccaaaagctgagaaatttctacaacagatggctattgtattttattttttattttttaatttttttttaataatagagacagtgtctcactgtgttgccctggctggtctccaactcctgagctcaagcaatcctcctgcctcagccttccaaactgctgggataacaggtgtgagccactgcgcctggcctcagagatgggtattttaaaatggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctcgaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttagaacagcctggatttgaaactaggttaggggatgattgggtcttccttggtgaagaagtggctgtgaacactcacgtgaaatgctacactaacaaagaaaagacatcaactcgcagtgattggtttgctatgtggaaaaaaacattttataggtgggtaatatttatgaagtgccaacatttcatgtaaattagaagaactatgggacagaaaaaaagcaacagtaagaaggaagaaaagatgatagtcgaactcactgatagtaggcatggtagaagtagcaccaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattgttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaaagatgactatttttacaacagcagtagtactcccttatctgcaggggatacgttctaagacccctagtggatgcctgaaactacagataataccaaattctatatattgatactatgctttttcagtctgataaccgaaacagctacgaagtgagtaacgagcagataaagaaaataaaatttaccaaactgaaagacatgatatagattcaaaagaaccactgagtacccactgcagtaaaccaaaagaagaccacgacagtgtatgtcactgtaaaatttcagaacgctagggggaaaaatcttttgggtgtaggaaggaaaaaaaccatctatagtagttctctgttttttcctataatatacatacctatgacaaagttaatttataaattagacacagtaagagattaacaacaactaataataaaagattatgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggccggggtaggtggatcacatgaggccaggagttcgagacctgcctgggcaacatggcaaaaccccatctctaccaaaaatgcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtactatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttacactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccaccactgcacctcaggatgaaaattccccgcaagggaatctccagctgttccagaatattccccaatattcaactcgtagaaattctaaagaaaaagggcatttctgctgtcagtggagttcctctatgaccattttaaaattaagtttatttcataaacaaaagaacaggttctattgtatatttttatttccactgactccagggttatattgcacattttaagcatttattcacggttttacttcttagaaaattgtagtaccttttcatctccaactttgaaattcttatattgtgcataacggctatttttttcaaaatctgcaaggtcgatttttaaagtgtagtcttctaaaaaagaaacaagcaattataatttttaaaaatgtgtgacatgacacggactactgcggtttaaaaataattcacagctctattttaattttaccatttcccttggccaagaatcagttttcaaagattaaacagtgactcctttgtatatataacatgaacattttatcgtgtaatttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaagggtcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctgaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagaactgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtggcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccaggacgagaacatcctgaaggagtcctataaacaaactcaaggctgttggggcagggaatgctggattcctcaagactggagtccctttaagaggtgatgcgggcctctcttgggcttgttgatttagcaccacaatttccttgccccagggagctctctcaaggtagtaaaggtcacaggagaaaagactgtagagtgtataagagcagcaaggcaggctaagtcaactgtctttaaaaatattctattacagacgagatgcggtggttcatacctgtaattcaagcactttgggaggctaaggcacgcagatgacttgaagccaggagtttgagaccatcctggtcagcatggtgagaccaccgtctctactaaaaatacaaaaattagctgggtgtggtggtgtgcgcctataatcccagctactcaggaggctgaggcatgagaattgcttgagccaagagtcagcggttttagtgagccaaggctgtgccactgcactccagcttgggcaacaggcaaaaatctgtctcaaaaaaaaaaacaaaaaaaaaaaacttctattataacagagacataaagactcaattttttggctaacattgaaatgtctctttgttcaataagtaaacaaattatatttaccatttctaaatcaattttattgccactacttctagttgagatttatgtagtggggataaagctattctcagaggtaattcattaattcattagccgtaatgctctcataattaaagaatgcagagacaaaaacactggctattgtctggattgatgggatacgtgggtgggggcccaggaactgaaaaacacgttttttctccaacgagattagccagcctgagtaccaagttgatatatgaaaaggaacaggtttgttggcaaagttcctctgggaaaatatgtacatcataataacttaaaaaataatacgtttgaatttcatatatttagaaagagccaagggttactgctctggggttttcatagtttcaataagaaaccagataaatatcaatgtgcaaatgaaacagaagttggtatggcaaattttatatatctggcataaaacacttaaaactagaataatagatatgttgaaggaaaggaagcgttatgtaaatttagagagcactgatcataagaaggacatacaaagaaagtataaggtttctaggattactcatcctgtctaatgtttatcattctagtgtctcaaagaactttataaccataagcctactactataaatatagaaacaccaatagctttccagaacttggatggaacaaaggaacttttgttttatcttaattactttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccatgttggccaggctggtctcgaaatcctggccccaaggggtccacccacctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagataagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattgcccaattgttcacctctctctcataatatgtcttcatagctcctcctattgtttacttccttttaaaaaaaagtctgagctgctcctgtgatttgctttcaccaatagaagaaaaatgactccatgccaattctgggcctagatctcaagagacttatatacatccactcttttttgtggaaccctgcctgtgctacaaaaacaagtccaggctagctagctggaagatgagagaccctatggagccaggttgaatccttccatcccagagcagcaacttcagtgaggaagttgatggcagactcataagcaagcccagccatgatcagcagagcccagccctgatcagcaaaatcacccagccaacctgcagatttgtgagaagtaataaatggttgttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacttatattctatatatctatatatagctacatatatactatgtatagaatgtatatatatctataaatatatttagatatttctcataaatatatatgtgaaaacaattccccgcaacccaattctagcttttttttctgtttctaattttaggcagccacattttacatttgggattattgcccaaaagttatcactgccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcctctaaaaaaggtaaagtggaagccgattagagcaaactccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctgggctctggagaggtttgattttgtaaaatccactgagcttatacccatcattgaaaatctctgaacaatctgtttttaaaacaaggtaatgtaacattcattatgtgtctttttctccccccgccttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatcgaggaaaaaaggggagtgaaataagaatctagttttttgtttctttcttcttttttcttttacattttttttaagaaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaatgtagctacccctttgtcaccaaaaagtgatatctctttctttctttctttctttctttctttctttctttctttctttctttctttctctttctttctttctttctttctttctttctttctttctttctttctttctttctttctttctttctttctttctttcttttcctttgagacagagtcttgctctttcgcccaggctggagtgcaatggtgctatttcggctcactacaacctccgcctcccgggttcaagcgattctcctgcctcagcctcctgagtagctgggatcacagccacgcacctacacacctggctaatttttttgtatttttagtacagactggattttgccatgttggccagactggtctcaaactcctgaggtcaggccatccgcccgcctcggcctccaaagtgaaaggatgacaggtgtgagccaccacaccctgccaaatggtgatgtctgttccttaagccacttgagggtgatgtaaattaatacccattgggtctcacctaggttgatctgtacagacttagagaacgtggcaaatggggacctctctattgttcagatgcatagaaagctaggttttaggatgattgaagtagtggtcactataaacaatctcaagaagagccgtctacaaacatttgaataaaaatactataacatcatcaactttcacttttacccttatcgctttgttaatttccttaacaaaaaatttttttcttattggataattccattcttgtagcatattttaaagatgtttaaagatttaaaaacaaatgttcattgttttgatactagattgccaaatttacaactctcttgttttgttacagataaaatatattgcacattaagtaggtgaataggccatagacatcagaagagaaaagaaaagaaagaaccttagtcattttataaagccttcacatggttgggaccaaccatatactcctgctttggtgagatgtttacctttgtaatgatttaggctttattcatatatttattttcaagattcagaagcacatgcgttcatatacatgctaaattataaaaaggatcctgttttggcaattaaacaagaagcaaaacaatgagaaaatgattatctaaaattagttcaatgttgttataaagtttacatcttgtagtcaagtatatagtacaacacttttattaaagtaagcagattttagccctatttggaaagaagctttttgcttacattaaatttcctaccaaagagctgaatactaaagactcacaaggatcaaactattttccaggcaaatatggaagtgattagctataacatttgcctctggaaaacttagtgaatatagaggtttcagccaaaattttctacttgttattattttatgctaactgcgagtttgttatttctttggtcttgtttttgaaattttccttctccccagaagaaaatgccaaacacaacttaagaaaagcttttaactgaaataaacagtaacacaacaacaaaacccccaacaaataaataaacattaaaaaagcaaaaaagcaccagtagttcaatttgcttatagctaacaagttaagaagcctgctttgggaaatgagacttaaatcgtaacagcagaaagtatgaaaaatgtagaatttaaaatatgaacttgatatttaaaacgatgattttcaaaatgttctgacccactcaactccctggagaataggtagaagaaaggcaaggttaaagagctttgtgttcatgggagttttttttttaaaaaagaaaaagaattttgaatatttacataatactagacagaggccaaggcatcctgccttctgttttgacaaacactgtattaaactgggttatgtgtgtcctttctctgatcatgcagaaagtaagccatgttggaaggctgaatgtttaagctcataaagtgacatgacagcctgccaaatgggctttttcctcttgtctcaggatggtggctgaggcacaaagctgagaaccaaaggcacaaagtaccccacattctaaacacaaaaagaggtaagcaacagaggtcagctgccactccccagagcatgttgggatatgcgagaactggccctgctaccgccatcttcacccccaggcaacataaggaaaaaaaaaaaaggataaaggaaggtgggtacatagtaggtgtatgtatttgttggggtacatgtgatattttgataaaggcatgcaatgcataataatcacatcatggaaaatgaggtgtccatcccttcaagcatttatcctttgtgttacaaacaatccaattttgctctctttgttatttttaaatgtgcaattaaattaatattgagagaatgcgatactcttgtagggtagagtgagtaggctttcttccttgaaaacaaggctataataatgtccatagatagctggcattcactgagtacttcttttgctctacgatgttaaatatattaactcattttattttgtttatttatttatttgagacgggtctcactctgttacccaggcaggttgtagtgcagtggcacagtcagctcactgcagccccaaacttctgcaatcctcctgcctcagcctcctgagtagctgggcctgcatgcatgcaccaccaagcctggcaattttttttttatagtgttagagtctcactatgttgcccaggctgttcttgaaatcctggcctcaagtgttcctcccacctcggcctctcaaagtgcagggattacaggcatgattcatggcacctggccaaaatattttcactcatttgaatatattttaatccttacaacaaatacacagcattcttattctcattcttcagatggggaatatgggacacacagaggttatgtaatgtccccaaaggccacagctagcaagatgggcagctggactttgaaatcaaactccagagtcaacaccttaggccactttgtaacctgcctcaagacactcacatgcagactgggggctcctgaagaaggggagatgctggagccagtggtgttgtcaagtgaacggcggtggtgacgccagatttttgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatgttatatattttatttattgagtatctgttcttagtagcctctccagtactatctccctatatgctaaaatataaagaacaattgaactgtgtttatattttatttcccctttttcttcttcatgcttgtaattaatatatgaaaaatattgttttaatctactgaattctgatttttttggcttttatatcaaaaaacagtcatctagaattcctatcatctgtcttattattataacagtattatatttataataattataatgttttttctgaagcatctctatatgactcttctaactcctgcttgtacagttaatcctgctctgaccttggcatcgtaatttccaagtaactgatttcttgccttattccttggtgaccccttacttcccaaagtctgctccccagcagtgtcaacacaaggactggatcttcagctcttgatatgatttggatgtgtgtccccaccaaatctcatgttgagttgtagttcccagtgtgggagggaaggcctagtgggaggcgattggctcatgggggtggagttgtcatgaatgttttagcaccatctctcttggtactctacagtgagtggtgagttctcatgagatctggtttttgaaacagtgtcgcacctcctccctctctttctcctgttcccaccatgtgagatgtgcctgcttctgctttgccgtctgccatgattgtaagttccctgaggcctccccagaagcagatgctgctatgcttcctttacagcctgcagaaccatgagccaattaaacctcttttctttataaacgacccagcctcattcatttcgttatagcggtatgagaacggactaatacagcacttaagcctcagtcttcccatgactggttgtagaggcctgggaacaaacatctgattagctgccccctgccatgattgacccttgagtctgtgccaataacctgctcagaatgtgttcaaatagaaaccccaagtcttgggcttggtttgaaatttggagtaatgatgatccactggcatctacgagttcctcgcccttgagatcagctttgtatgttcttttgggatcacttatctgtatgctcatcccttaaacgatagtccgtttgcttcccaagcccatttttacccgaactgtccctggttcctcttggctccagaggcactggccatcttcaggctatagccatccccactactgcagaccactggctctggcctctttctgatctctaagggccagagggagggcagttggatcaagatgctggccataagagaagcaggagcccagggcgaggagtctgagcagagggagataaggatcttggtagaaaaaaagggagcattttaagagtctcatgcgctacagtgtgagccagccaggtgccctgaagcattttatggaagcatagactctcacaactcctatatcctacacttgtatgattagaagcagaaaataaacatgtttctattcccataagattggcaactctttgacctctacagtctttcaattctagtcaaataggtgtccgaatttatatttgcttatcttgctattcctctccctatgaactaccttcctttcattcctgaatatgaggatctactatgtttcaggcactctaatagccaacagggagataaaagtacattaaatatcattctagacctcacagagtgcccagttaattgacctcaatagactcataaacagaaattacaatgtagcatggtagtgctagaatagacatatggacaaagtgctttcgctagcattctttttgtttctgacaatcgtcgtttactctaaaagataccttttacttctggaggaattcaagtgaacagttttccatagagaataatgatttgtgcagcaatgtgtgtaatgtgttgccagtttaaaatcatttagtttctggggagaaatacctcattgaaaggaacattatgaaatcagaaaatatacatataaaaaactactcttttattttccttagtaattctggttctttttcctttttctgctcctttattttttaccttatttgccaccctaatgcacattaggatttcagaagggaaaactgcatacatgcaacaaggaaagatacacaaacacaaagctcaaatgcaaaaattcccaattgtaatctgccatgtgtacacggattttttttttttttttgagacagagtcttattgtgttgcccaggctggagtgcagtggcacgatcttggctcactgcaacctgcgactcctgggttcaagtgattctcctgcctcagcctcccaggtagctgggactacaggcacctgccaccacgcccagctaatttttgtatttttagtagagatggggtttcaccatattggccaggctggtctagatctcctgaccttgtaatccgcccacctaggcctcccaacgtgctgggattacaggcgtgagccaccgcacttggctgtgtccatcagtatttaaacaatctattgtcctgatttcttattaaatgatataaattctcagatatttagcattcacattaaatgccctggcagagatagaaaaaagtaaagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcattattacaagcatgtcaaaaatgcagagacattaaataacttgcctaaagtcagaagtgagtcagagacccagctcaggttccatccagacactctgcttcccaggatcctgtaactgcattgggaatttgtaattatttctccattatttgattagaaatagggacaatgttgattctggcttcaatccagaaacaaacatgtggacacaggtttaactgaaagaaagctaaaagagaagattcaaggacaaatcccaatactctgatatttttcttttttccccacttgtatgactttttgtgaaagatccaataatatatctttataaagatatatatattttacaacttattattatgttcattcagagaatttttgtactgtaacttcaataatgttccattgaagattaagtaaaaacgaagtccagctgaaactttgctttgtattaagggtaataacattttacccacaaaaatatgaattaatatgtcatctcaactaaaatatggagataagccaaatttttcctagttataaaaaacaaggcaggttaataattgccaaggtgaaatggtcagtttatttgctctctaagaaaaacaaaagtattccctgaggtgcaaaattgtgaaatttaactggaagcatcgattatactctggacaagttgttccttttgttttaaaatcctctagaagattttctaatgtgtaataggcacttgttagctccattaatcgtattgtgtaacagtttcttactggaaatctgggttcatcatttcttctttccttctgatgtaactcaagcagttgtttgccatttgtcctgtggtccctatttattcactcagattccagtaaaataccaaagttttgttttctttctgttctttgttatctactggacttgagcactgacgatgtttggtcttcccattaaacatcttcctgtccttcacgtggacattttgaagattattaagggaaaggtaatcctgttgatttactggaaaaaagaaggaaaaaaaaagccagttagactgaagtgatttgcacacacacagaagaagtggaaattatacattcataattgtagagaattcaagctgctaatgttaaatttcaaaagcaaaaatatgggattattcggctaattcaataatgatctctgtggtaaaatgacatattttgaaatacaaacttatctttccttcttgtatgcctttagctttgtccccattcaagcaataatttagccttgtgttcatttcctcactggagggacataacattaacagcagctaacatgtggtatacttatcatgtgctaaacatggtaattttatcaactcactcagccacacagccctataagtaggtactgttaatgatctccatttcacaaatgacgaaactgagacacagaggtttaagtgacttgcacgaggtcacacagctaacaagaggtatagctgggctcaaaggcaatcctgctcagaatctgtcctcttttctactaaaggtagactatgctgtctttcggaaacttggctagcatcattacctcaggagaaacttgcaaaagttaatcaggcagtaaggactactctagggccaatactttgtggaggaattccaaaagccaaattttcttggagtaacattattccatggatgtactgccataacatggtggaagaactatcatcaggaaaggtcaaaattatggccaggtgcggtggctcacgcctgtaatcccaacgctttgggaggctgaggcaggtggatcacctgaggtcaggagttcgagaccagcctggccaaaatggcaaaaccccatgtatttttagtttctactaaaactacaaaaattatccaggtgtggtggtgggcgtctgtggtaccagctacacaggaggctgaggaggagaattacttgaacccaggaggcagagattgcagtgagccgagatcgcgccactgcactgcagcctgggtgacagagcaagaccctgtcaaaaaaaaagaaaaagaaaaaaagcaagaaagaagagttgtgaccttgcacaactgcaccaaagctatgaaatgagaatgagacctgagatcactggctgaaaaaagtacaagaaaagcatgatataataggacaacaagtacagtcccaccaagatcaggctgattaggctctcaaacacattaaacggacactgtcaattcttttttccttttccttttggaagacctttttcagagaactcttcaattaatacatcagttacagcacaattttcatccaaaccctctggaccctgtattgtgcctgccagattgaacacctgtccattatttgatacttgacccagtcaccgtgggaaggtttaattccagatcttgccgcctccagtccactcaagcttgcagcgaggaacatgtctacttaaggctgcatgaggaactagactcagacaaatgatcttatatccttgactgtattctaccagcataaatttctgatggttatattttccaaacttgactcccagttcaggaggcacccttttatgggacttataaaactccatgctctgattacaatgataacattttaaacttcaaatgtgccctttattaaaatatttagaacggagcgtattgtagatatcaaggaaaggggttgttaagaacagtcttcgttccacacaactagcagagcttcctcaggtggaggtaatcaaattccttcctgaaatgctggtttcaatgtcatctcaggcagagtcctgaaaaactagaaagtttatttgcacataacgtaggtctcagaaatttcaatggagaagcattttaaaattaataaaactaaaacagttttactagtgagttatcctaagtattcccattattgatgtaactagcagaaagtttacattaatagatgatcaataaatagttccaccttcacacacactttctgggaaagattctgacaatatgaactagaaaaataagggtaaaggtggataaagaaaaagaggaagaaaagaaaaattgaggtgctttgtaatgtgtcaacttgggtaggccgaactacagttcccagaattccttttgccttatgttttccattaggagcagttggcaggcagaaaggaagtggcagccatctttgcagctctcccatgctgtaacgtatctcgttggccttaagatagtggctaagcctccagctgtttcacttccctttggatataatttggagcctcgtttagcacattacaaatgggtctggcttctgtaggacacccacatcaaccaaggtcagaggcaacaagaactgacacaggtttcagtccgtcctcatagattccagctcctgcttctattacgctcatctactctctcgcttaactgcagttcgtacttcaagctccaacatcatccctggagacagctgcctttcaaagagtacttaaccagctcccacagttgcattaagtcaaatcccttatatatcctagaagctctgcttctatgattgaactctgcctgtaactctgaggctcctggacaggaaagtcgaatgcctcagaaggaattttgtcactgcaccattatttcttcctcccagagctctctgttcttttgctcacatctggattgctctccctctaggcctgctacatgaggcatgtaaaaagtaatactgatagacatttggcagatactcccaaatgtgtagcttcaggttccacacaacctatgtcctcccctgcatactagttaagataaaatgaaacgcttattcactactcatcttttcagagctttctcacctatgtgtttggatttttttcccctctgattctcaaactaattttagattggttccctagcaggaagagtacaaagatgttttctttttttttttctgccacaaaaaataaaaagtgttcttgctgaggaatatgtttgtttttctttctgtgtgtttgcaaggactgtggactggcatttattttatgcttctgaataataacatctttcttattaaagaagaatctccccagaaggtcacatgtcattaaaaaaacaattttaaccaaatacacgtaaattctaatagaaaacagattttttacccgtaacacatgaagaagaaatttagctatattgtataaaaatatgtagggaaaaaagaacacaagagctcgtgttaagtaaaaccacattttaaaatacgcctttaggaacacggaagatggaaggtatcagaagatacttgctttcattctactcctcggtgatgatgtatctgcttttttttttttttttttggatgaatttgcagtgtatcttttcatcctgatgcctaaatccagtctctatatgtacctcttttctccagtttttagacttttaaaatattatcttttcatgaagaattcaactaattggaaaatgcgtgattcctaccactatgacaatatctgaaagtagaatcctcagggttgcaagctattctgacaaaatttctgaactctagcagaaaatgtaaaaatatacatttgacaaaaatatatttgcccatttgaatttaaattttgtcttttttttactcagtttttatttcttagaaaaaggaagacaatctaaatataattccctgagatatagtttcctttcacttcaaaataactgtacattaggttgagagacaaaaaaattcattgtctacaattacacatactttctgattaatctgttggttagcccacatttagttcatcaggcacaacttatttttctgcatgtgcatttgggacaataaccgggcatatgaaacctttaaaatttacatttaaaaatttatatttgcacttggataactttgccaataactagaactccctcaaaaacaaaggctaggtccctgactcctataggcatgaccaagagtatactacaaaatgattcctctgagactgaaatgtttttttcctgcttccccctcagagacacattgtggaaaaattctagaacttttagaatagacattgtgtgcttgactccagcgatcaaagattctgaaatattgaggccctatttgagagtcatacacttatactagttttatttgttgttgttgtttataatctgaagaaatgaacttcagccatctagaacaaaaataattggatttgttggagggttacggactgaggtaagtagtacaatcagtgacagactgatacaagccaagggaaggcagaataaggaaagctccaaaaatctctcaaagatgtgttcttggatttattctgtagtatgcagcccttaaaatgttttaatttcagtggaattctggcctctgtgtctgtccatacaaatctcacatccctaagagggagaatccaattagcccagtcatcggtatttctttctgtttttttctttttctttctttcttccttccttccttccttcctttcctttcctttctttctttctttttctttctttctttcttctttctttctttcttttttttttttttgagacagagtctcactctgttgcctggctggaggatagtggtgcaatctcagctcactgcaacctccacctcccgggttccagcaattctcctgcgtcagcatcccacgtagctgggacttgggcatgcaccaccatgcccagctaatttttgtatttttagtagagatggggttttaccatgttggccaggaggtctcgatctcttgacctcatgatccgcccacctcggcctaccaaagtgctgggattacaggcgtgagctaccacacccagccatctgtgtatttcagtgtacacctagatatatggcacccacacactgaggccacacctttactccctggccccaaaatttttgtcaaatgtggctgctgggtgatctgttgtgagcaagaaaagctccatagtatgtgccattctcctactacaaaattaggaaatttcaagagaaatgaaaggtggggatctgtccagtttaatggaagattgcctggctcaataaagatgctcggcaagcctaagactgcatctccaatgactctttcaccaatgaattaaccataatacatgtacccttttctattgctgtgatgtatatagttgttacctttttatttgcctattctaatttctatgtaccctctctgaatgaaataagtcttaattagccaccagcccttctcctagcccatccaccaaggctagatgttctcctatgtatttacttctcttatatcacacatcactatattgtgtactggagcttctcttttcattccagggagatcaggggcttgttttttcttatttcaatatccacagcacccagcatatgcacaccacacaatagaagctcagaaatatttattatgcatggaatagtaatatcacctatttgtattagcatataatgtaaatattcaaaattggtaacgattaaacttgataacttacatgaagtgcttatgacaatgcctgatagaaaatatgcgataaattttcgtttccttctgtcttgaaacaatgtcatgattgtttaattcgttctgtaaagaaggaggcagcaggctggctcctgggattggtggcttacacctgtaatcccagcactttaggaggccaagacgtgtggatcatctgaggtcaggagtttgagaccagtctggccaacatggtgaaatcccatctctactaaaaatacaaaaacagccagctgtggtggcaggtgcctgtaatcccaactactagggaggctgaggcaggaggatcacttgaacctgggaggtggaggcaagatcacaccattgcactccagcctgggcaacagagtaagaccctgtctcaaaaaaaagagtgaggcagcaatgtacaaccaaagataatacatcatttcatgaagataattccaatgttagattaggaagctaccatgtccagcctgctgcatcattctttacagaacgaatgaaagagtcatgatgttattcttaataatgtagaactatttgtgaaatgtggatgcagtgaacgttgatgcagacaatacaatgcccctaaactcattttactaagattcccaaatttactcatgctttagcacaagaattttacatttcagttaagaaaggtgaaagaaacttctttaatctgtaatggaagaccttgtagcagaacaaaattgctaccaagaaagttgaaaagtagatatatataagaaaaatgtttttgtgacctggattcacaaagtctgggataatgttcttgctcaacaactatttaaattgggattccctgaaagcagagcctgagacaaagatttggatacaagtagtttatttgggaggtgattccagggagcataaacaagggtgtggtcaaatgaaatagaacagggaggaaagccaaaaagtacctaatgagtgggggtacactcatagacaactgaggctccaacctactgaaacctctgagagccccacatcagaattttcctctcaggtggcaggagaccaagagtaggtatatatccaccaaccccaggtccttgttgcttgagggttgcttctgtggtattgattccacctgttgtactatgatccttccacgtgtgctttaatccccagctcctcatttcttctctagagctaggttgattaccttcctctttttcactattgacttcaccctttccttccacagttgtttcccctttttactctatgaacaagcccaagtctattaaaccctagaaaattaaaatctctcttactcctgcctctagtaactttcctatttttctctccatttcaactatgcttattttttaagaagacagtccacactcactgattccacggtctctctttccatgaactcctcaattaaagccagtgacttctgactcctttactgcaattgcggctgcttacaagatgccacaacactcctcatggcagtttctcgctgaattctcaggctgctccttcttcctcaaaagttcttcttccacaggcttttataaaacccatccctcttagttctctgggcatcctccaagttttccatctttcctttatggagtattctttcctttttggtccattgaatgttagtgtttaacaactcccaaatatttcattccagctattacttctctctgtaactccagaagtgtttgtccagtagcctgttagctcagactaaatttattatagtctcttctcttcctcttccctccccttgggaagaaaggcttgccttcgaaagaagatagtgagttggcaaaaccagcatttactcacttcatttacccacttcaaaatcttgggattatcagagaacattcctcctcctcatcctgcatttccagttagtcaataagttctgctgattctaccttctaaatggtaaattctctccatcagcgccattgctgctgtcaccttaattcatgtgttcatcaccttggcataatctactggtatctcttagttgatcaatctgctcccagtttcttcctcatgcagaccatctgctacagagtataaaacattatcttgatgcaaaaaaagaccacattacttctctacttaaaaaggcttagaagttctccatcaagtcaacaatcaacaagctaaaatctgatttcttttatgtggtgatctagctagtcccagtgtcagtatccagaagccgctcaggtggtcccaatggctaaagccatcatgagccagccaacctggcatgtgtgggtgctttgaaatcaatggttaaaatctgagtgtgggaatggatcctgagaccttgtagccctaagtcagtattggcacagagccttctctgtaaacttaaattaagtgtcaacatttagaagtcacttactatgagccaggtactctctgaacacttcctatgtactaattcatgtaatctccagagtagccctttgagatatgtattattatttttaattcccattttcccagtgaggtgactgagacataaagagagcaagcaacttgcttaacatcatatatgccacgatttgacttgaagtagactgttctagaagcagggtcttatccatttgctatgggctttgttagctttacacagaggctgtggggttcccaggcttagaacataattccagcctgtgcagggatctagatgaatcagaggtgaagagtggaagaaagaagcagagtggaagcccaagccactgatggcaatctgaacttggagcgtaacatcaccaggagaatctttatctccacatcttcccaatcctctatagttctgtcatccaacacacacacagatacagacatacacacgcacacatagacacacacacaatccatgagaagctttcaccagatcagaagtggaattattgctgcagaaggtaatgatggatggccccagaccacatgagaatgtttttaaaaatgacaaaatattgggaatataacaaacaagcaaaaaaatgggacccatctagagagccacatgtggtctctaattcctccctgcactgtgggtttggaatgaacactggcccctaagaaccgagttagccatgccctgttcttctcttgaatataatgggaggggatgtcagggaaatggagatgtctcttctcacaatatctgctaatcaggattgttcagggccttgtgcaattaattttagctttcaaaaaagaaataatttctcagaactccatggtgaggaaataggtcatactcattagcatagtcatagaggaagaacagtgtttaataataggcctggctgaaataggctagcagtgaaactagaagggcaaaattattctgttaatgaagaattaatgaagattttcgagtttccttaggtaacccaagaagaaaggtgtgaaaaaggaaggagtgaatgagataagaatggggaggaggatgtgaggaaggaatacatcaagatgccagggagctgagcaagaggcagccagggagaagttctgggctatggccaaggatctttaaagagcaaggatctttaaatagtcagttttaagatgtttggtgcagcctaaattcctcttcctcttcccctgcctgaatcttccgtaagaatctactacacagagatgccttgtatctgcagcattttgagaagagggaaagaggctgttgctttgggaatgatgcagagtggagaaaaagaacagccaaaagaggctagacttgagagaaattacagtaattcagtaaaagcaggaaataatagaaaaacattgactccaaagatcctggaaggtgccagcaagtgaggttaggtttcccactgtagatgtaatggaaacatggtttccccaccaacttcgaggcttgagagcattcaggtaactgatacttgttctatgttagtaaagcggatatgtgtcttttgacaatttacatgtgaaataactgcagctgttttctaattgaatttcaaggctccattccatgggctcagagaaatctgattctctactgctttcagcatgatatcagacaatttagagtttctctccagtctgggggttgcatatgatttctggggtttggggtggtgtgaagttggtataatatcactacaactgtctattcttgctctagtcactgggacctcagcctgagggactacacagattgctgccgcaaatccccccgcttccttttcagcaatgcaagggaaaacatcacattcttttgatttcccaccaattcatcctctttccaccccggcaaattgtgggagtgggagcttctctgattttaatcttttttcatctgttgtttctaatattgctggctgtgacaatccgcagaggaaatgcatgcctacctctagtctgaatggggaaaaacaaaatccagtatataagaaaatatatggtacagtggctgtgcatggtggctcatgcctgtaatctcagcgctttgggaggccaaggtgggtggatcacaaggtcaagatatcgagacaatcatggccaacatagtgaaaccctgtctctactaaaaatacaaaaattagctgggcgtggtggtgcatgcctgtagtcccagctacttgggaggctgaggcaggagaatcacttggatctgggaggtggaggttgcagtgagccatgattgtgccattgcactccagcctggtgacaaagtgagactttgtctcaaaaaaaaaaaaaaaaagaaagaaaatatatggtacaaactaatacctacaaatatcattcggttacattggctttataccctctctttctattagttcaaaatagtactcataaaataaccatcctgtaaagtaatgaaactgaattttcttccattgctaatttctcctctgacctaacattaattatctaagaacttaagtgtttagtgctctacatcagaggtcaacaaactattgtatcgcccacagtctaaactcgacccatggtccatttttatatatttaagtagttgaaaaaaatcacaaatagatcgatatcctgtgacctgtgaaaattatatgaaatctaaatttcagtgtctacaaataaagttttattggaatataggcatgctcatttgtttatatactgtctgtagctgctttcattctataaccacagagttgagaagttgcaacagaatgtatagcatacaatgctgaaaatatttaatatctggtcttttacagaaaaagtttggtcaaccttgtaggggaaccagcccgctataccacccgcgggttctccccttcccagtggagacgagggaatgagaaaagaaataaagacaaacacacaaagttcaagagttaacaaaagtgggtccaggggtccatcgcaatgtggaaactgcgacagccctgagctctggattccactgatatttactgagtacagttcctttgatcctataggctgagggtgggcagatggtggggtgatcacagggtgaccatggggagaggtggcagagggggtagcatgcgtcatcagcaagttaatattatttactgttccactgtataagctaatactctatgtttaacttacagataatccttaaagtccaactaattggttaacagaacaggacgtgaaagcagacagcccgtcagaccacaggcctgtgcatcaaaggagcggtccactccaagcaccatcagcagggcagcagagctctctgcctctgggaacgagcgagagatagaagactttccccttatcctcagaggacttctcctcttttacaagcaacctcctgctgttcccttctggggaatggagcaggggtcgcttcccttcccacaagacctttgttcagggactcaagtgggaggttgagcaataagcaagctttcttgcttagaggctccgcacacttcctgtggttgtttgttccaccctgcagttaggcaagcaagctcaccgcctgattcttatattgtcggactaagcagaagctattcttatgattcatgactatattaataaagcactattctaaagcatattttgttaatccttaaacaggcacaccataggccagccctcaaccacctcggcccacatccaagcccctgttttgacccacatttcccccattttttaaatttaaaacagccatctcaatcataacttgcttgtggttttgattttctttcaggagctgccttccgcatctgcagactaaaaacagacaacataagcagacacaaattaaaacaaaattagcaatggcagagcttcccagagttttaatccatttgatagaattgagctccgagagcctatctgcagctccagcaagcatttctgctccaggcaacaaatttaagtgagcctgcgatgctgcaaaaatctgttcttttaatttagttatatccagggttagattatcttctcttccttgtaagtggcatcagaccttttcccactgatgttcagtaacattataagaataaggagtaatacaaaaagcagatgtattccaatcacattgcatttgcatacgatgctctaaatgcataaaacgatctcttatccaggtgactgtttgcctcaaatcattaatttgattggccaacttctgatcaatttttgcctgagaattccataatctggtggaatttttctgccaggcattaacataatgagcagtttgaatggaagaatgcaaggcaacacctgccacagccgcggtggtggtgacagcaatcaagcccataatcacagcaattaaagtaaaaataaatcttattgtacgattaagaatcccttttaaaactccagttattacatgaatagagggaaaagtctcccaaggcctattaagagtaactggaatccaaacgccctctcgtgctcggaccagcaaaatgctattcctcatatcaaaagtagaatgaatacaagtaaacagatggcaattgtcacaagtaatggtttgagagtcaggtaaaatgataagttttccaacaactaacatgtaaggaggtttaacacaactttgaagagaaatagactgattagactgaagaagcatggtaaacagtagcttattacctcttgttccccatgatgcttcccctttccacactctcattccggaggtagccataagcaacttccacaattctggatgttccagacccatgactggactaattatctttggccagggaggagcagtacctttatcttcccatttcaatggatatagtgattccaatcttctaactaaagtggggggattattgggactttctctataatctatcatgaaggaatcctcagcgcacccagcattttgtccagtgcaatttctggcaaaggatcctttgggggcccaatctataattattccataagaatccttttgcaaaactactgcaccatctgctacacagttgtcccaagcaagaatctctagtttttctgaccattttggatttcttttaggacaagccagtccttgagatttgtaattttttacttttaaatttgaccgaaaataaccatccccataagtttttacagtcatgataggttggaaagacattccactcactacgtgataactgggttgggaacgattatgaggaggtacatagattatccaactatgtatttgcaatggtaaacatcaaggagcaattcctaaacaaattggagggtattcataccagttacattcatcaacataccctccttctcaggctgtgcaggacagccatcatcaatcggcccaggcatccaaaatactatcatttgtataaacttcaataggggaatccatccaagtaactggcctaattaaaggaggaaatggaacagaagccagtatgtaaaattttcttcagtccagacagcagggagacttaccgccgcggtaattaccatcaaggcagccaagatcatattacccgggataattgccagttgtttctcctttaggctgccctctgccatttgagtcagcttctttatctgttctcatgtcggtggtgtagcctggcgggtcttctccgtcttctgttgtttctctgagacgctcagcttcgtcatctttctcagctcccgaaaggacaggtcggagggaccagtcttcttcctctttggattcttccctttcttctgtccggtcggtgtagggttcattgcagaatttcaaatgtctattgggtatctaaatgggtgtttgattgtctcctggtgaaacacaagcaaaagcccttccccgcgtcataatttttcttaattcccaagttttagttctggtatccttccaccagaccgtttttccttcatgtaaattaactttctgtccagaaaagtgttgttccgctgctgtggagacctgatctctggaaatgttcaaaaaatttagagtcaaaagggctaattgtaactgcctatggggcgtggtatactccttactgcttccccctttcttttgtttttccaattgtgtcttaagagtccgaatggccctttctactgtggcctgaccttgcaaattatagggtattcctgtagtgtgtacaaatttccattgctgaacaaaactttcaaaagttttactgcaatatccttgtccgttgtccgttttcattttctgtggcacactcatgactgcaaaacaagataataaatgtcgttttacatgagctgtactttctccagtttagcacgtagcccagataaaccaagagaaattatcaacagtaacatgcacaagagaaagttttcccagtgatgggacatgagtcacattcatttgccaaagagcatttggtttaagccccctaggattaactccaggttcttgagtaggtagctgtagcacctggcattgcggacaatgttgcactatatttttagcttgtttccaggtaaatgaatatttattttttaatccagcagcatttacatgagttaatgaatggaattcttgaggctctgttaaaacaagtgtcactaataaatctgcttgattatttaattgggttaaaggtcctggtaaatttgtgtgagctagaatatgtgtaatataaacaggaaaatttcaaactctaactgcttgttgaagtgaactaaacaaaaaatttagctgatcatcagaaatatattttattaaagctgtttttaccattgttgtcgcctgaaccacataggcagagtcagagacaatataaacaggttgatcaaaatcttccaatacaaatataactgcttgtagcttagctctttgtggagaatgaaactgggtttgaataaccttttcttctggtcctgtataagctgcttttccattctgagagccatcagtaaagacagttacagccccctccaagaggatagaactggttattttaggtaaaatccaggtagccaattttaggaactgaaaaatttttgttttagggtaatgattatctatatggccaacaaaaccagctaaattagactgccattctgataaatgtataaaggcttgttgaacctgtgctttgtttaaaggaactacaattttatctggatctgtgccagtgaatctaactattcttaattgggcttggcctataagaatagctatttgatctaagtaaattgaaaaagtcctagttgtactgtggggtaaaaaagaccattcaaccaagtcaacatcttgaataatcactcctgtaagagaatggagagtaggaacaccaagagctgtaagggaacactaggatctattctactgacttgagcactttgaattttttcctcaattattcttaacagctgaagctgttgcaggcgtcagagttcttttgctatgtaaatttggatcccctctcagcaaagcaaacaagtcagacctcgcataagtggcaattcctaaggtgggccttatccaattaacgtctcctaataatttttgaaaatcatttaaagtttttaaggacttcttacgaatttctaccttttgaggcataactgttctctcctccaccttcattcctaggtaatgatagggtgtagtagtttgaattttatttggcgctatagcgagaactgtaagccccaccatttcttgtaacatagaaaaacatttgataagtctatccctacttgtagcagcacataaaatgtcatcaacataatgaataatattaacaatcaggaaactgatcctggacgggctgaatgaccttcccaacgaaagtttgacgaattgtaggactatttaacattccttggggtaaaactttccactgatacctagtagctggttccttattatttatagcagatattgtaaatgcaaatttttcaaagtcctggggatccaaaggaatggtgaaaaaaccatctttcgaatcaaatttttttttttgagatggagtgtcactctgtcgcccaggctggaatgcagtggcgcgatctcgctcactgcaagctccgcctgccgggttcacgccattctcctgcctcagcctccggagtagctgggactacaggcacccgctaccacacccggctaattttttgtatttttaggagagatggggtttccccgtgttagccaggatggtcttgatctcctgacctcgtgatcctcccgcctcggcctcccaaaatgctgggattataggcgtgagccaccgcgcccgacccaaatcaattattaccaccggccattctcttggaatcatgactggggatggcaaccccggttggagagcccacatcggttgaatgactgcattaaccgctcgtaggttggtcaacatgcgccatctaccggattttttctgaattacaaaaaccggggaattccacggtgagaaagaaggttcaatatgtcctttgtctaattgctcttttgctagtcaatgtaatgcctccagtttttgctgaggaggcggctactgatcaacccacacaggtttttgagttttccatttcaatgggatgggctttggaggctcaacagtggccgcccctaaaaagagtacccaattccttttcggtcaagtttaactgaagcttcaattggctgagttattccatcctcattctttcctaatgtttttccaggagtataccccaacttagtcatcatgctttgactctctgaactgtaaatcatagagggaatggtgatttccgtaccccactgttgtaacaaatcttttccccacaaattaatgggaatggcagtaattataggttggatggtgccttcctgtccatctggtactaaacagtgtaaaattgtaacactctgataaacttcagatgccatgcctattccaattaaacccatagaagctctctgtttgggccatgtttttggccactgatccagggctgtaacagaaatattagcgcctgtatcgacaagtccttcaaagagttttccctgaatcgttattgtgcacacaggtctattttcagaaacttgacttacccaataagttgcttttcctttgctatcagtgctgccgaaaccaccttctctttttactgtactttctcctacttaggtaataacaacaattaggtaataaggtaataacaacaattgagcaattctctctgcctggcttgcactccaaggaatactagaactaataaccaattgaatttctcccacaaaatcggaatctatcactccagtataaatttgaactccttttaaatttagactaaatctccctaaaacaagtccaactgttacctcaggtaaagggccaaatactccagagggcaccttttgaggtggttcccctggaagcagagacacagctctggtgcaacataaatctaaagcagcgccccctgttgtaactggcgccaattatgttactgtggtggtcacttgagggattaagggcactggtgcccactgacggacaaactgctggagagggaatgccccagtttggagtggggcctgaggctggcccctcttcccatttcccaattgcgcctgcaagggttggccattttcatcaaatttggagtgacaccgtttagcccaacatttacccttctggcacctgggacataagccaggtggctcctttgtttgattagatctggattgtttgtttgatttgttcttatattccttttttgtatttccaaattgcccacagttataacaattgcctgaaaagtttttcactggatctcccacctttgatcctgccatgttttgagccattatcatagccttatgcatgattccaccaatctatcacatgccctgatatactcattgattacatcaactcccaccagaacctttcctttcacagagcgaataggtgattgacagtcagggttggcattttcataagccaagaattctataatcaccttcctggcactttcatcagtgagagccttctgagctgcatcttgaagaggagcaataaaatcaggatacggttcttttgagccttgtctgacagaattaaaagagggataagtagttcccgggtcctgaattttttcccatgccctcaagcaacaattgcgaatttgctcaacggcatcatcctgaagcactaattgttgtacagttcctcattggcccccaactcccaacagttgttcaagtgaaatggcaacaacaggattagcagcacggtttttttgatcttgattttgagcctcatcggtccaccaacttttaaattgaagaaattgggagggcgaaagagtagcttttgctaaaatctcccaatcgtccggggccaatcgcttgtcctgagttactgagtgtaatagtgactggacagaaggcgaattgggaccttactgaccaacagctgctttgagatctttaagcagcttaaaagaaaatggttcccataccgcctgatgggcaccaccctgctgctgtgggagttccaaaactactggaaactgccaggcatcgggatctccagctaacctagcctgccgaataaccatttgaaatggtgattcattgacattaggtggcagtgcagccctatgctgtactggtgctgcaaaacgtgttcttgattcctgagcccctaatttatccattcgtgaaacagggcaaattggagattcaaacctccaaggctccaggttacgttgccttattggaggtggccactccggatgatcccaatgaggagccaaagattcctcaaggcccttctttgttttaaacatattggcataaatagcttctctattttaggagcagctggaggtcccacatgctcctcaaaagaaattaagtcatctccaggtttgtctgtactttcctcaaaatcttcttcactatcctctcctccttcaacttcctttatatttatattggcggcagcaccgccttcctccgctggaattctttctgccggaggataaacctcgttttccatttgaaacggttccaaggctgctttaaccatagcccagtctgaccagaccgttagaagaataagttttccttccttatgaacttgttttaaggcaattccaacctgctcccaatcttttaaatccatggtaccttattcaggaaaccaagggcaatactgctctactgtttgaaacagagtaatcaagttttctgtgctagcctttattacccccctctttaagaggagtttgataaagtgtaagtaagcagagtgcttacttcccgattgtcccatggtgtccctggaatactccgagcacacaagcttaccgcaaggccgaccacacgttcttgggagtccctcgacagactggtctccgcaatgaccatgctcaggtgtaactccacctgggtacaaggagcccacactgggtgccaaagatgtaggggaaccagcccgctacaccacatgcgtgttctccccttcccggtggaaatgaaggaatgagaaaagaaataaagacacaaagttcaagagttaacaaaagtgggtccagggttccatcacaacacggaaactgcgaaggccttgagctctggattccactgatgtttattgagtacaattcctttgatcctatgggctgagggtgggcagatggttgggtgatcatagagtgaccatggggagaggtggcagaggggcttaacagaacaggatgtgaaagcagatagcccgtcagaccacaggcctgtgcatcaaaggagtggtccactccaagcaccatcagcagagcagcagagctctccgcctctgggaacgagcgagagatagaagacttcctcctcatctctaccgcagaggacttctcctcttttacaagcagcctcctgctgttcccttctggggaatggagcaggggtcgcttcccttcccacgagacctttgttcagggactcaagtgggaggttgagcaataagcaagctttcttgcttagaggctccgcacacttcctgcggttgtttgttccactctgtggtcagtcaagcaagctcaccgcctgattcttatattgttggactaagcacaagctattcttatgattcatgactatattaataaagcactattctaaagcatatattgttaatccttaaacaggcacactgtacgctggccctcgactacctcggcccacatccaagcccctgttttgacccacaaacctctcctctataccagtgtgtttcacccgctatcagagttttacttgtttccttatctagattggggagagtcttggatagaccggcctgccatccaacgtccttggtttttagccctggaaattatttagttcttctggtaaggagagggcattttctcttacctggttaatctgaattcacgtgtgttttgctagttctcccctgactttgggatctttctcatggaaggagaaatgcaatgtggaagcctttttacggtaaaataaaaaattataaggccaaggtgggtggatcacaaggtcaggagatcgagaccaccctggctaacacgttgaaactccatctctgctaaaaatacaaaaaattagccaagcgtggtggcgggtgcctgtagtcccagctacttgggaggctgaggcaggagaatggcttgaacccgggaggcgcaggttgtagtgagctgaaatcgtgccactgcactccagcgtgggcgacagagcgagactctgtctcaaaaaaaaaaaaaattataatatatacagctgtagctttcctacataatgccgtgaatttaacatgaatcattgtaaccccaatcatgccacatactcctctgctagtccgtatggatgcatattacaaatctagttgtcacctgcagatctctttatttctgtgaataaaaacttatttgacccagaaaccaacttttataaaatcactccagattattccttataaccatgataattttgagtccttatttcatatcattttgttttgattaacagcttttttaaagtgaaagctgaggtttaattttcatgcctttctaacatttttcctatgaattaggaaacaaaatctgtatcagcccatatttccatatttttggaactccctcacctaattatccaatttttctacttaattaccaacatatatctagttacatagttctggtttaactgttttggtatagtgctggtgggaaacaaggaaaaagatgtggattattttccttgtagttttaaaaaatggttactcatatctctccgtttaaacctctccaacttggtgtgtcttgggaaggaagcaatttactcaagattttactacatgattgcagctttgaccacattttcagtgaatagagaagatgacgtaaaaacatacatacaagaaaaatacaggaagaatcatgtagtaatcacaactctgtagaagtaaagccatgtgaaaactgatgaaatgcaactatagatgaaattgtcagaatcacgaaggttacatccattaaatgagtgatttttgaaagaaaagaacataaattggttatgaaggaagaggcagttcagaccgttacaaacgttaatattgtatgtcgacggcagtaattaggtattttcaaatctaataataaagaatcaaaactaggcagtaatgagagatgttctgataattagatctggggaaaacagagcaaagtaaaaagagccttgaaacattacttacgcatgtggatttgatagaattcgttgacataattatataatggctggttgattagattatatacatcaacttttaagtttttgagcaaaagagttatgggagaaaaatctccctccccaaactcccgaggatgcttggcaatcaatgtcaggagacatttttggtttttacaatggacaggggtttgctctaggtatacagtgggtagaggccagggatgttgcggaacctcccggaacgcacagaaccgccccacaacaagaatcacccagcccaaactgtcaatagtatcaaggttaagaaactctgggctagattaaaaggtagagaagttaaccgtgctacaatttaaccaaaaggtgtaagaactaggtcagaggcctccaattagtcctttgtttggcatgaccagtctcttcttccattaagttacccagaaagccaagttatatttttcaggaatattcaaaaattaattttacgttctgctcttaataaatttggggtttatacccattaaaatggatgagtcgcagaaacacaatgttgaatgaaaaaagcaagtaaagcaaaaatacattcagtatgatatcatttatataaagcttgaaaacaagcaaaataaaacatattatttagggatatccatagttacatgaataaaatgaaggaattcaataacattgaattccggatagtatttatgtctgcaaagaggaaagagtttgaagaaaatgtggcagggagcagtccttaaacatcttaagttcttttttttttttttgtttttttgacagagtcttgctctgtcaccaggctggagtgcagtggcacaatctcggttcactgcaacctctgcctcccgggctcaagtgatattgtcctgcctcaacctacctgggattacaggctcgcaccaccacgtctggctaatttttgtagttgtagtagcagcggggtttcgccacgttgccttgtctcaaactcctgacctcaaatgatccaactgcctcgggctcccaaagtgctgggattacaggcataagccactgtacccagacacgttttgattaaattctattttcaaagttaggttgtgggttcttgagtgtttcgctcgttattgtactttatgtatgcatgtatgtatgtatgtagaaacagtttccttaagttcctcaggctggtctggagctcctggcctcaagtgatcttccagcttcagcctcccaagtagctgagattacaggcatataatgcgcccagttgtcagtattgtactatagagtttacatgtatgttatatattcttttgggtgtatcaaaaaatcacataataaaaacaaataacatgcagttataaagtagtggatttgtccctgaagatttttcctttaagttctgtcaccatctgcaggttaaaactaggtattgcagaaaacttgtttttcaaagattaaaaagtacaaacggctggatttctgttacagacatgcttacaatccatctgtggataaggagcatacagaatacattaaagagataaacattatagcaccaagtgttttgttttttttttgagacagagtctcgctcaggctggaatgcaatggtgtgacctgggctcactgcaacctccacctcctaggttcaagcaattctcctgcctcagcctcctgagtagctgggattatagtcacatgccatcacacccggctaatttttgtatttttagtagagacggggtttcactatgttggtcaggctggtctcgaactcctgacatcatgatccacgcgcctcggcctcccaaagtgctgggattacaggcatgagccaccgtgcccggctgtgttatcttataagtaccacctggttagtgtcctaccaaatatcaagaaacagaaatagtattttcacatcataacaactgatttagtttatgtgaataaaaatttaaatcccttactttattcatcctgctactaccttaggccaagccttcattacttcatgacaggttggcacctgttctccttgtcttcttttcctagtctttacaaaacattgccactagattgaagtcttcaaataaccatttcattacagcattgacctcttccaaagtctcaaatggtttcacactaactgaagaacaaagtccacactctttagataagtagttgactttctatagtttggccccaacctggtaataaaccttgccttctcccacctccccatcacttaccatatataaatcctctacttcagccagtctgttttttgtccattgcttactctggatgtgtgatctgtgttcttggtatatcccacttccttgaacatcattctgcaatttggaacttccaccccctgcatatttaatacatgtgttaggttgttctcttgaatgtggaaaactgaaaggcagtttcaatgtttatctcttagaggccattcttctgtttcctatctacatttccacagactgctgcccctaatttcatcctacctataaatcctagagctatcattatctctgagacaaaacatccctattttaaaaatctaaattaccacagcaatcagtgtctacatcatttgtttggcatagtgacggactattaacactaagtcgattcattctgataaagtttgtttctaaaaatagatgttaaatttctgaaagccaggtataattttatcgcttcttgttttttttctttccttcttcccttacaaagatcagtaatgctcatatttgagtttgagatccccttttcaatgtaaatatttctcaaattcctcttacctcccaacaaacaatagtattgacattctggggcttcataaattcagaaaacatcatgactagtagatattataatttcatgcttttgaatttattagaattgttttaatgataacagcttctacatttcaatgtaaatatttctcaaattcctcctacctcctaataaacaatagtattgacattctggagcttcataaattcagaaaacataatgactagtacgtattataatttcacgcttttgaatttattagaattgttttaatgataacagcttctacatacgtttaataataatacatatgtataaagcaaaataatgatgatagctaatatttcgggcctcaacatatactagtgtttttatatgcgttgtatttaattaaaaaaaatcttaaaggaatcacatagacctccgtttaaatttaggctctaccacttgcagctgctacaagtttgatttatataatctttcattgccaaaacgggtcagattcagaaccagcctcttcagggtaactgtgaggatcaagaaaatcacaacagccgaagtgctttacagtgtgcctggcataaaacaaactctgagaacattttttaaaaaatcctttcaaggtaggcagtatcattccttccccctcatttcatagatggggcaattaaggctcagaaaggcacgtcgcttgtccaggatcttggagtggtggaattaggatagggcattctggactacaataaacacctgagcgtttagctgctgtgttctgagctcccacagcactttttcttacaacacaaactttatttacatcacactccacttccgcatccttcactaaaatatgagctcttcaagggcagggactatatttttgctaccgcagtagttagcgatacacacacagaatatgaggaaaaagtgtctgaccaacgatcaatgcactcacgactgaacctacggtggcagattgcagtgggatagaagagctttatgtgaattgcgtactgagatgcagacctactattttgggaacaatttgtttttgttgttgaaacccagaatgcaattcttctttttacctttattttgcttaaaaagttattccataattataaactgcgtaaaactagaagaatgcccttgcactcaactaaaactgacaggtgttttacctttccagtcaggcacattgaaggccttgtgactttattgatttttgttttttaaagggaggacctgccaatttattaatcttaatagagctgtaacaggagagtataaataaaaagatagttcagagaaaatttactgaaattaagtttggattaaaatcatctggctcttttaaggaaaagggacattaaccaaaagtggcgttaactatcaacaatatttatgattctctcactcagtagatacataatgacgtctggcaaattgtttaacttccgtggaacaatcccctcatatgtaaaatcaggaggttggactacattgtaagtgtccttttgtttccacctcttcgtgaccgaatgtggggtgaggaaggggcaaaaaagcgatcccggtcttggctccttcttccggcacgggccggagctgacacccccacggaaaaccgcacagcgcctccgctctttctccacgggctgagggatcaatgcacttccgcataggcctagggccccacgctccgcgatcagcgccggaagcgcacggcatgctgggatttgtagtcctccacctgtggccggcaggcgtttagaacgcgaggtctagttggcattctgggatacatagttcctgggcgggtgggggcggattcgttggtgtaatctcttttcggcttaaagagccagaagcgacaccacagactccggcgggtcacatgactccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggtaatgcctgcgcgtccccagcccttggcaacctagggcggcgcgccccagaggcgggagagtaacggctccgggacactcggccctgttgggtctggccacgggcccacgcctcctctgtaggttcccgggtcttcctgccccgggcttcccgtgccctaggcggtcagtccgcccgctccctcaggactgatcgccgggatccccgggtgagcacctcgcgacgcgttggtgattgcaggactcccttcttgcctcctcgcccctcctgctggccctgtcggggaggctgttctgcgtcccggtggctccggctataccccttgcgggcggaggaagcggagcggggactctggtttgggtgctaggggcactgggtcgagttcttagagaaacaggccttggtggccatagttcttccccgcgttccctctgtggaactctcggtgtccagagtttggggtgtagaagggcggatgaggagcgacgcgactctgaagagttgcagttgggctgtgagctgcaggatttccgccgtctctggtgctgtgggagccgatgggccgggggaggcgttcctgggaaggttaatggagtaattattgccccttctttctcccttcctacctatctagttagaattgggcctagaaccgggaaagactaaatgccaagtgggactgggggaaacgttgtttggtttacagaaactggcgtttggggattaggccccgccagggaggctgggcgcgccaactttgcatccctcagcctactccccaggaactcgcctggtttaattttttttgttttgttttgtttttttgagcgagttgaggtctgtattgtgtgtcttacgggtgacggttcgtgtttgggcgctggaaggagcgggctttctgggcgcccctaccacccccgccccataaccgctttccagactccgcctgctggtgttctctggttaccggagtgggtgttgcagagcctcgggtgcacctgctcctttctttccctagcaccttcctggtgaggacccctgaacaccaatataatacagagtttttgaattgaaggtaaacctggtatttatgtagtgacgaggttattttattatgaagtacagtagcttttaaatgagcaaacatttttaaaatcatcggatatacgaggttgttacatagtttgagtaacaggaagctcgatcaatcagaggagtaaactttggcatagactattaaaggatagttagggctaaccatctttgttacactgttccgaaatagatatcactttgctgtttggtaagatttcagaagtttaggggatttaagcatttatgcatatcacactattttccaaaagaattgaggtaacttaaatttaaaatatgaataagttatatttttccccttcttttgatctttctaaacatactttagaccaaaactgaagtattttttattctgtatttcatagcgtaagtaatttacttaagtgatacatatttttaatcctaattaggaaacagctttgaagtgtggagcgggaaaggagcagtttctgagctgcaaaaactagtttctaaacaggtaatttgacattattatctgtattatcctttgtattagagttggagaagactttatggtggacactgctgtcacagttacagtgcatgactgaggatcctctctgcttagtaaacaaactttctgggttcaccgccctgtttgctctgcttttcggcgtgctgctttggcctgccggtatatctttgttcggaaaggccctgtcattcctaattattaattactagaatggtttatgcagtaccgtttgaaatttatttgtcttcacagaattttttcaacctgtttgaatttgtcctataactggatagcctctctttccaaatccatttaatctcaagttctctcctacaacattcctattaattggctgttcatgaactctacttgtcgaacttgttataccttgaccgaaatttagttgtctaaaattactttattattattttttgtacttcgatctccctttcctggtataaagttacttgaaacattacttttagcgcatagtacattgtcacatgcaagtgacataaaggtattctctgtccagcagaataaagtcagtgttgtagaatgtaagttcactaggagaagttcaataattgtttgcaaagggcagtttggaaaaatggctaaaagataattagaagtttgttaaaagctttttagaaataattgctcttcagaaaaaaacctcagaaataaataacctaaatttaattctactcttaaaattttaagaaagttcattttgaaagttttgtagaaattggctgggcgcagtggctcacgcctgtaatcccagcactttgggaggccgaggtgggcggatgacgaggtcaggagatcaagaccatccggctaacatggtgaaaccccatctctactaaaaatacaaaaaagattagccaggcgtggtggcgggcacctgtagtcccagctactctggaggcagaggcaggagaatggcgtgaacctgggagcaggaggttgcagtgagccaagattgtgccactgcaccccagcctaggcaacagagtgtgactccgtctcaaaaaaaaagaaacttttgtagaaatcaatatatattcttgctttctacaaaagcagacagatttttattttatagctctcctatgaggacctgaaatgagactgtcatgagaaaatacgaataggtagttgatgtatatcttaattataattctcagtgggtttttttttttttaaactggaagactaacaaaacagggcaagaaaaatggaactcaagggaaaggtcacatgtgaatgtgtgtgttagagttgttaatactacagtgattgctgtatggtgggctttagtaaaataaacaataattacaaaattagttataagattttccttttagcacattggggaagatgatggataagacgaataaaaataaagggtaattgagttaacttaaattggaagacctgggttttttcaataggagatttggccatttttttctgaaggaggaaagtggatttgagacttggagaaactagtaaggctgtgagattcacagtacagaactaagaagacaaccagaaatacctatcagtactttcatttttacggatttgagtgctaggcaacgtgctatgtaatgactactacagataaaacagtgtgcaaaacagacagggtgcctttcttcatggagtaaatttacattttaaaagtatctatgtgtatgtagagtgtagtatatcttaatagtgatcacaggcaatgccattttatgatcatttccccactttttgacagcttgagaatagtagcagagaaaacagacagtggagtttagccagaattgagtcgacacagtacgcaagtaggtgaggaagtgaaggatgctagctagcaaggcatttttgcaatgacttagttgggtttgggtttgagtaaagaatcaagggattgatggatttagggagagagaaacgatcaaggggctggtagtattcaggaaggctaagagcagtttcagcaggaatcaagtgagagaagtagaatgcaaaaacttatgatcagaaagaggaacttcagaagttcaggatcctgaacaaattatcagttcagtattggaatagagaagatgagatggatattggaattgaggccagagtcctagaaaagtcattgcaagtgtttagttcatgcaagcagggaatgaagtagaaagtgaaaccatgcgccagttactgtcaggaaaagtacaggcatatcttggatattttcagaggtgattatgagtaatttaatgccatttgagaaaaaaataatttttttcgttactgatcactttgatttttttttttttttttttggagacagagtcttgctctgttgtccaggctggagtgcagtggcattatcttggcttactgcatccctctcctcccgagttcaagcaattgattctccttactcagcctaccaaacagctgggattacaggaacgccccaccacacgtggctaatatttgcgtttttagtagaggcggagtttcgccatgttgaccaggcgaatcaagtgatccgcctgcctcagcttcccaaagtggtgggatcacaagtgtgagccactgcacccagcctgattatttgattactttgaatttcttctttaccttatattcttatttcaaaggtaaactgtagtcataggtattttcatggtaattaatactgtgatattctactgtaatatgtctctatagttagaatcctgcaacgggatgttcttttttttggcgatggagtcttgctctggcacccactggagtgcagcagcgcagtcttggctcactgcaacctctgcctcccaggttcaagtgattctcctgcctcagcctccctagtagctgggattacagacgcgtgccaccacgtccgactaatttttgtatttttaatatagatggggttttaacatgttgatcaggctagtcttcaactcctgacctcgtgatccgcccgcctcagcttccctaagtcctgggattacaagcgtgagccaccgcgcccagcctaacaggattttcttaaaaaaaaaaaaaaaaaaaagtcattgaaagtagcttaaaattgccatagtatattttcatttttgtgtctttgtaaaaaaaaaaaaaaaaccactaaggctgttaaaaatagctaaatgaaacttgaaagtaacagtttcaacttcgtttagtaaggcatagcatgagtagaagtgcgtgtttaaagtagaaggattttatttttatccccgttcagctacccgtagtactgtcatcaatcacttctaccaattgttttcctacagtttcaactttcttatcttactgtctttctgtttaacttgcatggcaaaatttcaaccttgggtggattcagtggagtgtttatattgagggatatgagcactgctggaaaaaaatatctgtagtatgtgttatatgagtgaatagtctctcgtttccctgagtccgtagtgctgcccacggtcattctccattccctacttttctacgctctctcagacactgctgtctcaccctcacatttaatgtacagtccttcctacttcacaacacttaggaacacctttggtttcctaccaccacatctgctaagcagcctccaacccattccatcctttcttggtttttttcaattaaagagatgttcttcttcctctctaaagctaatcatttgtcttttgctctagaccccaatggcccccgctttctcagagcccacatgctagttgcttatctcctttctcttctgcatttttagtatctccctcttttttttttttttttttttttttttttaaagtgaggcggagtttctctcttgttgcccaggctgagtgcaatggcactatctccgctcactgtaacctctgcctcccgggttcaaacgattctcctgcctcagcctctcttgtagctgggattacaggcatgtgccaccatacctggctaatttttgtatttttagtggaaacagggtttcgcagtttggaacaggctggtctcaaactcctgaccttagatgactcacccacctcagcctcccacagtgctggtattacaggcgtgagccaccgcacccgaccagtatctccctccttaccaacaaattgtaaacgtactcaagatacttctattttaataaaactttccttatgaccgtctgtgcttgcttctcatcataggctgattccttaaaaatattagctaatgactttctttattttttccctcttccttccaataatacattccagttatggaattgaccctcactacccctgctgaaatttctcaccaaagtcaacagtaaccttgttgctaaatctaggaggatacttctcagtacttctcttatctggcaaggtaactgtttggtttcttatcacattctacttgatacacttttccccttttggcaggctctcctggtttccctcctgtctttctgtaccttattagtgtattagcgtgtccttttcctctgcctctctatttaataccagtgtatttaagatctggtcttctcttactctttatcgtctccctgagtcctctgtcccactttttgagtggatgactctccagcccagatttctctgttgagagatagatcgctatttgtcaaccggacaattttattgggtgtattataggcacatcaaactctccatttctaaaacttgaactcatcatcatcctctctcaacaaagaaaacttgtttcttttctgatcagtttaactgtgtgtcacatacccagtttctagcaacctttatcctttatcttttaactctactatcctttaactcttctgcttctttatcgcccgtgttgtaatacagtagtctgccctattctgtgtgggataccttccagagacccccagtgcatgcctgaaactgtgggtagtaccaaactctatgtgtatgttatttcctgtatgtatgtaactgtgataaagtttaatttatagattaggctcagtaagagattaacaataactaataagacagaatagtcacaacagtatactgtaataaaagttacaagaatgtggtctctgtcgctcaaaataacgtactttactcaccagtttcctgaccatggttgactatggggaactataatcctgtaacacaaaactgcagataaggtggggactatagtcaccaactcctattgatcctgcacagcagttttgcttgaattggtattctgtacatccttagtcttttcgttattggaatacttccttttttttttttttttttttgagacagagtctcgctcttccgcccaggccggagtgcagtggtgttatctgggttcactacaagctccgcctcctgggttcacaccattctgcctcagcctcccgagtagctgggactacaggtgcccgccaccacgcctggctaattttttgtatttttagtagaggtgacagggtttcaccgtgttagccaggatggtctcgatctcctgacctcgtgatccgcctgccttggcctcccaaaatgctgggattacaggcgtgagccactgcgcctgaccgttactggaatactttctgtacttgtaagtactagtttatattaatgtgtttacagaataaaatttagaaggcagagattctgtatttgtaatggtgacatttaggtggttaaagaggttgacatgaagagaaataacatgccattactcttatgagggagatacttagtatttttgggaaatgttgtgaatgtggccgggtgcggtggctcacgcctgtaatcccagcactttgggaggccgaggcgggcggatcacgaggtcaggagatggagaccatcctggctaacatggtgaaaccctgtctctactaaagatacaacaaaaattagccaggcgtggtggcgggtgcctgtagtcccagctattggggaggctgaggcaggagaatgacgtgaacctgggaggcggagcttgtagtgagcccagatggcgccactgcactccagcctgggtgacagagcaagactctgtctccaaaaaaaaaaaagaattcatccatatgcaattatttctttagcttcatactaatagttttactttttaaaggcatactaatgctgtgccttttaaacacatttggtgtcatcattaagttacaaagtattctaccccctatggcaatcacagtgtaacagtggatgaaattgttcattttgccaacctgatagattagactttagtaaattttgttttaaaaaatactaaaaaaatcatctgtttttcccaaactaattagagtgtacagttttaaaattgttttagaaacttattttagtagtgttcaaagtcgttagccagaaataggtctttggaacaagctctgcattttagggggaatttattgtgatagggaaatagaatgcgtaaaacattctttctccagatatattcttttttttttttgagatggagtcttgctcttgcccaggctggagtgcagtggcgtgatctcagcacactgcaacctctgcctcccgggttcaattgattcttctgcttcagcctcctgagtaactaggactacaggcgtgtgccaccatggctggctagtttttgtatttttagtagagataggatttcgttatgttggccaggctggtattgaattcctgaccttgtggtaacgccgaccttggcccagatatattcttaatacatttatcttactttactattacttcattattctattaatagaaagtattgctaacatactcttttaagataaaaatgatatgtaataattttgacttaaatatcttaattttcccttccaatttacgtttcaaaacaattgcttttagtacttttaaatatggcatcacttctgttgcctggctgttttattcttcagtattacaaattatgtcagtatatgtagaatacagtagttgcaaaatgttttatttaaatgagtcattttggttcactggatatacttctatgggtattattttttaaagttttaaaatatatttctagtataaataattacgtaaactgttcctgaaaatatgagacagaaaaaaagaagaaaaatcaccagtgcctaccctgtaaccaataattgcttttgtgaaagcactttaataaagtttcttagcttttgtttaaaaaaatttatgtataatttttcatactgcttttttacttttttatattactttttccatgatacaccgacaggttatattgtccaggcttcataattacatattttgaagggtacttagtattctacccagcaagtgtagtacagtttgcctaatagcattgattttgtcatttgacatttagtgttgttttttaatttatcacaattatagcgtaataaacaacttcattatagttctttccaccatatttaaggttgttttcttagattgcatatagagaggtagaattactgcgtcaaaaattcagttttagttcttgatacagtattgccaaaatgctttccagaaatgttatactggtttatattctcaatgtagtgtctgagaattccattttccttttactgtcattaggattagataatatgtaatttatatgaaagttagcaaatttaatagtttcttattttaatttgcagctggactttatatattcgtatttttttttgcaaactacttgttttgcttatatttctccggttttatttttttaaaacaaattctctgtataacaaaggtattaactatacttagtatttctttgagatttttttttctcccaagctctcatttactattctcagcacacttaggaatttacttttatgtgaataaaatctgttgaactttttattttttatttctttgtgttctaaatttagtaagttctctgtttttaaaaaccattcaattttcttgtctttttaaaatcttaattgatgtttaaaattctgttttaatctttgactattttgatagtatgatataaggcagcctttctcagttgggagagaattaagctccaataccctaaggcatctgttgtttactgtgaattaactttttttctgtgtgtctgggatggatggtactggatatgtaccatccttgggagaattgagaaagtagtgactcaaacgatttttcccctcttctatgattgaggtgaagaataccacttaaggaagactgttaaagctctaaatgtatctttttcaaatctgttagcaaattgttgtatcagtgctcactcctacatcatagaattgttgtgaggctttaatgacataatggacgtgaaatattttagcatggtgtttggcatgtggtaagcaaaataaaatgcgttagctgttactagtttttcttactacatttttctgattacatgtatttgagggtttttgttcctgagctagtactgatttaaccatatagacagcattgttgaaaccatatagacagctaatttggattagcattctaacctcctgacctctgttgctatccttgcttttattttacagatggtaacttttttttccgatatgtttattcttccagataaattttagaattattttgtcaagttctaaggagaatcccagtgggatcttaactggaattacattaagccaatctacatttagaaaaagtggttggttgtaatatttagtatcccatcatggaagatagtttttctacttattcacattttttctcccatattgttttatagagtttaatagtgcttcttgacatagagccaaattattactcctagttattttatatatttgtcactattataagtagcatcgtttaagtggtattggtgatattttgacgttctctagatttttaaaaaatacctactctttaagaataccaccttttctcttttcagtggtaatatttctgtttcatatttgtctgcttgatagaatttctgaaagaatgccaagtaactgatatgtagcattcttattttggtctttattggagatgtccttcatgtcttattttaagcataatgttgactgcttgtttatacttactttcaactctttagagaattattaaagtaatatatgctcattaaaaaaagagtgaaatataacaggaagggtcaatgtatttgtgatttttaagatttttaaaattaatacttcgttgaattttatcatttttattttgagataaaatttaatttgctatataatttgttaaagtaatatgttattctaatagatattctagcatcaaaacatctgtgggacaaattctactttttcagagttgataatccttttgatattttttctctagtgaatgggatgagttagggtcttagaattaaagcaacttggatttttatcattattactatttatttaatttttaatcttttttttttttgagatggttttttgctagtcacccaggctggagtgcagtggtgcagtctcggctcactgcaaccttggcttcctctgttgaagccatactcctgcctcagcctcccgagtagctgggattacaggcacctgccaccacacccggctaattttgtatttttagtagagatggggttttaccatgttggccaggctggtcttgaactcctgacctcaagtgatccgcttacctcagcttctcaaagtgctgggattacaggcgtgagccactgcacccagcctattaatatttttttattgccatttttagctgaatgaccttggccaaactgtctcttttgaatgtcagtgcttttgtgtgtagtttaatgacttttcatgtcccttgaattttagataaaattatctcaacctctcctctttcagctagcaccctttcaacctgtacaattccacagctagtggaaatccaaagtcttctgcaagattatgcagaaatcttactttctgatgatcatctctgcctttgaacctctacttccaccattgctgctgctttttctcatctctttgacccaggtaggaaattcagtccctttcttgattttcacatgtacaagcaaaaaccccatttttatggggaggattagagtttggtagtctttaccaagatttagagaaagcactaatacaaattaaactagggtagtaagcatcactattcttaaaatgtcttctagccactgcacttttggatgttttggccctagtcctgcttctctttccctaccttcttatcatcttgctattgtaccttcctgttaaaaccaaaattttcttcttgtttcttgcagagcagttctcccgtctttgactctttggcatacaactaatgcctgtgttttcagggtatcatcttcatcccaagtccattgtcagaacagagatactttctttcctgggagaagttctgggtctagctgtttatgacacttttcctactttattgttctaccctttggaactgtgttgaattaagtaagtaatcttcaagcatgcagactggtgctcacaaggtatattcaggggttttcctttccttctctgtcattccaactacctagctcattttaatcataatatgcctgtcacagctaaatcaatttgtctgtgatgtggttgacagtgcctcattttagttcataaaaatcagtgcttcaaagattgtattgctaaacttcatggaatgatttgaaaattgaatttgtttttatgtgttataaagctcagttcttaacttgtttcgcagagagttaattgttaaatccagtatggccacaggaggaggtccctttgaagatggcatgaatgatcaggatttaccaaactggagtaatgagaatgttgatgacaggctcaacaatatggtatgattccttactcttcatggtgtgttgttggctattaatgttaaaatgcagttttccccctgaccaaatttaactcactgatgctctttgtatacacttgctggccaagacattaagggaccctgggccgtttattatattaattgaagacacaaatcaaattgagtttttaagccccaaagcagatttactgttacataaagatgtaaaagtgttttttttatggaaaccatgtttaagacatgcagctgggttttaggaagggatttggagaaggaattgggaaattatcaagaattacgttttcaccaccctaactctgcttttgagtgcatctgcctaacacacctttctctttacagaccagttttctctcctctggtccatgtgatatactgtggctgtcccattgttctaaaccttttagttatgggtgcagttatgtactgactagttacctcttagttccaatttgaaattttgtagtatgattatcctaatttggattagatatgtgtttcttttttcagtcttctgtggcgagggtggggtgaggtgtaagtagtgtaacaggttggcaggaatattcactcatagattgggtggaaggacagttcataaagaagggggttttgttaaaataaggaaaatatcccaagtggtttactatactagtactaaaagaattttccagttggataaagtgggaatttacagacctttttgttaatgaattaggttatgtgagtttaactaagtaaataaaaatgttttctatttgaaactataagcactttttgtaattccatattagctgttaccatgtacatttttacctataaaaataatagctgtctttattgcttactaaatgctaggtactaattagttttaatcctattttgaaggtgacactattttagagattaggaaactgagactataggaagcaaaataaatagcctagggtcacacagtggagtgttttttcagaaaacagtaattaggtttagaacctaggttgatttgatttcagatctctttttgatacgtactgactttataggagatcggtaaaggtatctgtaatttatttcactatttataatagaaaatcacaatgtaaaaaaatcctcttggaaatattcagattgattttagggttggcatttgaggatttgtatttgttagtgatcttgataagaaaataatctcttttcagaaggatgggctataaaattaaggtagatgtaatgaggggaaaatgggttaatagaagtaaatatttgtctctaggagtataagtctgtcaaaaatgtcttgtcttttttaattttaaaactgaccaaaactttttaattataccaatctattttcctggtttgatacaggccatgttaatttttgcttttacttttttaaaggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcaggtttgtgaattatttttaaaaatgaagctattactgtgagaaatacttgaaatggattaaataatttgtcttaggaataaaaaattgagctgtttatgtaatttttaaaaaaagtttctgtgcctatggaaagaattttaatcactggggatggtcctgtcttctttagaaggaaatgaagtcccatttctaaacttgctaaagacatgcatttctggactttatactatgttatatgactaactcaagtgattttactatacaactaaattttgcattttggtaactgaataaaatggtattaagtaatggaaagttccagtttagtatatatatcattggctaagtgtgggatgtgctgggttacctcaagtttagaatgaaactattttctgtttataatcaccaaaataaagtttagatctaaaaacaagtagaaatgataataaattcttgagagatattttactcttagatctatatgtcatagagacacacacatttccaaaaatgtagaaaggtagattcaagtctgataatgatgttggtaatgatcatgtatcatttatttatatctatttatcaattattgaacacttaactgtatatcaggcactgagctgaatactttttcagacagttcttcatgtagacacaactttaattacattgattcattgggtccaaagcgtataaaaatactataagcaagtaataaaaagcaatatgagttaaagtgtgatccatggtcctaggacacgttgagcatccctaatacgaaaatccgaaatgctccaaaatccaaaactttttaagtgccaacatgagtggaaaatttaacacctgaccttgtgtgatggtctgcagtgaaaacgcgtcaaaactttgtttcgtgcacaaaattattaaaaatattgtataagattaccttcagattatgtgtataaggtgcacatgaaacataaatgaattttatgtttagactccggtctctttcctaagatatatctcatgtttatgcatatattccaaaatttgaaaaaaaatgaaactcctaacacttcttgtctgaaatattttggataaggggtactcaagctgtacttcatttagacttaccttgttcatattcgtcagttgaattgtctcagcaaagtgaagtctagaaaatgctaatcaaattttcatattgtagtgaaagactgttacagagccaaagctctttcaggtcttagtgcaaagctctttgtgtgcaccttctgaatcaatatctgatggcgaaactaagaacattggggttaaaacaaaattttgtcataaggttaatgtttgtgtgatttgatttctttttcatatatagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccaggtgataacgtttgtttcttttgctcattctttacacaaacctcaaaataccaacagtaaggtttagaaaattaggttacgcacacaggaattttagttgggtggaattaaagtgcttcactgacctcctttgttaatctgccagatttacttaaaatagagtaaatttctgtttatccaaaaatattttagaaatggcatattcaggttagttaaaggcttctgtttatttacaaaatagcatattgccagtttttagtaaagggggattggaaggaaagtgattaatagatttttgtaggaattttttaaaatggcaaatattcttttgaaaagttgtaaaactataatacatttaattaatttataaacattaggaaaatttatataaaaaattgtatgcagttgtagaagtaaaatttttcagatactgtagattaaaattttgaaatgtatttttgaattgacagtgattggagtttttagtattaccaattatgtcttgattaaaatctaagctggattcagattttttgcatgtgttaattcacacaataatccaagtgtctttggttatcttcgaaataaaaatttgtaaaactgttgctattgaactaattatccttagttttatatattgtgtactttcatgctttttttaaaaaaaatatttcccctgcagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgtaagtattcgacttttaaaataacatattatttttgtagtatctcagtgtgtatttactgatgacattctgatgccaccccagaggagttaacatattttcaaaaaatcatgccatccattataacaatttattgcccattttaatagttgtatgatttataccgctaaaatatttcaggctagagaaaatgaggaggaggatgttcggactatagattcagctgtgggatctggttctgtagctgagagcacatcgctaaacatagatgtgcagtctgaggcttcagataccacggtaagcggctttttggtaattaaagtgctggaaatgaaggtttaaatttttctcccagttttcaagatgttatttttataggcgttccttaatgaaaagtgtattccagggaagaacccctcaaattgttaatgctgtatgtgttcttctgtatttaaacacggaagttaagttttatttattaacactaaaaatagttttaatggttaatttgaaaatgtaatttttgatcttcagtttatagaaacattgtttttgtagtttgttttgttaagcaaagcttcactaattttaagaagcatcgaggaagttaaaatggatggtggaattaagggcaataggcaacattagtgattacttagcatgtagtcttttggaaataaccaagttcatttgtcactgaggacacgttaaggatattagaatttttcattttttgggctctatcctagtactggagcaaaaccagatgactgaaaaatcgagagaaagactagtaaatgggacaggatagcatttacattgtgacttattcacaatgagaaaaatgctgtaattgctgacttggcaaaatggaatttgttgaagtactgtttttctgaagaatagtaatttacagaactttgaggaaagatttctaaaacttagtgtggttcaatgctagggtgtttttaggcattttaaacaggcgtgcctataaccatgcattattaagcttttaacacctattacaggctagtaaagcttttgttttgagaggataagcatatatctcttcgggttttgaggtgttcaaaatgccattcagcattaggaatttgaaggtttgtttcctattagtattgacctgcataattcttacctgcctcctttctcttcccggaccttcctaatttgaagaggtgatttggatttcttttctctacattattttcaacaggagatacttagagagcctgatccaaacagttgttgaagaatggattttactgtggggaaattctttttctatttacagtggtgcgaggcataatttcttccttaggttccagcagaaatggaagggttaggacgatgtgggtaaaggaattctgttggggaggagtgggaacttgtatagatttattgtaatttatataaagtattcattgtgatggcaatttctttcataatataaaatgacggtatgaaagttgactaataacatgtagcagagtaaatgttaaaaatgtgctttaacaactgtgtggtatggtaattccgcaggatgtggtacttgcttagttacagtaagcaacagtctagtctacagaaaacttaaaagactaaatatactgctgcttggagggggatgtggattgatttttgtttttttttttttttaaaaaaaaggtggactggtactttttaaattgttttacaaggctggcttatatgttaaacaggagtttgtgttaagaatttaatatgctacactatttaataaaggaggaggcatcttttattctgagaattcggccgtgcattgaggacaaactagggaattcagcttcacaagaacaggtttcagacattgacgttactacaagtccaaaagggaaaggtgacagacctcagaatgacagggaactgaggcctaataggaaatatagccaaaaacgtggatttccctcaaaggtatactttacaatattaacttgggaagtctctaaatgagcacttcttctgttcatatttcctcttctttatttgcttttctgttgttgctattactcttacatattaattgttaatatagttgtcatactgtaatttgctttagtaaaattctgtcccttactgttttttttctactttgttatatacctctccatggattatagcttacagctgtttttaatttatattaacaaaggttttgaaatgtaatttattcccttttttataaattgcgagtataatttataacacgttcttaaaccttgaccatcagtcagttgccctttgtttctgatatttgtgtttattaatttagatggggccaggcgtggtaattctagcactttggaagactgaggtgggcggatcacctgaggtcaggggtttgggaccatcctggccaacatggcgaaaccctgtctctactaaaaatacaaaaattagctgggcacggtggcgcacgcctgtaatcccagctactcaggaggctgaggcaggagaatcgcttcaacctaggaggtgtaggttgccgtgagccactgcactccagcatgggtgacagagtgagactgcgtctcaaaaaaaaaataatgaaataaaaataaataaatttagatggtagtttgtcagattttttggtttatatttttatttttggaaacccctttcatttgctttttttagaaaaattatccagttgacttggttgcctctttttttgctggttttttctgcagtgtttaattggttttttaattttccatgatttgcataatggcattccagatagagttaaagacaactatttgtagttccacataaaaagagtttgaataggccgggcacggtggctcacgcctgtaatcccagcactttgggaggccgaggcaggcggatcacgaggtcaggagatcgagaccagtctggccaacatagtgaaaccctgtctttactaaaaatacacgaaaaattagccaggtgtggtagtatgcacctgtaatctcagctactcaggaggctgaggcaggagaattgcttgaaccctggaggcggaggttgcagcgagccgagatcctgccactgtactccagcttgggtgacagaacgagactctgtctcaaaaaaaaaaaaaaaagagtttgaataaaaataccatttataaaagtgcatgtatctgttggcaggagcaaagtactattttagtaattgagtataggtaagactaatttcatatgttttattactggtttattacctaggactacactttcccattttgtggctattttatgggtttgttgtattttttttttttttttggtgtgtgtggctatttacaaatggtaaaacttcacctctagtattttggcagtttttttattttttctggttcctacaagaatttgagagcacagtttgaaattagttatgggaatcttattatatcaaatatcaagtaaaatgtgccccagttcaccagtagagtgaataaagtagctgattattttaaaaactagtggcattggagaagagcaaataaacatgaagcataataggtaaccattggaattttattctctttaatccttctgaatagtgacaagcgaaatttaagagttaacagttaatgcagtatctgccagttctttttttcttaaggcattacatataatttaaaaaccactttgctgtttttaggtttctttgaataatatccttataagtgattattattcttttttgaattctcttcttggcatttatttcattttgactttcttgattcttaaggctgtctcgttgttctgttagtattctatttgtaaaaacattttaatttcttcaggggaaaaaatcttaattctcaccacctgtgtttatttttttctctactctgcaggaactgtcattcttaccaccccacccctgtttcctccttagaatcttttcaaaatgtagtattctgttagaatagtggaaaacacagttgagggtcttacatgcgattcaaggttgaaagcaaccttgagacttaacgcatgatatgaaatgattgatattctagagctgcctaccaagggcacattccactttatgaaatattttaagacatgatgacatcttgtataagatgtcagaagaaggcaaaagaaagccttctacgagtagccatgcgttcattgttttcctatactcatggcccccaacttaatctcacctcttaaaatttataagctttctttgtaccttgtacctgtgttttgccattattttcatcattgctagttatttcgtgtgagattgccctgtcttttaaaccagctatggttcttcagacatgatgtcttatacttctgtatttagaacccagcacataatttggagcagatagtatgacgtaaagaagactagagcctaagaacctgatttcccttaactgtgacactggataagtcacaactttatcttctctaggcttatagttcctcaaccttcacatgaagaaattgaagtacataattatctgaagctgtcaaaatacattaggatccattaataattactaggagaacctcagttgagtagaggaaaggaagattgagggttctctgaaattggactactacatatttacaactcagggtttgatgcctaagttatttttttaatctgtaaactaaaaatatagttggtgaaagtgactttttcaaaaaaagtttaaagaaaaatatgtgtttgaagaattaatatacacctagcatcctttttggatttctattccaggtgccatcttcctggtatgttattactcctacctagatatttttattttctcccttctgtatatttcatcataggctgtactcccatcttttggctcagtttttttgagcatcagtctgaaatgttgtttatatgaatgtgaaagttattaagtagtaatatttcactaattttgaaaattgagaattcatttttagattagtgagaaatctgaagataattgtgtttaatagcttagaattctttatgattaggttatcacagttttgtgactaataaggattaaagaactttttagaaagtacgcttttttctcatttgcatatttttttctcctaattataatttatgctttgctagaggagtatttgatcaacctagagagattttgttttaccccttccattgatatctgtacctatttgatttggttttacattttaccgttgactttgatgaaatcattataaaattatttttgctgcattctgagagggctagctattgataattatccctacccttcaaagttgtttttttcctaatgatgtaaactgtctggaaataagccagactaggatgaatttccacggaaatggatgtaaatatttacaaggtaactccccttatataggataggagagaactgagtaaacagtacttaatttgttaaaagtttcagtttattagaggttcaagacaacagaaaaacctctaataaatattggcttaccaagatccaggtaggctatttgtttcccatgctcatgaagtctagagatagtctaggatagagaggcactgactaggcacctctgatgtttacatgaaataatctaattatagccaacttcctatttgatcataactttcttgaatatttaactctttgccatgtacttatttgtttacttattaattttatggatttccaagtcacagtgtaaaatattaccacagttactcatgctcattcacaatactgatgagttctacttggggaggtaaagaaatttttatatagtattgtaaaggatgtcacccagaagggagtttctcttgagcccatctgcatgctccataatttctctgggaatcaaatgtacatagcaagtgtagatcagtgcatttttactttcaaaagaaatctttgaacttctttgctctctttagtcatttatttgaaatttacataacccgacaaaaatttgttagcagtacaaatttaaaattgactaagtgaaacaaaagtgaaatattttatgtaaatattaggtaaaatcgttcaacttttaaaataaaagactttttaaaaggtaaatcggtgatgaaaaatacaattacggtatacgtttcgatgtataatttagcttgtaatatattgtttccaggttgtatttaaatttgtctctgctttgcttttccattttcttgttggattacattttgaatagttttaagattaacacttaaaatttcatcattttttgtaagtgccacttatttaatccatccctctacttttagactagatgataacctcctagcattttcggggaatttggaagtagttacttccattttatgtcatcagactcagatgaatgagcataatttaagaggaaaataatgatgcctttgatgacgaatataaaattcgttattttcttagatgtctgataatatgatgtgattaaatgaaaatctttttacataagattatcaaataaaaaatgtatttttaaaatttcagtcctttgttagaaatagtaggtgtgcctactttctaggttttgttgttgtttttaaatattacttctagtcttttttttttccttttttcttttttctttgagacggggtctcgctctgtcacccaggctggagtgcaatggtgcagtctcagctcactgcaatctctacctcctgagttcaagcgattctcttgcctcagcctcctgagtagctgggataacaggcgcacaccgccacacccggctaatttttgtatttttagtagagatggggtttcatatgttggtcaggctggtctcaaactcctgaccttgtgatctgcccacctcggcctcccgaagtgctaggattacaagactttcaggtcattaacccagtataatgtgctccttttctgtaggggcctagattcttcagtgtgtgtgtgtgtgtgtgtgtgtgtgtgtgtgtgtgtgtccatgtgtccgtgtccctcttggccttttatgttttgtatatctttttcttttccttttgttcattcctcttcctgctgagccattgattatgtagctttttactgtgaaattacctcttaagtggcaggctatatatatatctctgtgtcatcattctgttcttactcttttttcttgatgtctactaaaactatatttagggttgtatatttaataatttgttatcaatgtgtatactttgccattgataattgaaaccgcaacatggattttaatagtcagatacaagtattgttggtcttattttccaggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctggtatgtcacagtctgagaatattctttttgtaaggaagactcatacataattgtattgcagggtggatgctgattattacataatcagatcttgattgttgtctagtttagaaaccttcatatgaggcttatactttcctgtgcttttctctggttatgcagaaaaggttgcagggacaactggccatcatactataccatgcagatagccagatctctctccttttcatcagagagtacccttaagaggtaaaagagacaggctgtagttctgtttttgtacctcagactgataaggctcatgatgcgtttatttcctttttttctattttattcagctaggattgtcattctttgcttgcctcccaagaaagggttaaaaccttaagtgaggcagtgagtaaatttataaagtgtctttaaccttcaaggttagtagtagctagtagctgttattttaattaggtatccttttgtatatgctagctccttggaactatatttatagtgtatacattcttcgtaagactcagaaattttcttcctcctttcctcatagccatgtgtgaattagatgaaagttgtgttgaatttcttagtattgagtctaattttgtacgtttatcatcaccttcaaacttattttagtttctcgttaaattgcaaaaaaagatgattagttattaaaagtcaacaaaactaagttatgttttctaatagtctatcccccactgtctgcttttagtaataatttctcttctttgagcgctttgtttttgcgagtgagttaggttctcactgaggctaccctgttgtgaatcagtttattctgctgtccaaacctagcccactggctcacctgtctaatccctgttatacctaatttaagtttgcattttcacaaggaacgttatgactttcaaataacctctttttttttttttttttttttttttttggagacagagttttgctctgttgcccaggctggagtgcaatggcatgttctcggctcactgcaacctctgcctcccaggttcaagtgattctcctgcctcagcctcctgagtagctgggattacaggtgcgcaccaccatgcctggctaatttttgtatttttagtagagtcggggtttcaccatattggtcaggctggtcttgaactcctgaccttgtgatctgcccgccttggcctcccaaagtgctgggattacaggcgtcagccaccgtgcctggtcaataacttactcttttgtagtaatgatatagctgtatagagtactgtatacagtaataattacaaagatttttgtccccatttctccattgtaaaatttaaagtaccattagcttttatatttaggaaacagataatttaggaaaagataattaaaatgctttaacataatgactagtactagtttggttaatgactaaccttttaaatatttttcgagtttggaatatcagatttaaaagctttcctttggtagttaatattaatctctaaacttgcataatctcctttgatcatcagagatttctaggttagtcagagctttaattcttatttctgttttatagagaaggaactctacagagtttgtggcttgcctagatttatatagaattttagcagaattacatttcttgaattgtaggtcaggggtcttgtttctttttctgaatatgaacttttgaaagtaagcagataatttctttttaaaaaatactattatgagtcagagaataggagtataatgcacatgagtttgaacttcatactatttcaaaaagaattttagcttagtaattttaaaacaaatttagtcttgtatttatgagattttgcaggggcatgctaatgaaaagccatggaaagctacaattacagtatttaatctagtatatgagacattatcttgggataattatgttacctcaaagagtgtccctttcaccatttaactaacaagttacatataattactgtaatttctttcttctcagcatagagttttgactagacatataggattctatatagccttgaaattctcagttctcagtggaaaaaaggtagtgttttcctttaaaacagaagcaatttataactaattgtcttttttctttatcttttttttttttttgagacaggatcttgctctgtcacccaggctggaatacagtgggcgtgatcttggctcactgcagcctctgcctcgcaggttcaagtgattctctcaccccagcctcctgaatagctaggaatacaggcgtgctgtaccacgccgggctaatttttgtagttttgtagagatggggtctcactgtggtgcccaggctggtcttgaactcctgcgctcaagtgatctgcccaccttggccttccaaagtgttggaattacaggtgtgagacactgtacctggccaccaatgtctgttttagagttggagagttagaagtcaggttaaggatggagttatttgttagtagaacagtgactatcatgaaaattgttgtcacaaaactgctttatgaatatgggggcattttttttaaattaagaagataaaaaccacagtcttttagtatgacttgtatcacaaacagccacttcaataaattatccattttactgcaggggtcagcaaactatggtcagctgagtttggctcattgcctgaaataaagttttagggaacacagccatgcccttttgtttacattgtctgtggttgcttttaccttgtaaaagcagagttgggtggtcgagacaaaaactgtatttcccacaaagtttaacatatttactatttcaacctttaagcaaagtttgccagcccctctaccggagaattgattctattcaagaacatggagattgaaacctgtcagaatcagctgtgcttttttacactatcactttccctttcactcctcactgatcttagacctgctccactgagtcactactattaattggaatgtaatagtaaccctccttgtatgttgggacaggaaaagatgaaccactttaccagagttttgtgagcatccctttatttttaagttaggtggtaacttctaataaaatgattgttggcagatagatcggattgttaactagtttcaagttacgtatgtgagctttttaaattctttttttaaatttatttttagcttctcagagattaaaaaaggtgtttgattatttacattaatcagtagttactaatttctttccagttgttgcagaaactgcaggtagcttatctggcgtcagtatcacatctgaactaaatgaagaattgaatgacttaattcagcgttttcataatcagcttcgtgattctcaggtaacctagatgttttagtatagttgagtttaaaaaatcacattaattagaacagtgattcagaaacttcagtgagcatacatatcacctggcatgattgttgagcagtgtaggtttctgattggtggggtcccccccaccttcaaaattacgattcatggatttggggtgggcttctccacgtctcagtccaatgctggtggcctggggactatactttaagaatcactaaattagaggagagtttactttgaaggaagtgattaatgaagtttttctttgtatgctactggatgacgtattcttttttcctctaaaagacttaatggtcacaacgattaagactttgctttaaatctgtgtccttcgactagatacatgggattctatacagccttggaattctcatttgaaggaatattttactaacaattttaagaaagttcttaatttgagagttagcaagtgttataatttgatgcactttgtaagtgatataaatgcagattttcaatatgggggccttgggtaagaaaggatgaattaatgcctctccattggaagtgagtatgattgaagatgcagtgtctcttgtcttcttgctgaccaagtgaaaatgagagaatatggcccaaccactttggagagttatatagcagtacctagtaaatttcttctggtagacctggggcctactttagagaaactctcacatgttcagaaggaggtagatggaagaatattcatggcaactctgtgttaatagcaaataaccagaaacagcccaaatgtccatcaacagaaatgggctaatgaattcttacatagagtgaaattctttatagcagttacagtaaataagccattgctaatgaatacaaaattcaagtttaagaaggatcccacttaccttattttaaaaaaagtctacatttttaatgtatgtatacataggcattagaaaataaaaacatgtagagaatggtagatgcctgattccaggttggggttacctttggagtgggtaatgacattggaaagggtacaaacagagctttagttaaatctgtaatgttatatttttcttaaaataattgatgcaaatatgggaaaatcttaaaatttgactaagcataatgggagatattcattatatgatttcctaagccctagtggattcttgcaaagtttcataattaaaaaaaatttaaaaaaaggccaggtgcggtggcttatgcctgtaatcccagcactttgggaggccgaggcgggtggatcacttgaggtcaggtgtttgagaccagcctggccaacatggtgaaaccctgtctcaactaaaaatgcaaaaatgagccaggtgtggaggcatgcacctgtaatctcagctgcttgagaggctgaggcaggagaatcgcttgaacccaggaggcggaggtttcagtgagttgagatcacgccactgcactctagcctgggccacagagtgagactttgtctcaaaaataaataaataaataaataaataaataaaaaataaaggaacatgagagagaagtggtgggaaaaattgataggttaagaagttaaagtttacagtggtagttctagaaagaaggcaagagagagaatgagatttttgaaggtttattttatgtaacgtggcattgttattacttttgattcaattactgatgtctagtgaatccaagacctctgtgtggtcatgtgtctctaaaactatgtagagtcagctctcagtatctgtgggttccacatccatggattcaaccaaccatggatcaggaatattttggggggagaaataacacaacaatttttaaaatgcaaatttaaaaatataacagctatttacatagtgtttatattgtattaggtattataagtagtctagagctgatctgaagtatataggaggatgtgtgtagattatgtgcagatactacaccattttatataagggatttgggtatctgttgtttttggtgtccccaggggtccttgaaccaatccctcatggatactgagggatgacttcatatgttaatagtggcatatcaggaaaccgtatttaatttgggaatagtaagggtatatacttacctaccagcacagcctagcaaatatttctttctctttataaagaatatttatgcatttaaaaaatgagaatgcatttaattgcgttagtcttaattcttcttttttgttgtttttttttaataagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatgtgagtaaatctggttcagcagtattgggtataagacacacaagtatatatactgtcacataataaatttagtatttggtgaatgaacacatagctcctcaaaaatatttgtagggacttaagacttgcatatgaaaagtttctaagttgcaagccaatatatatgaaagccaaataggtgataaatcagttttataattcagaaaagggaaagaataaagttggaccttgaaaaattagtaggattttaataagggaaaggtagaagagaaggcaactgtttgatacgtggacatattaatactttgtttcttaacattcaaaattttcccttaaagaaaagttaatccagttagtactttgatttaaaaacccaaaactgtgaaacatagtgtgtattaaaaaaaacaaaaaacaaaactatgaaaaacttttatatatggtttagtctagagagcccagaacttccaactgctggatttatattcatttttaaaaaatatataaataatcatctcaagcaggtataactgcgggagttatcttttttgctccacacgtgtttaaccttctttgtctaaatcagatctagtcttcagttcctatcctaataccttttcaaacatggcccctgtctcatatccaaatagtaatagaggctcaagcattagaaattgaagtcagtagggacaacttccaactagtctttaaacattctagctgctgtctaattaaagaaaagatgagggatttaaaaataacaaaaccattgtctctggagcctctggtccttattctccacctatctccttttccttttccacccacaaaagaaccttaatattcctgtcctaaaacatactcctttcttttctctgacttctgctagtctctttctcctctagagtataatcccagtttttatcctttacaaacacatgaatacaactaagatgtgtggctgggtgtggtggctcacgcctgtaatcccagcaccttgggaggctgaggcgggtggatcacctgaggtcgggagttcgagaccagcctgaccaacatggagaaaccccgtctctactaaaagtacaaaagtagccaggtgtggtggtacatgcctgtaatctcagctactccggaggctgaggtaggagaatcgcttgaatctgggaggcggaggttgtggtgagccaagatcgtgccattgcactccagcctgggcaacaaaagtgaaactccatctcaaaaaaaaaaaaaaagaaaagaaaaaaacaacttaacatgtgaaagttgcgcttaagtccttgtcgtcagttttgtatgcataaagtagcactccgtatactgatgactcttaaagcctatttttttcctcactgggaagcagtgtgagagcagcagcaaaaggtagactcgtcaaggaatagaatgaggagactgctggaaaccacctacaggaattgtggtactaaagtgagcaacaaataatgatggttcctttgagaaagatactggtaaatgacagcacctttgaaatggtaggaggtagagaagtgcaaagattcttaatctttaattcctcttgaaagcatgatttatatttgatagtaacagaagttaaatagaaagtaattaaatttagttcaaggaccatagaggattagccattatctaaatagcaggtttttattgctgtttaatatttcatggtttgaggtaccacagtcacttttaacacttttctttctctcctggagcaagaaaagttccttcttggtgtccagatgtgacatccccctgatctgtgggtatgaaaaactgatgaagacctaatcagctacagctaccctgtaaagattacagattgagtactgcacatgattcatagtggccctgtttaacttaacctagaaccaagtttatcaagttagttaccaagtttactcgttagttaaaactaactagagtacttctctagttagttttccaaggtagaatatcattattcttgtcaatttccatcttttttctttcctttctgttttaacccagtggttatattgtaaaggtgatagaacctgtggaagaaagaggtaaacaagtctttgtacattttgatgtgtttaattgtggagtaagttaataaacaattttctgaaatttaaatctgcagaaattaagttgttaatttttactttttagttttcaatatccaagccaactgtatgtgtttgtttatggtaactggtgattaaaaaaaattttttgttgttgtgccttcttcagcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagtaaaacatttataatcattgtttacatgaagttaaataatagggataaattctgtttttttttttatgttgaaaattctgcaaaacgagatttatttaatattgttgtaaacattcttaagggataggtagaagaggcgtgtgtgtgttgtgtgggcataatttgagttgtctaagagatgtgatgtaacatagtttctgtgaactgatgttactttcttgtttttcaaataaaggatcaaaaataagattacagttaaaatatttctatattcagatggtttagagaccaggctgtagaatcagacagccctgaaattgtatcacacaaggctgtgttaccctgtacaaataacttagccttactaagcctgtatttcctcatctgcaaaatagggatgataatatacctgttgataaatatgttttcattaaaaaacgttggcgcagttcctggcacttacagtaagaactcagctaacttaatttttatttttggtaaacgtagtatgtagtgtatagatctcatatgtgcagacaaatcaagaaccttccatacatgctcagtaatgtctgtatacctgattttcctgagaggtagtatttagtagtacttcacacttttgatacttgagaaactagaaatctttttgacatcaggttttctgctattaacatttacacctgcttaaaatgaacaattaaattgaaattggttttcttacacttttgtccctaaaacagcataagaaaataatgtgagattttgagtaagctgtacttggcattaacctcattattttacagtcataccccctggagagttcactaggtggatattccattaggtctaaattttgtttctgttagctgctatgatatgaaaataatgtctgtattattttgctaaaatgggtgtaaatcgtatacataaattttttgtttatcaggaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcggtaagaacttttctggggatgtttttccagcatattcattctgtcttgatacttataatgtgggaacaaaaatacttcgttgtagtatttactatttgccttttatttaagctttctactattttggtcagtgtaatcatctctgccctgtgaagaaagatgaatagggaagtatggagtacaatagttcagtaaatttgccctttgttagactgaattcgagtaaatcatgagatgtatctaacttagcattttgctgtctttttctttttaggcgtaattttcattttttcagatgtttttctacttaaatagcacatatgcagaagttaatgaaaagcaggagtcgattattcaatttgaatttaaatggaatagccaacaatgtgcttggtttggtgttattttattagcagttctaaacttggatttctttctctctttttttgtgccttaaatgacttcaggctgttttctttcttctagaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttaggtatgactgactgtatttacatataattttgctgtgttattcttacaaagtgggttttcgttcatgtgtgctctttcctttaaaagttactggttttaattatacatgttttcagcagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggtaaatattgcttggtcttttaaaaacctatttgtcaaatagtacagtcttaagtaaaatttgtgtatgataattactttggtttaattatactaatacacatttatgtatcatatgtgaggtttaaatttttagcactttacatgctgtatgtcagaggtcagcaacctttttaaattaagagtgagttggttagatagttgcggctttgtggcgatatagtatctgtcacaatttcacaatgcaaaagcagccatacataatacataaatgagaatgattatttgccaatatagctttattttattataaacaatatagctgtttttatttacaaaaacagaagaggttttgttgtttttgttgttttgctgacaactctggccttatattatgtacaacttgcagcatctcaatgaggtagacattaaataggttaaagagatcttaattgccgaagtttatatgactgtccaatccagaattcagacttcctgataccagagcctgcgatcttaacctactgtatataaaagaaaaaccatatgttatcttattcagtaaggttaaagttagaactattaatcataaattttaaaaagcagtttatacatattttgtattatagttacacaattaactataatgtacaattgtatatttatacaaatgtaaaaatatacaattatagttacataactattaacacaaaatatgcctacacttataattgtataaatatgtaattaactataattgtattaccgtgtaactattaacacatttataaaggtgttgtgtatatatatataaaaatcatataaaatggtttttgtgagtgaaaaacctcaagttttattaacagtttcttttgaaatgctatgtactttgaattactcaagtaaaaggtgagcgtgctctctcggttcaaaaaaagtacgtatttgtatttatttattttttggggacaaggtcttgctctgtcacccaggttggagtgcagtggcatgattttggctcactgcaagctccatctcccgggttcaagcgattcttctgcctcagcctcccgagtagctggaattacagatgtgtaccaccacacctggctaatgtttgtatttttagtacagatggggtttcaccatattggccaggctggtcttgaactcctggcctcaggcagttcacccaccttggcttcccaaagtgctcagattgcaggcacaaaaagtacatattactaataaactctgtctttacctccattaataatcctattcttcttcactgaagttgctaggccttttctctgcagttaggtacatcactatgcacctatttttaaaaaaatacatgacgttttgtggtatgtttctttgtttttacaaactgtatatataatacactaagtattattttatagctttccttttttccccactccacattgtctcagagaactttcatgtcagtatagttctatataattataagtaattaagaaacacaaatatgataattataaaatataaataatactgcatatatatatatacacacagtacatagttatttgtagctgcagtacagttttcagtatatcgatggactttagttaatgtataatagcatccagttactatatacttgttttcaatctttcgctatttagaaacaatgcaccaaagaatatacttgcacaagcttttgtgcatttgtgttttttaagaaggatttggagaagtggaactactatgtcagttggtgtacattttaaaggacacaacttaattggtctctagagagcaattttctatatgtatttccgtatgtatttatatttctatatgtatagaatttttgatatgtattcatatttttctatatgtattttttatattttaagcagtggtatgtgagagttcgtttctccacacccttgattgtgttttattttattgatataccgtagcttgtttaaccattactggaattggccttttccaaatttcccaattataagaagagttattgaggtgagataaacatgtatgcaaatacaaacgtgtgtaaacaaatatatattgaacacgtgtacacatgtatacaaacgtgctttctttactgctttaatctttttatgtaaattttacagactagtggtatttactaaggtatgaattggataatgtcttgaggtatcaagattgttttaatgtaatgatgctctttcaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaaggtatgttaagcttttggccttcatttaatataataaaaatttagtgcctgttttggagaaggtgctcagctaggtactgtgttatgttgtgcctaatgcttcatcacattttattggagtccataaatataatgtcaatttaattgtagagagaaattttatgaggctaaactacagcagcaacagagagagctaaaacaattgcaggaagaaagaaagaaactgattgacattcaggagaaaattcaagcattgcaaacggcatgccctgacttacaggtaattatgaaatttatttctaattgtctgaaaaaagatgtttaaaaccttaggtcaactgaaagtactcttttttgtttttgtttttctttttttttgaggcagagtctcactctgttgcccaggctgaagtgcagtggcgtgatcttggctcactgcaagctctgcctcttaggttcacgccattcttctgcctcagcctcctgagtagctgggacttcaggcacccgccaccatgcctggctaattttttgtatttttggtagagacagggtttcacagtgttagccaggatggtttcgatctcctgacctcgtgattcgcccgtctcagcctcccaaagtgctgggattacaggcgcgagaaactactcttttttttctagtattaaggtgacagaattatatctagtaattttgtgattaatgaagtggatgaactaatgaagagttggggttatacgtttacagtgtaaaagacagcacataggaattgactcattattttcattcttactgggctggctggccatagattcagaacatgtgtactcataactgtttattatgttaaaatattctgatttgacttttgcagttatggaccagcatttccatcttttactggcctgaaataatataataaaatctttaagccaccataagatatctaaggaaaataactgtatgtggtttaaagagtaagttgtatatacttttgcttattaactaggatcttatacatgggtcttgagattgaacagaaaataagatatctttggtgatatcaaataatcagttaataatatgggaaggggataataattccttctgatattttcccagagtttattggctagcttttttttttttttttttttttttgagacggagtctcgctctgtggcccaggtgggagtgcagtggtgcaatctcggctcactgcaagctccacctcctgggttcacgccattctcctgcctcagcctcccgagtagctgggactacaggtgcccgccaccacgcccggctaatttttttgtatttttagtagagacggggtttcaccgtgttagccaagatggtctcagtctcctgccgtcgtgatccgcccgcctcggcctcctgaagtgttgggattacaggcgtgagccaccgctcccggcctattggctagctttatcttcagttaggttgtgttttcaaagaaaggaaaacagggcaactgtgttcattttctaaacccttgcctttcctactgtatctaatcctttttctctccttatctccaatctaaataatgtctagagaaatatgttgcaaaggtgggttaagtatacaaaattttccattatgttttatccctgttgtttctgttgtttctgagggcttgtgtttgttaacctcagcttgtgttttcatctttgttttcttatttcatgttatcttcggatgatgatggaagtcagggtctgatagcagattaaatatggcactagagccttagtgccatatttaaagtaactgcttttatgaaattaatataattgctttaattcctcataacgttttttgtgaattcctttttagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgaggtattgtaaattgtactctcttgttcctgagttagtcttttgttttcctttttttttcttcaataaggcacatctcaagaaaggaaactgaatatccttgaaacatgtttgtaaatagtagtctgctttgtgccttttttagtagacacaaaaatgtaatagattataataatataagaaagataaaacattttaatttttaaactttaattgaaaagttttaaataattttttctaaaaagtaattatcttttaaaaatatccatgttctttgttagtaaatatttggcagaaatatataggggggtagttgcagcaaatagtaatcatttcagttagaaagacctatcctttgacattttatttatatgtggtttgtagaaaatataatttttcctaaataatttctgaagtatatttgagttctacttgtttctattaataggccatgtgcggtgactcacacctataatcccagcactttgggaggctgaggtgggcagatcatgaggtcaggtattcaagaccagcctggtcaacgtggtgaaaccctatctctactaaaaaatacaaaaaaaattagctaggtgtagtggtgggcgcctgtaatcccagctactcaggaggctgaggcaggataatcacttgaacctgggaggcagaggttgcagtgagccgagatcacaccactgcactccagcccagatgacagagtgagactctgtctcaaaaaaaaaaaaaaattggctgatttttttgtaatcataactatattattattttaaccttcatggacatgttagtgtgaaaaggagagaatgagaatagaaacctttgttgatactgacaatactagtagtcttttactcttttaggctacagcaaatccaaatatttatttaactctggtttcttaaaaaaaatagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaagtaagagagctgcataaatcacttttctaaaaatgtcacctgccgaagattgacctgtaggctaggcagccacatttctcctctacatcacagcacaaatctgctatttcagtgaggctactgtttaactaccacctttgtgacccagtttaattgaatccagccactttctgttctgacttctcgtagcatcagctttctcttttgtcttaaattactatggcacttgatcaaatggtgatacagattttcttatgtgtataagccttattagttaagtttataaaaagaaaatgcttgatattttgtagtgcttttctgtcaggccagaaataggcccttttttgcttaaattgagtatctgctgtttgtaaggttcttaaggatcttaaaacattttattataatcatttagtttttaggatttcagtttaaaatgtccatatttagaatatttctaaaagagttggtcatctataagatcagtgaattatttagctatatagtagtaaccatatcaaaaattttgaaatatagatttgtttatgaccttcccttttgatatcctcagatggcatttctggaatttctggagttttgcaccaagccctactctcttctcagatgaacttctattcttggggtcccaatatgcattttactgatcagactatatctacaatattttattctgttctgggtactacacgtctgttcttctacagagttcttcagatagttttgatgagcatctggtttcagaatcattggtctggatttttgctgtccagtatggcagccactagatataggtggttatttaaatttcaatcaaatgaaattaaaaatttattttctcagtcatattagctgcattttaagtgctcagtagccatgtgtacctagtgtctactgtattggatagcacagatacagatgattgccgtaattatagaaagttctgctgaactgcactgatcttgaaaactccctcaagcaaatgttaagggtagtttagctttgggaagtagtcccaggggatatgatgattatttaaatgtatttgaagaattgttttgaggaaggcaaactaaacatattctgtatataacagcaatagggagagtgccacccgtagcatagttattgtgattaaatgaaattttatatacagacatgtatatgtatgtttgaaacaatgtctggcacatagtaggtggcagagtatttaacttatctccagaatgacatctgttttatgtctcttaatcactagaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggttagtttcagtattttaattttgtgcttaatttaagaggctcaggtctttttgactgacagcaagcacttctgcagttctccaagccaactgaatgtcctacaactcaattcaatttttacactaactactcagagttagtgcagacccctcaagttaaggggctcagttcagtaagactgccctcacctcagacttcaatttcaactgcttggtccccacgttacccacacttctgtgcaacatggctagaaatttgggagttcttacaatccccttcaggtttatttgctagaacaactcacgaaatacaggaaaagacttacttacgtttcctcatttcttataaaggattctgaactgccaaatggaagaggtgtgttaggacagtgtgtgggttggggaggtgtgcagagcttccatggtttcctctgtgtgtcccaccctccccagcactttgatgtgttcagtgacccagaagctgcctgaattctgtttacggttttttaggagatttcattgcttaagcgcaattgataaaattgttgactgttggtgattgttctcattagcaaaaattcacatctggttgaaaggggcttgttacggataacaaaagacattatcacttgggagattccaagggttttaggagctctgtgctaggaaccaggcacaaagaacagatagatattttattataccacaagaatgttgttccagtagatccaggtaaactggatcagtcttcactcctgctgttgagaattaagcaaaaataacaaattgtagatagtgaaaagagtctgccaacaaagatgttattacattgttactaataattataactgaaaatttcttcatgaataacagatggtgaagtagatacagtagctccacttgatgaaatactatgtggttgaacttaaagcgtgaagaatggaaaactacttgtgacataataaatatttttattttgcagaatacttaattatatggacactgctgtgtaaaaacatacatgaaaaagactggagactaatgaaaactaataattgtacaaagctaaagatctggacttctcccccctctatattttttaatactttgtatgttcttttaatttaaaacagaatattggcccataggcctgagtatcagagtttattgctgtattttaaaaaccaaattattatgtatgatgacttaatgctttcaatcttgtgttaggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcaggtaaaatttgctatgaaagtatatttttcgtctatttttataacttctgaagcaatacaaatttttctcaagtcatcagtaactattaacaaacattttctttcaatagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggtaatctgtttcttagaagtattgagactgtataagagctaacattgagcagaggttttacagttagcttctgggagaaaagagcaagaccaaattgcatatttggacattctctttcccttgagaattttataagtggtgatttacctaatgtttccttttaataccatggatttctgtttttataaatttatgttattgaattttacttatattttggcagattttatggtgtgtaaattgtaccacagtgaagctataaacaaacaaaaaagtgattttcttacagttttaccgactgtcggacagaagtactaagttcatttcttgttccagagggaaagttattgaattaagccttatagagcaagcacgtatttgttacagtatcagagcagtttgtctgcatgcttttgaatcatttttttacatgtattcttcctgaatgtactttatatatatggcaatataactgattcttagattactgacttaaatctttgtaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtaggtgacttaacctaaagagaaaataaataaaagcaaagtgtttggaacaacgtaatttgtctattgcctagatgttttaacattttcttttggagtggggtaggaaatgtttgcaaagaaagttacaaactcttttttttttttttctttttgaggcggagttttactcttcttgtccaggctggaatgcagtgacatgatcttggctcacggcagcctccacctcccaggttcaagggattctcctgcctcagcttcctaagtagctgggattacaggcatgtgccaccgtgcccagctaattttgtatttttagtagagatggggtttctccatgttggtcaggctggtctccaactcccgacctcaggtgatccacctgccttggcctcccatggtgctgggattacaggcatgagccaccgtgcccagcctacgttgttccttttaaaccaaactttaataatacggttgctaatgaaattaagtaaactacttaggaatgattgcttcaactatttattaagaggaaagagaacctgttcaatggctgctgtatactaggcactgtgtaaaacgctgggagagtaaagatgaataagacagtgctctcctaaaggagtaccatgtcttgttagggggatgctaatagactaaaggagagcacatttagcttaagcttttctttggatggttttttctgcactcattatgtaccagacactatgtaagttactgggatctaaagatgagtgacactgatcctttaaggaattcagggtctagtgaggatgctgttaatgaatgcttatagtacagtgccacgggtgccataacagtagtgcaaatgctgggaagtgtcagcaaatcagttccgccgccaaaaaaaaaaaaaagagttgatatttaagctaaagaatgaatagaatttatttccagagagattagaaatgaaagggctttctaatagaaccacttagagttataaagcaatgaaatagtacatcactcagggaatttagaggtatttaagtgtggctagtatttaggggaagagtaattgatgtggttgaagagtggcagagagattttatgatgtgcaaacaagcttaggttttatattgcagacgagggtgccattgaaggactttgagcaagggataacatgaaatttatattttagaaagattacactggtgaaagtgttcgggagaagttggaggaaaggagtgaagatttagctggtgaacagaaggctgtcataataatatggaaagaatgatagcttggccttaggccttgtcagtagggatcaagaaaaaggagtaactgaaagacattatagtgatagagtgaataagttaagtgaccgattatatgaggtgaatcatgaggaggagttaaaggtgttggcagggaatataggaggagaaaaaaggttgagagggctttgtgaatatatatatatataatcacaatatatatgtactcaatacttcttacatacatatattacagtgttatgcccagcaatgtgtatatatatggatgtatatatgtgtgtgtgtgtgtgtgtgtgtgtgtgtgtgtatatatatatatatacacaccacagtgttttttctttataggattttcaagacagtggcataaaaaatttaagagactttttagttcttgggtgtcaattaatattggcagcaaacatcacatgagtagacttttaagtaataagaaattgcaaatgctcttcctttttactaaaatatacttcatacccacaccaactctatataaaggctcttcattcttcttaacagtacaatttttgtgaaaccttcccagtctctttccccacacgttgttagtagcctcttgcaaatagctctgatacataacagtatttggtaagtatttaattatattctactttcccaataaaaatagagtagaaacaacataagcgtaggagtcatacagacctgagatctaatcatctttttcatttattagacgtttgatttctaaccgtatttgctcactggtaaaatgaatgcagtatctattttataagttacttggttttaagtattaaaccaagtaacatgtaaagtgcctgcagtagagtgtgtcacccagtaattgataaatgtcaggtaccattatttctaacttttagctcttaagggagtggggattattaattgtctttgaccaatgcctaaaacatagtggcctaagctgtgaacagtgattggataaatattagcttttttttttaattaacagttttttgttttggtggatttgaatgacatgtttaattaaaactgtcttttaatttcattttaaagctaaagacatttatttatttttctcttacccattgcttttactgattaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggtactgattgtaaacagtcttttattgcttaaacattcacttttgtgattacatctaattatgtgtaatttgaaaacacaactagggaggacgtttgtgatgatttggcttgatgatgttggaaatatgaaactttgacgtatcagtagatgagatgccagatacttcctggtaaccctggtacattaaaagttgtttggaaggatgtggcgtaactcataggatttgttttgtctctaatttgatacctgtctttacggttaaagcagtttgctgttcaatgacttagggctggaaactaatattaactgctagaagatagttgttaagtgatgatccctttttttgattcctagctcttgattagaatcacttcctaaagcctattcaaatataatgttgagtactattagattataaaaacaacttttgtctcataagttttgaggatgcatggtattaatgatatttaggatttcttctgaaacagagtttttgactcagtgtgaaaggttggctccgttgaacctagtctgtcagatgtatctctctgattgtctttcctactccataaaaatatatataattcacattatatttctctttagctatgtgattaggaaggtctcaggctcttatattagcattttgacactgtttaattactgagtcattaactgggatttttttttttttttactcgattaaccaataactctgagaattccaactttgtattcaccactaggagtgctatgattaacatccgttactttgttgactccttttttttggttgttctatctttttcctgttaaatctcatgttgctctataaaggtattctgttgtcagaagcctaacacagtgttagttcacagttgccattcagaaatgattgttgaatgaatatccatcacgagcagtaaacatttattcaaagcttcggtgaatagactttcctattagaatgtccctacttcattattttcatataattgatagtaaaaaattactctggttttaaattatttatatcatttttaggatggatctgaatgtctaatattattttagatatttggcctacttcagattagacctcatttcccaaaatctcaactattgtaatttcatggaattaaatgactagagataaaaagtcagataaaatcctgtagtcttattcaggggtcagaaaacttttcctataaaagactagatagtattttaggccttgctggccatatagtgtttatcatagccattcatctgtgacagttttgcacaagagcaaccataggcaatatgtaaacatgagtatggctgtgttctgcaataacactttatttatgggcacagaaattttattttcatataattttcatttgtcacaaacttttaactttttttcttccaactatttaagaatataaaagccattcttagctctcaggtcatatggaaacaggcagcaggctgaatttggtctgtaagttacaggtttctaacccttgtcttgagttaaatcctgtaggtcactgtctcccagactattaggagcagtgttgttgttcacgctaggttctgtgataaagttttggacttgttgcccactaccacttttaagagatttataaagcacattggcatattaaaagttgtgagatattttacagacctgtttaactttgttttatgtgttttctccccaacctagacgaccgatgagtacctattaaatattaagggatgctagtgttcagcagataaaatttgagaaatgacagtagactaatagaactacggacttaaggagtggagaaataaattgctaattgaatgaccaattgtattcaccaaattcttgttctacttgaactgctttaggtgaacacaaatccatgtatgttcccaagccctctgctatagctctttttgagccattcttccaacttttgggtcttgtatatcccatcctcccttgatttttctttttgttgttttttctagaggcagggtctcactttgttacccaggcaggagtacagttgataacgatcatagctcactgcctccttgaattcctgggctcaagggatcctcctgcctcagccccctgagtgtctaggactggaggcacatgccactgtgcctggctcatttttaaaattttttttagagacggggtctcaccaacttgtctgggctggtcttgaactcctgggctcaagcattcctcctgcctccgccttccaaagtgctggagttacaggcatgagccactgcagctagcctgatttttctttcccactgttttccattgctaatgctagatctttgataaggaacttttgccagtaaaagtggtttagtgagatgggtccagaattaaaactaatttactaccttagcttatgtgatatttgcatatttaatgtgtatttttgtgaaaacatttttatagcctgttgacaattttattcacctaaatctactcgagtagactataaattcagtgtatttggagtttttgtaaactatagttgttaacttataaaaacttgttttcattggtaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcagtaagtgttgaaatttgttgaatgttgatcagtgtaaattttggtaatcttactttgacatgttgacatagatatagtttcagtaaggctagatgtgcaggtgctgttctagacttagttgaacagtcatttttagttacctttatatatataatttttttttacaaaataatattcgaaatagggtttaattttctggattaatgttgtaaaacatggcatttattttttgtacttcttaaagcttcagttttgtagattattgaaaaattgccaaatgcccacgtttactattttttttcttttgctattgtatcagatcctgcatccaactctttggtcatgacttttagatggattcttgattgattagtttaaagaatagtgggcttctaaatacattgcagtttttgaatatcatatgataaaaccagttttaaaacaggctggcttaagtccttctggaagtaaactcatattttactcagtcttgccattgaatgtcatattaaagttgtttaaaaaatttttttaaaattttctttatggtgttagtcatacctcttacaaaaataggttttctgtgatttttgaattatttactgaagtgtagtactaggttaaaaatagtttcattagctaaaatctgcagtgttacagctgaaggatattctttttatgtttgcaaaggatgggctatggccttgaaaggttgttctgagtttaaggagatagtatttggtgcctaaggctagttgcggtggctcatgcctgtaatcccagcactttgggaggctgaggcaggtggatcacctgagagcaggagtttgagaccagcctgaccaacatggtgaaaccccatctctactaaaagtacaaaaattagccgggcatggtgggcgtgcctgtaatccagctactaaggaggctgagacacaagaatcgcttgaacctgggaggcagaggttgcagtgagccaacatcatgccactgtactcccagcctgcgtgacagagcaagtctctgtcagaaaaaaaaaaaaaaaattggtgtttaagaacaaagtattctaggcttataatcaggaaagtttgaaatgcattgcacactgctaactccctttcttggaagttcacaacacatacaagtatagtaaatgccctgagaaatcctgtagtaagaaaatacacttgtaaactttggcaaccttcatcttaatcacttttggataatgaaaccttagaaaaatctaatgaaaaccacagatacaagagaatattggcacatttttaaaaatttcagtaattcatctatccttgaagtccttggctcctaccttgaaccccatgtgaagaatctgacggatggtttaaaaagcaagtttgaacaggagtgaaagaggtgacatttttcttagcatacacattatcagccttgaagtaattttctggttataaaggtttaggagaagctggtttatttagtaaattaattggtaatctgaagctattcagaaagttactgcgcttttccaagattactgttggtgctaccagagaagatttaagtagataatggccatttagagacagggccgttaggcaactcagaactttctatttcctagtgctttgccctcacagagatgctctttgtcatataaataaatgaagaaaagctgacattttaaatttcagcattgtctcattcagatagttaatttgaatctgatagggcaatacttcataaacttgagtttcacatgaatctccttaggaatacagttttaagtgcagattctgattcatttgacttggaagggacttgagagtctgccttcctaacagactctcttgtgttgccagtattggtctgtggactacacttcaagtagcagattttacaggaaccttagctaatttatggctatgaccacctaaccctagaaatattggtatgttttaatttttctgaaacccctttattctcgggaattacttttccaaatatataattcagccttttaacttcaagacaaagattgacattctgatctttgtgctcttgtccttcatattgaagtataaaaatacctgctgtttgaaatgtacagtcacatttgctcaacaagcattcaagaccatctgtcagtgagtgccccactttaaggcacacacacacacacacacacacacacacacacacaaataaaaggcttgatagcagaatcaaactatacatagcagagccgaagtaatatggggtaaaatcaaattagctcaatccttgctattcaaactctgaactgtggacaagcagcattacatcatctgggatattattagaaatgcgtgcttttgggcctcaccttatgccaactaaatcagtatgtatttttcttcagtatgcattttggcaagatttttggtatgaagatatgtacgtgaaagtctgaaaagtactgaactagaacactggtttatgtggtttttgttccttttgtgctataggaatggtcaagatttgttagaaaaaaggatttttactgtatctttaacctccacctcccgggttcaaacaattctcctgtctcatcctcccgagtagctgggattacaggcatgtgccaccacacccggctaattttgtatttttagtagagacggggtttctccacgttggtcaggctagtcttgaactcccgatctcaggtgatccacccccattggcctccggaagtggtgggattacaggtgtgagccacagcgcccgaccaatttttattatatcttaaaggaagtggtaaatagaggtgggtggggaaaagtttagaaagcctttcaaattgttactacagtaagaaaagtatagagtggggaacaagcaggatgagaggaattgggaacggatatgacagatatttcagcatagtgggaattacactgctgtcttgagagatatggtacagccagttatactgtcccatacttactagactgatccaaatatatatgtgttttttgtgcatgttgacattctttcagaagtagcttgataaatctcatataactttgtttcccatgatggtaatgtgttttaatccttagaaggtctttatatatgaaaatagatattgcatatgaggtaagaatatataaattatgtaataatcgtattttaaacttgagttcagacttagaccttatgagttgaaggtgatttcctgccttactgagtttttctgttatcagacctataatttgtttacactatactcttctgatattattagtagtagccaagattttcttcactcttttcttggaaaattggatagaactgttaaggtacagccttctgggttcttactgtccttgaatcttttcatttcttccttcctccctttcctgttgcacactaatgaagatggacatgaaatggacgtgaaacattaggcaaggcaaggcctgacagatttggctggtaaacaactagtcaactttttgaatttagacagttattaattacttaggcagagaaaaaagtagtccaaggtgccatttctctgtgccccttgtctcacacttgaaaagagtgacaccgaaataaaaggggctagctaacgattgtcccttgaatggtgggacaccctgttgctgaggaatcattgttatactgcagctaagcctgtttagtctgcaaatgtaccctacaaggttgaggaagaaaggtctcatgtttcattagaacctgagaggagatgggaaactctcctgacagaagcatcctggggcaagagagaggtgagtggaaaacgtccatccatatagcaacttctcacaagcctctcttgtccatgttccaggatgattccatggccttctgccaagacagcttgcactgtgattcagaccttaacctctctgcgctctttggacatgtgcaaggtctccagagtgccatggctgatctctttcccttcagtggaggctcaagtagaagtactgtttcttctactaatgtcaccccctcatgctgagaaaaacagaatgagaaagggaaagagtggtgaagtggcataggcgataacatccttatctctcatcagtcacacattagtaccttaactttggaaatctagcctttgatgtttttaatttgggactcatatataaaaccagttttttttttttctcttttcgtagcatcttaataattatagcctacttctcttcacagtttcagctattttggaggatgactgtatgtattcctttttaaagtacctattgggactccccactgagaatttcgtatatgccacattaagtgcattttaattttgattaaaatttattcatcacttttcatgtgatacagtaacagcatttaaatgtttaatttcacttatataaatgttcatgttagaataacatacttaaaatctttttctttagatcattgtatgttattaaatgagcaatagtactaccagtcatgtcattttacatattgcttttggcactcatactctttattgctggttttatattaagatcaataataatcaagaggtctctcttttcagtaaatttcatgcagactcggtggcagaggctaaactttagtttgagagaccagtgaaaaaacctggaacctaaagttgagatgatgaagtcttacataatggccttggaaatagagagggagggctgaatctagatgggatatcacagataataaattgacaatatttgggaaaattatttgttgttagtagacctgtgcggtgatctggaagatgcaagcaaggctttagggtctgctggctttttcctagagtgtcaggagcatggtcagatctccatgattcttggagaaagctatgttggaggagatccttgcaattcctcctgttattaacccttccccttacccccaagagtagcagtgttttgctactgcaagctactagttggcagaaaggttattgagtaagtaggtggcagtcttccttaaccctgtacatgggagagcattagtctttgcagctgaagagactaagcagtagagaagattcctctcattgtcttgatgagggactgacagcttgctagcgaaaatgttgcttgaccacaggaatgagacttccatgcaccctcatcttgccattattaaagctatccagcatttgggtccagccttaagagaaggtgagagtcatgactaggccagtgaatataacagtgcatataaaagggacctagttaccagggagaaaacagaagtagaccactgaaagaggcaaaacctagtgaaaatagaattattgaacaaaatattgaacaaatacacttgaacaaaataataagggcacataagcagattgaattataacaaattctttagagctagaaaaaaatgacattaagttttaatgtttagattatttaaaaaagaggacacgtgctattaagttccaaattacaggcctagaaaatcagggggaagaattatgtcattaaatggaatgaaagtactaacagataaaatcaagagaagacgattagagacttacaagaagttctgaaggggaaaataaaaaaccaggtggacaagcaataactaaataatagatgggatgaagaaagacttgagactgcagatcagaacagctggctgttgtctagccaggagagaagtgagggaaacacacaaacacctatgcagagtctggcaaaatccctgaattccaaggaaaaagtaaaaatcctctaagcttccatatgaaagaccaagttgcatacaaagaaaaagaaccaaaccgacaccaggcaatcttccttaccacacaagcagaagtagaaaaaagtggaatgacgctacacagttgacaaagaactgcaactcaggaaccttgtactcagccaaaggaccctccacatgtcagaatgaaaaggagatactagtttatcctatctgaggaaaactaaagaaacaa

SEQ ID NO: 359 - DNA, 3228 bp, Homo sapiens
gcaggcatctctcagacttaaacattgcttcataggatatttaaacacgccaattgaaaacaataataacaatgacaatttatgaaggttgcattcccaaatgtatttgagaaattctagtttaagaaaagtgaacatgtttctttatttcaagacttcccgatgtcttagaatagtcagacatcaaatttcatccacagtttccagagttgctatttctttcccatacctttgctttggaacttgatctaatggaattgttactgttactatgacatttttcatgtgtactatgtcctaaaaacactgtggttgcattcattttattttatttttgagagatgaatctagggcctcttgaactttttattcgtagttatgctgagtactagcttactttaaaaataagtctccagtacttgtgaggaagactcattgtcagagcatgaaagatttttctgccttttgttttgacttctaagatacgtttctttattaaggaatagttttatgctttgcagaagatgcattgtaccataaaaaccagtaaaatctgtgcattaaaaaaaatacctggatttaaaccagttacttggcattctgtgaaggtaaaggaatacatttttaccttaaatgatagtgtttatattttgttcacacagaaaaaaacaaaataaaaacaagcaactcttagtgattctgcatatagttatagtggttgtggacctttaaatattctccatcagttatgttttttaaaagcagaattttgtaaactttactaaattcaagctgctctcctgtctgcgatggctgaggacattggaagaatacttctgtacttttccatgacagccagtgtcacctcctggaagcaatcattcgtagattacttataaattttactcctagaatagcaatggtcactttagacaaatgaaatcatgcaaagagctggtatcaatttcccacctatacccactttcacccaagtcaggagggggcaatgtggaacttggtgtgggtccaagtcctaagtgaattattcctagtatagcccgttgaaatggcaaataaatggccacttagagaatgtttgagtgaaacaaattggtcgtctgttatttttaggctacttattcataaaatccaagctatattatctctggcctcatgatgctctaaataattttctgttgtagaacccatatgcttatggttatccaagagcttctaaaatctactttggtaagatgaggaaatattttatatagtatacaaaccctgtattttatatagcatacaaaccctgtagcctaaccgtcctgccatcttaattgtacagtttgctgctataattattaatagattgtaaattaggaacatctggccaattattagaaacacaaaaataaatcatgaaattgatatgagagcctaaagtgatgaccatcaaaaaggcaggcaggaatattttgtatttggtccttcacaggtaaataatttaatgcctgcctaatataatcagttacctttcttgtaaatttaattctttgatctccatttccttttgtagcagcaatttccaacataaatttcagcagcagaaaaagaatcaggaccctataatataaagcaactgtttttttgctttataatgtatttatgtggatcatcattctcatttctggtttctatatagtctaaaaggcaaggatagttcccctccccaagatatgggccattttatggattatataataaatgggctctaaaggtaaattgttattattcaaaaccagctggtcaggcaggcaaggcagcttagatacagtgaattctgttttgctctagtggaaaatgtcatgctgacaaggtcagtgctgggaactggtgtcatccagaagcaggcatgcagcacctggggaaggctgagaaggaggcccctgctctgtttgctgttggtcaaatgagtgccagaaatgcagggcttcagcagcacctagaagtccaggtttagcagtaggtttgggggctcacataatctgtactagtgattgttattgttaatcacataattactagtgtgttgttagagcatattgtgctttaaataggatttcccaagaaactaaaacgtcatggtgtttttcactgaccacagctgtcttgtggcaatctcttgagcagtcaacatctatggctggcgcaataagtcattaaatcaaaatacatcaattactggttttcaaagagagtcttgatttctgcataatgtgacttacataagggtaactgtattgttgctgagtgtgattgcacaaagaactcactgggcactgctttaacaaatgaaagcaggtcagagggaaatgtatcctttataaatggcttcatctattcattcaatttaggaaaccatttcttttaggctggtaatttaaggatagcactgctgaggactaggaatttgtttttacctgtactatttcatctgattataaaagtaatatatgccgaccaaaaaaaaaaattacacaaataaatgtcttacagagaatgcaatctgttgaaatcctacccctcagtaccactgtcaccagtttgctgcacatctttcagatattttccatgtaaaatacatacatatgcatttctgcaattcgcttttcccctgtagcatttaaggggatatgtattttagaaggacattttctgatatatctgaatattcctgatagaaattaacttttctatatatcagcttttaaaaattatgtgtgtgcctggaataggttaagatagagacattttcaatgcctgtttattgctgtaatattcaaaatccctgagagactgtggatagtttattagacagaattagaaagaataactgcagtactaagctttttgctacagagtgggcttccagtgcacaaagcattatgattatttggagacaatctgtagccttggaaacaatatggcgatagtgacatcagtagcaattatgtgtaatttttatccccagtttatcaccaaggtaaccagagcaggtctccctgcttgaaattttaagaatgtcgtagtcttatatacagcaaggatgtaggaaaggattatattcagaattctttctacagttcattctatttcccttataaaagagctctttagaattctaatagcacacatctatttttggcaacagccgcaagtttttgaagc

SEQ ID NO: 360 - DNA, 1127 bp, Homo sapiens
attgtgctttaaataggatttcccaagaaactaaaacgtcatggtgtttttcactgaccacagctgtcttgtggcaatctcttgagcagtcaacatctatggctggcgcaataagtcattaaatcaaaatacatcaattactggttttcaaagagagtcttgatttctgcataatgtgacttacataagggtaactgtattgttgctgagtgtgattgcacaaagaactcactgggcactgctttaacaaatgaaagcaggtcagagggaaatgtatcctttataaatggcttcatctattcattcaatttaggaaaccatttcttttaggctggtaatttaaggatagcactgctgaggactaggaatttgtttttacctgtactatttcatctgattataaaagtaatatatgccgaccaaaaaaaaaaattacacaaataaatgtcttacagagaatgcaatctgttgaaatcctacccctcagtaccactgtcaccagtttgctgcacatctttcagatattttccatgtaaaatacatacatatgcatttctgcaattcgcttttcccctgtagcatttaaggggatatgtattttagaaggacattttctgatatatctgaatattcctgatagaaattaacttttctatatatcagcttttaaaaattatgtgtgtgcctggaataggttaagatagagacattttcaatgcctgtttattgctgtaatattcaaaatccctgagagactgtggatagtttattagacagaattagaaagaataactgcagtactaagctttttgctacagagtgggcttccagtgcacaaagcattatgattatttggagacaatctgtagccttggaaacaatatggcgatagtgacatcagtagcaattatgtgtaatttttatccccagtttatcaccaaggtaaccagagcaggtctccctgcttgaaattttaagaatgtcgtagtcttatatacagcaaggatgtaggaaaggattatattcagaattctttctacagttcattctatttcccttataaaagagctctttagaattctaatagcacacatctatttttggcaacagccgcaagtttttgaagc

SEQ ID NO: 361 - DNA, 1427 bp, Homo sapiens
atcagactctttcctctgatggattagaagcaaattggatcctgctttctaggaatagatccagtttgaagaaaaggaggccttattttttaaaattctagtaaattcttaaaagtctattaagtataatttacatacagtaaaattcagtttgagaacactagatcccctccataatcaagaaaaagaacaaggagacacaggtccttcctccaaggagcttgcattctaatacagaaagtaagaataaaaagagattaaagatatgaaagcacctgaaacttttaaggggggtgtgtcagtttgactagtgatatcccaaaattcatgtccattcagaacctcagaatgtgactttagttggaaacaggatttttgcagatgtagttaattaaaaatgaggtcatactggatgaaggtgggtcctgaagccaatgactggtgtccttataaacatgccatgtgaaggcacaaagaagaactccaaaaagttcccttatgcccttcttgacatccacccccctcaccctcagcccctgataaccactaatgggttttctgtcctatagtcttacctcttccagagtcttgtccttatagtcttgacactgtaaatggagtcatacagcgtgaaacttttgagtctggcttttttcacttagcataatgcttctgagattcatctgcgtgttgcgttttttagtagttcatttattttcattgctgagcagaatttcagtgtatagatgtaccacaattttattcatttaccagctgaaggacaattggattgtttccagttcttggtgattatgaataaagctgctataaacatttagagcattttccttttgttttttttttttttttgagacggagtctcactctgtcgcctaggctggagtgcagtggtgcgatctcagctcactgcaaactccgcctcccaggttcatgccattctcctgcctcagactcccaagtagctgggactacaggcgcccgccaccacgcccagctaatttttttttttttgtatttttagtagagacggggtttcaccgtgttagctaggatggtctcgatctcctgacctcgtgatccgcctgcctcggcttcccaaagtgctaggattacaggcgtgagccaccgcgcccagccttagagcattttccttttgagtaaaatgtatagtaaagtaaataactttgcttcacaggaaaccagaactgtaggagcaggaatgatcctagaggtggaagttgttttctttttgattagctgacaggtatagttattttatacttttgcatagcaatttatagtctattcaaagcactttcacacaccttacttcctgtaattatcattatagtaaccctgagaagtaggctaggaatcttgcttcattttacagatagaagctagga

SEQ ID NO: 362 - DNA, 17747 bp, Homo sapiens
attatgacacccttctaatataacacctttcttcaggcaagttacaagatgctcttccttcccacctttcacacatattttaagctccatattaaatactacaacttatatgaagccttttcttactaccaactggaaatgtttttttgtttttttgtttttttgtttttgagacagagtctcactctgtgcccaggctggagtgcagtggtgtgatcttggctcagtgcaacctccgcctcccaggttcaagtgattcttctgcctcagcctcccgggtagttgggactacagatgtgcaccaccaggcccagctaatttttttgtatttttagtagagatgttatttcgtcatgttggtcaggccggtctcaaactcctgacctcaaatgatccacccgcctcggcctcccaaagtactggggccaccgtgagccaccaggcattagccaccatgcccggctagaaatgacctttataatctgaattgtgtacctgttttggagcacatgtcacattctgccatgtattaccatgtacctgtttttcccacctgtcccctagattttaaaccctttgaatgtaggagctgatcttacccttgtatttgctttgcatacaactgaccctcaggaagtaatcttgcaacttggcagttgttctcaaccttcatttcaaaagccaaaagccaactatttctacctttaaatcggctccacccttctaaatactgagaatctaaatcttacatcctttacttatatagttctaaaaagaaaaatgctcaagtttcaactttcatgtaagaaagcctgaactacttaatgttcagaaaatcagtaatttccaatgttgcagtgtggctaattgttaaggttcctaaccctagcctactgtacagttttgaagctagaaattgtgccttaatcctttcacaatgtgaggatatattaaaatatcctcaattagtgcttatttgaattagaaatgaatcaaaatgattttctgtcctgagaagagcaacttttaaatatcatataaagtgatacatgcttgcttaaaaaacaagtaaaaacttaaaacaatacaaaaggaatacagtgaaaactaccttcctcccacaagccttaccccaagtccctgttaacagtttcttatgccattaatatgcaaggaaataaatatgcacattcttacattcttttataatatacatttttttttattattatactttaagttctagggtacatgtgcacaacgtgcaggtttgttacatatgtatacatgtgccatgttggtttgctgcacccattaactcatcatttacattaggtatatctcctaatgctatccctcacccctccccccaccccacaacaggccccggtgtgtgatgttccccttcctgtgtcctggtgttctcattgttcaattcccacctatgagtgagaacatgcggtgtttggttttttgtccttgtgagggtttgctcagaatgatggtttccagcttcatccatgtccctacaaaggacaggaactcatcattttttatggctgcatagtattccatggtgtatatatgccacattttcttaatccagtctatcattgttggacatttgggttggtcccaagtctttactattgtgagtagtgccgcagtaaacatacgtgtgcatgtgtctttatagcagtatgatttatattcctttgggtatatacccagtaatgggatagctgggtcaaatggtatttctagttctagatccctgaggaatcgccacactgtcttccacaatggttgaactagtgtacagtcccaccaacagtgtaaaactgttcctatttctccacatcctctccagcacctgttgtttcctgactttttaatgattgccattctaactggtgtgagatggtatctcactgtggttttgatttgcatttctctgatggccagtgatgatgagcattttttcatatgtttgttggctgcataaatgtcttcttttgaaaagtgtctgttcatatactttgcacattttttgatggggttgtttgattttttcttgtaaatttgtttgagttctttgtcgattctggattttagccctttgtcagatgggtagactgcaaaaattttctcctattctgtaggttgcctgttcactctgatggtagtttcttttgctgtgcagaagctctttagtttaattagatcccatttgtcaattttggcttttgttgccattgcttttggtgttttagacatgaagtctttgcccatgcctctatcctgaatggtattgcctaggttttcttctagagtttttatggttttaggtctaacatttaagtttttaatccatcttgaattaatttttgtataatgtgtaacaaagggatccagtttcatctttctacatatggctagccagttttcccagcaccatttgttaaatagggaatccttttcccatttcttgtttttgtcaggtttgtcaaagatcaggtagtgtagatgtgtggtattatttctgaggcctctgttctgttccattggtctatatttctgttttggtaccagtaccatgctattttggttactgtagcctcgtagtatagtttgaagtcaggtagtgtgatgcctccagctttgttcttttggcttcagattgacttggcaatgtgggctcttttttggttccatatgaactttaaagtagttttttccaattctgtgaagaaagtcattggtagcttgatggggatggcattgcatctataaattacctagggcagtatggtcattttcacaatattgattcttcctatccatgagcatggaatgttcttccatttgtttgtgtcctcttttatttcgtagagcagtggtttgtagttctccttgaagagatccttcacatcccttttaagttgcattccgaggcattttattctctttgtaggaattgtgaatgggagttcactcatgatttgtctgtctgttattggtgtataagactgcttgtgatttttgcacgttgattttgtatcctgagactttgctgaggttgcttatcagcataaggagattttgggctgagacgatgggactttctagatatacaatcatgtcatctgcaaacagggacgatttgacttcctcttttcctaattgagtaccctttctttctttctcctgcctgattgccctggccagaacttccaacactatgttggataggagtggtgagagagggcatccttgtcttgtgccagctttcagagggaatgcttccagtttttgcccattcagtatgatattggctgtgggtttgtcataaatagctcttattattttgatatacatctcatcaatacctaatttattgagagtttttagcataaaaggctgttgaattttgtcaaaggccttttctgcatctattgagataatcatgtggtttttctctttggttctgtttatatgatggattaagtttattgattttcatatgttgaaccagccttgcatcccaggaatgaagcccacttgatcatggtggataagctttttgatgtgctgctggattcggtttgccagtattttattgaggatttttgcatcgatgttcatcagggatattggtctaaaattctcttgttttgttgtgtctctgccaggctttggtatcaggatgatgctggcctcataaaatgaattagggaggatttcgtctttttccattgattggaatagtttcagaaggaatggtaccagctcctccttgtacctctggtagaatttggctgtgaatccgtctggtcctggactttttttggttggtaagcagttaattattgcctcaatttcagagcctgttattggtctattcagagattcagcttcttcctggtttagtcttgggagggtatatgtgtggaggtatttatccatttcttctagattttctagtttatttgcatagaggtgtttatagtattctctgatggtagtttgtatttctgtgggatccgtggtgatatgccctttatcacatctatttgattcttctctcttttcttcattagtcttgctagcagtctatcaattttgttgatcttttcaaaaaaccagctcctggattcattgatttttcaaagggttttttgtgtctctatctccctcatttctgctctgatcttagttatttcttgctttctgctagcttttgaatgtgtttgctcttgcctcgctagttcttttaattgtgatgttagggtgtcaattttagatctttcctgctttctcttgtgggcatttagtgctataagtttccctctacacactgctttaaatgtgtcccagagattctggtatgttgtgtctttgttctcattggtttcaaagaacatctttatttctgccttcatttcgttatgtacccagtagtcattcaggagcaggttgttcagttcccacgtagttgagcggttttgagtgagtttcttaatcctgagttctagtttgattgcactgtggtctgagagacagtttgttataatttctgttcttttacctctgctgaggagtgctttacttccaactatgtggtcaattttggaataggtttggtgtggtgctgagaagaatgtatattctgttgatttggggtggaaagttctgtagatgtctattatgtctgcttggagcagagctaaattcatttcctggatatccttgttaactttctgtctcgttgatctgtttaatgttgaccgtggggtgttgaagtctcccattattattgtgtgggagtctaagtctctttgtaggtctctaaggacttgctttatgaatctgggtgctcctgtactgggtgcatatatatttaggatagttagctcttcttgttgaattgatccctttacgattatgtaatggccttctttatctcttttgatctttgttggtttaaagtctgttttatcagagactaggattgcaacccctgccttttgttttccatttgctcggtagatctgtctccatccctttattttgagcctatgtgtgtctctgcacgtgagatgggtttcctgaatacagcacactgatgggtcttgacttttcatccaatttgccagtctgtgtcaattggagcatttagcccatttacatttaaggttaatattgttatgtgtgaatttgatcctgtcattatgatgttagctggctattttgctcattagttgatgcagtttcttccgaggatagatggtctttacaatttggcaagtttttgcagtggctggtaccagttgttcctttccatgtttagtgcatccttcaggagctcttgtagggcaggcctggtggtgacagaatctctcagcatttgcttgtctgtaaaggattttatttctccttcacttatgaagcttagtttggctggatatgaaattctgggttgaaaattcatttctttaggaatgttgaatatgggcccccactctcttctggcttgtagagtttctgctgagagatccactgttagtctgatgggcttccctttgtgggtaacccgacctttctctctggctgcccttaacattttttccttcatttcaactttggtgtatctgacaattatgtgtcttggagttgctcttctccaggagtatctatctttgtggtgttctctgtatttcctgaatttgaatgttggcctgccttgctaggttggggaagttctcctgggtaatatcctgaagagggttttccagcttggttccattctccccatcacttcaggtacaccaatcagatgtagatttggtcttttcacatagtcccctatttcttggaggctttgttcgtttctttttattcttttttctctaaacttctcttctcacttcatttcattcatttgatcttccatcattgataccctttcttccagttgatagaatcggctactgaagcttgtgcattcatcacgtagttctcttgccatggttttcagctccatcaggtcctttaaggacttctctgcattggttattctagttagccattcatctaatcttttttcaaggtttttaacttctttgcgatgggttcgaacttcctcctttagctcggagaagtttggtcatctgaagccttcttctctcaattcgtcaaagtcattctccgtccagctttgttctgttgctggtgaggagctgtgttcctttggaagaggagaggcgctctgatttttagaattttctgtttttctgttctgttttttccccatctttgtggtttatctacctttggtctttgatgatggtgacctacagatggggttttggtgtggatgtcctttctgtttgttagttttccttctaacagtcaggaccttcagctgcaggtctgttggagtttgttggaggtccactccagaccctgtttgcctgggtatcaccagcggagggtgtagatcagcgaatattgctgaacagcaaatattgctgtctgatcgtttttctggaggtttcgtctcagaggggtacctcgccatgtgacatgtcagtctgcccctactggggggtgcctcccagttaggctactcgggggtcagggacccacttgaggcagtctgtctgttctcagatctcaaactctgtgctgggagaaccactactctcttcaaagctgtcagacagggacatttaagtcttcagaggtttctgctgccttttgtttggctatgacctgcctccagagatggagtctacagaggcaggcaggcctccttgagctgcattgggctccacccagttcgagcttcctggctgctttgtttacctactcaagcctcagcagtggcaggcgccccacccccagcctcactgctgccttgcagttcgatctcagactgctgtgctagcaatgagcgaggctccgtgggcatgggaccctctgagccaggcgcaggatataatctcctggtgtgctgtttgctaagaccgttggaaaagcacagtattagggtgggagtgacccgattttccaggtgccatctgtcacagctttgcttggctgtgaaagggaattccctgaccccttgtgcttcctggatgaggcaatgccttgccctgctttggctcacgctcagtgcgctgcacccaccgtccgacaagcccctgtgagatgaacccggtacctcagttggaaatgcagaaatcacccgtcttctgcatcgttcacgctgggagctgtagactggagctgtgcctattcggccatcttggaactgtcctcttatattcttataaatcaaactctgatattacaaaacctacagccactgaaggcatcaaagcccccctagaagttcactttaccaacaatggtccatacagcatcttttgtgaagctttagtataggattggatagtaggcttcaagtttggatatttttaccaaacaattttttttaaaagaatcttcccatagtctttcccaggaaccctataactctgatcaggtctgggttttcatgactcaagtgtcatgtttatgtaggcacacttacatcctatgaaaaccaaaagtctccatgagaacagtgagaaaagtcaaaatcagagtgagcccaaccgaagaacgttaaggacaggattcatccatacccacagtgttctgtctctgggacttgcttgtctgtttttaaacaaactctgttctgtgtaattggacctccgattaatacactgtctcagacaggctggccagtatgggcataaactgtcaaaagtttaggattggatgatttaaaatgatccagattcaatccccagaatcttgcatttctgctggacttctgctggactgccagccaccctgattacccctccaaatgatgcccacttcctggattagcagccagtatcacctgactcaccctctggtgaggctgtatctgaggctacagagtcttagatcttccctgttatttttcccccatcccaagcatctataaactggccagaagcttcatgagggtgattttagcagagggtaaaattatcataaaagtaccatcaccatctaaaaacaaatataccctgaatcctttttcttgtaataccttttttatatcagaactaagggtatactgaagactaatgttaaaagccacacaacgggctgggtgcggtggctcacacctgtaatcctaacactttgggaggccaaggcaggtggattgcctgagcttaggagttcaagaccagcctgggcaacatggtgaaactccatctctactaaaatacaaaaaattagctgggcatggtggcacatgcctataatcccagctactcacgaggctgagacaggagaatcacttgaaccttggaggcagacattgcagttagccaagattgtgccactgcactccagcctgcgcaacagagcgagactctatctaaaaacaaacaaacaaaacccacacaataatgaactagaatgtaattcctctaatgaactcagctataatattaatgatctgatttccattccaagacggccaaataggaacagctccattctacacctcccagcatgatcaacacagaagatgggtgatttctgcatttccagctgaggtacctgcttcatctcattgagactggtcagaaagtgggtgcagcccatggagggcgagctgaagcagggcggggcattgcctcacctgagaagcacaagggatcgggggatttccctttcctagccaagggaaaccgtgacagactgtaccaggaaaatcgggacactccacctaaacgtggcacttttctgaaggtcttagcatgcagcacaccaggagattatatcctgcacttggcgcagtgggtcccacccccatggatccttgctcattgctagtccgagatcaaattgcaaggcggcaagcctggctggtggaggggtgtccaccattgctgaggcttgagtaggtaaacaaagctgccaggaagctcgaactgagtggggcccaccgcagctcaacgaggcctgcctgcctctgtagactccacctctggaggcagggcatagctaaacaaaaggcacagaaatttctgcagatttaaacgtccctgtgtgacagctctgaagagagcagtggttctcccagcacagtgtttgagctctgagaacagatagcctgcctcctcaagtgggtccctgacccccgtgtagcctaactaggagacacctcccagtagaggccgactgacacctcatacagctgggtgcccctctgagacgaagcttcagaggaaggatcaggcagcaacatttgctgttctgcagcctccgctgcttatacccaggcaaacagggtctggagtggacctccaacaaactccaacagacctgcaactgagggacctgactgttagaaggaaaactaacaaacacaaaggagtagcatcaatatcaacaaaaaggacatccacaccaaaaccccatctgtaggtcaccatcatcaaagaccaaaggtagataaaaccacaaagatgggaagataccagagtagaaaagctgaaaattctaaaaaccagagtgccccttctcctccaaaggaacgcagctccttgccagcaacagaacaaagctggacggagaatgactttgacgagttgagagaagaaggcttcagatgaccaaacttctccgagctaaaggaggaagttcgaacccatcgcaaagaagttaaaaaccttgaaaaaagattagatgaatggctaactagaataaccaatgcagagaagtccttaaaggacctgatggagctgaaaaccatggcaagagaactacgtgatgaatgcacaagcttcagtagccgactctatcaactggaagaaagggtatcaatgatggaagatcaaatgaatgaaatgaagtgagaagagaagtttagagaaaaaagaataaaaagaaatgaacaaagcctccaagaaataggggactatgtgaaaagaccaaatctacatctgattggtgtacctgaaagtgatggggagaatggaaccaagctggaaaaccctcttcaggatattacccaggagaacttccccaacctagcaaggcaggccaacattcaaattcaggaaatacagagaacaccacaaagatagatactcctggagaagagcaactccaagacacataattgtcagatacaccaaagttgaaatgaaggaaaaaatgttaagggcagccagagagaaaggtcgggttacccacaaagggaagcccatcagactaacagtggatctctcagcagaaactctacaagccagaagagagtgggggccaatattcaacattcaatgtgcagagacacacacaggctcaaaataaagggatggaggaagatctaccaagcaaacggaaaacaaaaaaaggcaggggttgcaatgctactctctgataaaacagagtttaaaccaacaaagatcaaaagagacaaggaaaaccattacataacggtaaagagatgattccaacaagaagagctaactatcctaaatatatacaggagcacccagattcataaagcaagtctgagagacccacaaggagacttagactcccacacaataatagtgggagactttaacaccccactgtcaatattagatcaacgagacagaagattaacacggatatccaggacttgaactcagctctgcaccaagcagacctaatagacatctacagaactctccaccccaaatcaacagaatatacattcttttcagcaccacatcgcacttgttccaaaattgaccacatagttggaagtaaagcactcctcagcaaatgtaaaacaacagaaatcataacaaactgtctctcagaccacagtcaaattagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacatttaaagcagtgtgtagagggaaacttacttatagcactaaatgcccacaagagaaagcaggaaagatctaaaattgacaccctaacatcacaattaaaagaactagagaggcaagagcaaacacattcaaaagctagcggaagccaagaaataactaagatcagaggagaactgaaagagatagagacacaaaaaacccttcaaaaaaaccaacgaatccaggagctggttttttgaaaagatcaataagattgatagactgctagcaagactaataaagaagaaaagagagaagaatcaaatagacataataaaaaatgataaacggcatatcaccactgatcccacagaaatacaaactaccatcagagaatactataaacacctctatgcaaataaactagaaaatctagaagaaatggataaattcctcgacacttataccctccaaagacagctgaattgctgaatagaccaataacaggctctgaaattgaggcaataactaacagcctaccaaccaaaaaaagtccagggtcagacagattcacagccgaattctaccagaggtacaaggaggagctggtaccattccttttgaaactattccaatcaatagaaaaagagggaatcctccctaactcattttatgaggccagcatcatcctgataccaaagcctggcagagacacaacaaaacaagagaattttagaccaatatccctgacgaacatcgatgcagaaatcctcaataaaatactggcaaaccaaatccagcagcacatcaaaaagcttatccaccaaaatcaatttggattcatccctggatgcaaggctggttcaacatacgcaaatcaataaacttaatccatcatataaacagaaccaaagaagaaaaccacatgattatctcaacagatgcagaaaaggccttggatataattcaacagcgcttcatgctaaaaactctcaataaactaggtattcaaggaacatatctcaaaatagtaagagctatttatgataaacccacagccagtatcatactgaatgggcaaaaactggaagcattccctttgaaaactggcacaagacagggatgccctctctcaccactcctatccaacatagtgttggaagttctggccagggcaatcaggcaagagaaagaaagaaacggtattcagttaggaaaaaaggaagtcaaattgtccctgtttgcagatgattgtatatttagaaaaccccattgtctcagcccaaaatctccttaagctaataaggaacttcagcaaagtctcaggatacaaaatcaatgtgcaaaaatcacaggcattcttatacaccagtaacagacaaacagagagccaaatcatgagtgaactcccattcacaattcctacaaagagaataaaatacctcggaatgcaacttacaagggttgtgaaggacctcttcaaggagaactacaaaccactgatcaacgaaataaaagaggacacaaacaaatggaagaacattccatgctcatggataggaagaatcaatattgtgaaaatggccatactgccctaggtaatttatagatgcaatgccatccccatcaagctaccaatgactttcttcacagaattggaaaaaaactactttaaagttcatatggaaacaaaaaagagcccacattgccaagacaatcctaagccaaaaaaacaaagctggaagaatcacgctaccggacttcaaacaatactacaaggctacagtaaccaaaacagcatggtactggtaccaaaacagagatatagaccaatggaacagaacagaggcctcagaaataacaccacacatctacaaccatctgatctttgataaacctaacaaaaaacaagcaatggggaaaggattccctatttaataaatggtgctgggaaaactggctagccatatgtagaaagcggaaactggatcccttccttacaccttatacaaaaattaattcaagatggattaaagacttacatgttagacctaaaaccataaaaactgtagaagaaaacctaggcaataccattcaggacataggcatgggcaaggacttcatgactaaaacagcaaaagcaatggcaacaaaagccaaaattgacaaatgggatctaattaaactaaagagcttctgcacagcaaaagaaactaccatcagagtgaacaggcaacctacagaatgggaggaaatttttgcaatctacccatctgacaaagggctgaaatccagaatctacaaagaactcaaacaaatttacaagaaaaaatcaaccccatcaaaaagtgggcaaaggatatgaacagacacttttcaaaagaagacatttatgcagccaacagacacatgaaaaaatgctgatcatcactggtcatcagtgaaatgcaaatcaaaaccacaatgagataccatctcacaccagttagaatggcgataattaaaaaggaaacaacaggtgctggagaggatgtggagaaataggaacacttttacactgttggtgggagtgcaaactagttcaaccattgtggaagacagtgtggcgattcctcaaggatccagaactagaaataccatttgacccagggatcccattactgggtatataccaaaaggattataaatcatgctactataaagacacatgcacatgtatgtttattgtggcattattcacagtatcaaagacttgcaaccaatccaaatgtccaacaatgatagactggattaagaaaatgtggcacatatacaccatggaatactatgcagccataaaaaatgatgggttcatgtcctttgtagtgacatggatgaagctggaaaccatcattctgagcaaactatctcaaggacagaaaaccaaacactgcgtgttctcactcataggtgggaattgaacagtgagtacactcggacacagtaagaggaacatcacacaccaggggcctgtcgtggggtggggggagcgggggagggatagcattaggagatatacctaatgtaaatgacaagttaatgggtgcagcaaaccaacacaacacatgtatacatatgtaacaaacctgcacattgtgtacatgtaccctagaacttaaagtataataaaatatatgtatatattaacgatcctcacagtgagattggaagctttgtaatatctcttaaagatcacattatagggcatctctgttctttaagtctaatctgtgatcaaaagaaataaaatattgtattttaaacatgttttctttcttacatatttatagataaggggaaggaggaggagatatccaaaggtctaaaaaagagaaagagaaaatgaatttaatcaataatgtaaaccaagttcgtaaccacatgtatgtaatatgcaacacccctgactgacatttccttgtacaaattaccttagaaagtgaacccaggcttgttttagaattatttaagttgtgtcaaaaatcacaacttagatgatcagcttgaacacaggttttctaagcaaagctgtctgtttttttctttttagtcacagatcgtattatatagtgtgtggaatatgattaatgcattattggatatgagctgtgccccatactttagatctgacatattccagttaccttattatgaagcatgtgtgttacgatctctcgccactatcaaagtataagagtttgttggccatacacttggtcttgggctggtcccaacccaggtgccaataactggttcatcatggccagaaacaggcctagaaatgtgactgcctggccctactctcaaaaacagagcactttgaagataacctaacttccaaggaaggagccacgctggaaataacataactgtttgtgttatgttattgaaaagaaaagatctccatgaatttctttttttttttttttaagccaactttgacagcctctttccttccagatggtgcctggagccaagcctgtcagagaaccttagtctcctgctgccttttaatgctggtccttgattgctaatgacccctggctggactggcttctcaacccatttaacccctctctgctgggtccccatctcatgcaggatgagcggccacgagagctggaagtgggaaggtgccaagtcagccagagcctcccacccttccagagctggtggcgcgtttcccggtgccatcatggatgtccaagatcattccagtgaagagctcatgttaatatgattttctctatattgtcagataaatgctgccaggtttctgattgttaatattttatttgactaaaccaagacaaccaagtccctgaaagaatgtttccttcaggggtcaagagctgaggaccactgatatgagcctcctggaatatgttcatttggaaacttaaaattacattgcactggaactatcttttagtttggtcgaacttcatggacaaagcatttgcttttgtgcgtgtgtgtgtgtgtgtgtgtgtgtgtgtgtgtaggcaataatttccttgtcaaggctgaaatatcacttgtataacacaggagatacccatttctcagctttgttagcaacaactgtaaccatttactttttggttaagcttggtttgttttttatgacatataggaaggtgcttatagctatactgatcaggtaggtcactcagagtgtagggtttttttttttttttttttagatggagtatcactctgccgtccaggctggagtgcagtggcctgatcttggctcactgcaacctctgcctcccgggttcaagcgattctcctgcctcaccctcccgagtagctgggattacaggcatacgccaccaggcccggctaattttttgtatttttagtagagacagggttttgctatgttggacaggctggtcttaaactcctggcctcaagtgatccacccccctcagcctcccaaagtgctgggattacaggtgtgagccaccacgccccacctgagtatagggatatttaaaaggggtgggggcaggaagctgctgatgctaatttgttgagaaatcttgagtccagtggagaaattcagatctcttgcaacctcctcaggtcagggagggcatgagaagtcatcattttatgcattatttccgtaacggatttttactaatctcatattggattgtaaaacaaggcaaagaaatttggtagttctctgtgaccctgaagaactgaaatttaaattcttgattagagcagagaactgaaagctttgtgctgccctacttgtacaaacgtcttaatgtttactggatagttggaccaaattgattttataatgtaatgtacttaagaaatttgttccaaaattcggcacaaattaggaaaataaccaaaccatacctttctatttaatctttgcttctctcagatacttactattttcttggcttttttgaagattaagactgaaagatcacaactgcatttctcaccactaacacttcattgatttcatttttacatcttattaattaaatgcaagaaaaaaattatatttgtgattttattttggtctactactgacattcttttctatttccactcaatctctctctccctctctctctctctctctcacacacacacacacctgccagacatttgtagatataacctcccccaaatcatgtcattcatactaatgactgccctctctatgtgtaaaaatattttataatttatggacctgggtggggatttgtacagctgtgcaatattaatctatacactgcaggttttgctaacagctgggcaaaggctgaggtgaggttttaatgatgtcctttagcccatcagtaaccaaatgacccagaaagtggttcaggggaacctaccttgtgcagctgtgctctttgaatgaatgaatcatgttagaatgaaattctggtgtatttatggagaactttttcctttgaagcctaaacacattttgattggtcgtatttaaattccaacaagctgaaaagcaaaagcatttatgtcagtttcacagatgaggctccaagaggttaactggcgattactctggagttacagcatcttaaagttggaagggactttaaagggcctctgggctaatggttcttacccttttcctgccttcacactggcttcaggcaacagatccccatcaggcatgtctctcactgcacacagatgttcacacactgggaaagaatgtgactccaaggagagcagctcagaatcttcaggccagaacatgtgtaatttgccacaccaatgttctccattaaaaattactacctcagtccacccctctctttatcattttacacataaaacatggcagcagaggggtaagggattcacttaaggtcacataccaatatgtgtcacaacttgaactatgtgtgccggggtcttctgatcccccatgtccagtgctggttttgctacagctgaccagccccttgcacactcacagtagaactggaactagctcctcaaagagtgaggcagagctggagacgagtgccccagggtcccctgctgcagggaatcaaagaccccgtcacaattagcttagtaaaaccaacactatctggtgtcc

SEQ ID NO: 363 - DNA, 11748 bp, Homo sapiens
aactgtcctcttatattcttataaatcaaactctgatattacaaaacctacagccactgaaggcatcaaagcccccctagaagttcactttaccaacaatggtccatacagcatcttttgtgaagctttagtataggattggatagtaggcttcaagtttggatatttttaccaaacaattttttttaaaagaatcttcccatagtctttcccaggaaccctataactctgatcaggtctgggttttcatgactcaagtgtcatgtttatgtaggcacacttacatcctatgaaaaccaaaagtctccatgagaacagtgagaaaagtcaaaatcagagtgagcccaaccgaagaacgttaaggacaggattcatccatacccacagtgttctgtctctgggacttgcttgtctgtttttaaacaaactctgttctgtgtaattggacctccgattaatacactgtctcagacaggctggccagtatgggcataaactgtcaaaagtttaggattggatgatttaaaatgatccagattcaatccccagaatcttgcatttctgctggacttctgctggactgccagccaccctgattacccctccaaatgatgcccacttcctggattagcagccagtatcacctgactcaccctctggtgaggctgtatctgaggctacagagtcttagatcttccctgttatttttcccccatcccaagcatctataaactggccagaagcttcatgagggtgattttagcagagggtaaaattatcataaaagtaccatcaccatctaaaaacaaatataccctgaatcctttttcttgtaataccttttttatatcagaactaagggtatactgaagactaatgttaaaagccacacaacgggctgggtgcggtggctcacacctgtaatcctaacactttgggaggccaaggcaggtggattgcctgagcttaggagttcaagaccagcctgggcaacatggtgaaactccatctctactaaaatacaaaaaattagctgggcatggtggcacatgcctataatcccagctactcacgaggctgagacaggagaatcacttgaaccttggaggcagacattgcagttagccaagattgtgccactgcactccagcctgcgcaacagagcgagactctatctaaaaacaaacaaacaaaacccacacaataatgaactagaatgtaattcctctaatgaactcagctataatattaatgatctgatttccattccaagacggccaaataggaacagctccattctacacctcccagcatgatcaacacagaagatgggtgatttctgcatttccagctgaggtacctgcttcatctcattgagactggtcagaaagtgggtgcagcccatggagggcgagctgaagcagggcggggcattgcctcacctgagaagcacaagggatcgggggatttccctttcctagccaagggaaaccgtgacagactgtaccaggaaaatcgggacactccacctaaacgtggcacttttctgaaggtcttagcatgcagcacaccaggagattatatcctgcacttggcgcagtgggtcccacccccatggatccttgctcattgctagtccgagatcaaattgcaaggcggcaagcctggctggtggaggggtgtccaccattgctgaggcttgagtaggtaaacaaagctgccaggaagctcgaactgagtggggcccaccgcagctcaacgaggcctgcctgcctctgtagactccacctctggaggcagggcatagctaaacaaaaggcacagaaatttctgcagatttaaacgtccctgtgtgacagctctgaagagagcagtggttctcccagcacagtgtttgagctctgagaacagatagcctgcctcctcaagtgggtccctgacccccgtgtagcctaactaggagacacctcccagtagaggccgactgacacctcatacagctgggtgcccctctgagacgaagcttcagaggaaggatcaggcagcaacatttgctgttctgcagcctccgctgcttatacccaggcaaacagggtctggagtggacctccaacaaactccaacagacctgcaactgagggacctgactgttagaaggaaaactaacaaacacaaaggagtagcatcaatatcaacaaaaaggacatccacaccaaaaccccatctgtaggtcaccatcatcaaagaccaaaggtagataaaaccacaaagatgggaagataccagagtagaaaagctgaaaattctaaaaaccagagtgccccttctcctccaaaggaacgcagctccttgccagcaacagaacaaagctggacggagaatgactttgacgagttgagagaagaaggcttcagatgaccaaacttctccgagctaaaggaggaagttcgaacccatcgcaaagaagttaaaaaccttgaaaaaagattagatgaatggctaactagaataaccaatgcagagaagtccttaaaggacctgatggagctgaaaaccatggcaagagaactacgtgatgaatgcacaagcttcagtagccgactctatcaactggaagaaagggtatcaatgatggaagatcaaatgaatgaaatgaagtgagaagagaagtttagagaaaaaagaataaaaagaaatgaacaaagcctccaagaaataggggactatgtgaaaagaccaaatctacatctgattggtgtacctgaaagtgatggggagaatggaaccaagctggaaaaccctcttcaggatattacccaggagaacttccccaacctagcaaggcaggccaacattcaaattcaggaaatacagagaacaccacaaagatagatactcctggagaagagcaactccaagacacataattgtcagatacaccaaagttgaaatgaaggaaaaaatgttaagggcagccagagagaaaggtcgggttacccacaaagggaagcccatcagactaacagtggatctctcagcagaaactctacaagccagaagagagtgggggccaatattcaacattcaatgtgcagagacacacacaggctcaaaataaagggatggaggaagatctaccaagcaaacggaaaacaaaaaaaggcaggggttgcaatgctactctctgataaaacagagtttaaaccaacaaagatcaaaagagacaaggaaaaccattacataacggtaaagagatgattccaacaagaagagctaactatcctaaatatatacaggagcacccagattcataaagcaagtctgagagacccacaaggagacttagactcccacacaataatagtgggagactttaacaccccactgtcaatattagatcaacgagacagaagattaacacggatatccaggacttgaactcagctctgcaccaagcagacctaatagacatctacagaactctccaccccaaatcaacagaatatacattcttttcagcaccacatcgcacttgttccaaaattgaccacatagttggaagtaaagcactcctcagcaaatgtaaaacaacagaaatcataacaaactgtctctcagaccacagtcaaattagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacatttaaagcagtgtgtagagggaaacttacttatagcactaaatgcccacaagagaaagcaggaaagatctaaaattgacaccctaacatcacaattaaaagaactagagaggcaagagcaaacacattcaaaagctagcggaagccaagaaataactaagatcagaggagaactgaaagagatagagacacaaaaaacccttcaaaaaaaccaacgaatccaggagctggttttttgaaaagatcaataagattgatagactgctagcaagactaataaagaagaaaagagagaagaatcaaatagacataataaaaaatgataaacggcatatcaccactgatcccacagaaatacaaactaccatcagagaatactataaacacctctatgcaaataaactagaaaatctagaagaaatggataaattcctcgacacttataccctccaaagacagctgaattgctgaatagaccaataacaggctctgaaattgaggcaataactaacagcctaccaaccaaaaaaagtccagggtcagacagattcacagccgaattctaccagaggtacaaggaggagctggtaccattccttttgaaactattccaatcaatagaaaaagagggaatcctccctaactcattttatgaggccagcatcatcctgataccaaagcctggcagagacacaacaaaacaagagaattttagaccaatatccctgacgaacatcgatgcagaaatcctcaataaaatactggcaaaccaaatccagcagcacatcaaaaagcttatccaccaaaatcaatttggattcatccctggatgcaaggctggttcaacatacgcaaatcaataaacttaatccatcatataaacagaaccaaagaagaaaaccacatgattatctcaacagatgcagaaaaggccttggatataattcaacagcgcttcatgctaaaaactctcaataaactaggtattcaaggaacatatctcaaaatagtaagagctatttatgataaacccacagccagtatcatactgaatgggcaaaaactggaagcattccctttgaaaactggcacaagacagggatgccctctctcaccactcctatccaacatagtgttggaagttctggccagggcaatcaggcaagagaaagaaagaaacggtattcagttaggaaaaaaggaagtcaaattgtccctgtttgcagatgattgtatatttagaaaaccccattgtctcagcccaaaatctccttaagctaataaggaacttcagcaaagtctcaggatacaaaatcaatgtgcaaaaatcacaggcattcttatacaccagtaacagacaaacagagagccaaatcatgagtgaactcccattcacaattcctacaaagagaataaaatacctcggaatgcaacttacaagggttgtgaaggacctcttcaaggagaactacaaaccactgatcaacgaaataaaagaggacacaaacaaatggaagaacattccatgctcatggataggaagaatcaatattgtgaaaatggccatactgccctaggtaatttatagatgcaatgccatccccatcaagctaccaatgactttcttcacagaattggaaaaaaactactttaaagttcatatggaaacaaaaaagagcccacattgccaagacaatcctaagccaaaaaaacaaagctggaagaatcacgctaccggacttcaaacaatactacaaggctacagtaaccaaaacagcatggtactggtaccaaaacagagatatagaccaatggaacagaacagaggcctcagaaataacaccacacatctacaaccatctgatctttgataaacctaacaaaaaacaagcaatggggaaaggattccctatttaataaatggtgctgggaaaactggctagccatatgtagaaagcggaaactggatcccttccttacaccttatacaaaaattaattcaagatggattaaagacttacatgttagacctaaaaccataaaaactgtagaagaaaacctaggcaataccattcaggacataggcatgggcaaggacttcatgactaaaacagcaaaagcaatggcaacaaaagccaaaattgacaaatgggatctaattaaactaaagagcttctgcacagcaaaagaaactaccatcagagtgaacaggcaacctacagaatgggaggaaatttttgcaatctacccatctgacaaagggctgaaatccagaatctacaaagaactcaaacaaatttacaagaaaaaatcaaccccatcaaaaagtgggcaaaggatatgaacagacacttttcaaaagaagacatttatgcagccaacagacacatgaaaaaatgctgatcatcactggtcatcagtgaaatgcaaatcaaaaccacaatgagataccatctcacaccagttagaatggcgataattaaaaaggaaacaacaggtgctggagaggatgtggagaaataggaacacttttacactgttggtgggagtgcaaactagttcaaccattgtggaagacagtgtggcgattcctcaaggatccagaactagaaataccatttgacccagggatcccattactgggtatataccaaaaggattataaatcatgctactataaagacacatgcacatgtatgtttattgtggcattattcacagtatcaaagacttgcaaccaatccaaatgtccaacaatgatagactggattaagaaaatgtggcacatatacaccatggaatactatgcagccataaaaaatgatgggttcatgtcctttgtagtgacatggatgaagctggaaaccatcattctgagcaaactatctcaaggacagaaaaccaaacactgcgtgttctcactcataggtgggaattgaacagtgagtacactcggacacagtaagaggaacatcacacaccaggggcctgtcgtggggtggggggagcgggggagggatagcattaggagatatacctaatgtaaatgacaagttaatgggtgcagcaaaccaacacaacacatgtatacatatgtaacaaacctgcacattgtgtacatgtaccctagaacttaaagtataataaaatatatgtatatattaacgatcctcacagtgagattggaagctttgtaatatctcttaaagatcacattatagggcatctctgttctttaagtctaatctgtgatcaaaagaaataaaatattgtattttaaacatgttttctttcttacatatttatagataaggggaaggaggaggagatatccaaaggtctaaaaaagagaaagagaaaatgaatttaatcaataatgtaaaccaagttcgtaaccacatgtatgtaatatgcaacacccctgactgacatttccttgtacaaattaccttagaaagtgaacccaggcttgttttagaattatttaagttgtgtcaaaaatcacaacttagatgatcagcttgaacacaggttttctaagcaaagctgtctgtttttttctttttagtcacagatcgtattatatagtgtgtggaatatgattaatgcattattggatatgagctgtgccccatactttagatctgacatattccagttaccttattatgaagcatgtgtgttacgatctctcgccactatcaaagtataagagtttgttggccatacacttggtcttgggctggtcccaacccaggtgccaataactggttcatcatggccagaaacaggcctagaaatgtgactgcctggccctactctcaaaaacagagcactttgaagataacctaacttccaaggaaggagccacgctggaaataacataactgtttgtgttatgttattgaaaagaaaagatctccatgaatttctttttttttttttttaagccaactttgacagcctctttccttccagatggtgcctggagccaagcctgtcagagaaccttagtctcctgctgccttttaatgctggtccttgattgctaatgacccctggctggactggcttctcaacccatttaacccctctctgctgggtccccatctcatgcaggatgagcggccacgagagctggaagtgggaaggtgccaagtcagccagagcctcccacccttccagagctggtggcgcgtttcccggtgccatcatggatgtccaagatcattccagtgaagagctcatgttaatatgattttctctatattgtcagataaatgctgccaggtttctgattgttaatattttatttgactaaaccaagacaaccaagtccctgaaagaatgtttccttcaggggtcaagagctgaggaccactgatatgagcctcctggaatatgttcatttggaaacttaaaattacattgcactggaactatcttttagtttggtcgaacttcatggacaaagcatttgcttttgtgcgtgtgtgtgtgtgtgtgtgtgtgtgtgtgtgtaggcaataatttccttgtcaaggctgaaatatcacttgtataacacaggagatacccatttctcagctttgttagcaacaactgtaaccatttactttttggttaagcttggtttgttttttatgacatataggaaggtgcttatagctatactgatcaggtaggtcactcagagtgtagggtttttttttttttttttttagatggagtatcactctgccgtccaggctggagtgcagtggcctgatcttggctcactgcaacctctgcctcccgggttcaagcgattctcctgcctcaccctcccgagtagctgggattacaggcatacgccaccaggcccggctaattttttgtatttttagtagagacagggttttgctatgttggacaggctggtcttaaactcctggcctcaagtgatccacccccctcagcctcccaaagtgctgggattacaggtgtgagccaccacgccccacctgagtatagggatatttaaaaggggtgggggcaggaagctgctgatgctaatttgttgagaaatcttgagtccagtggagaaattcagatctcttgcaacctcctcaggtcagggagggcatgagaagtcatcattttatgcattatttccgtaacggatttttactaatctcatattggattgtaaaacaaggcaaagaaatttggtagttctctgtgaccctgaagaactgaaatttaaattcttgattagagcagagaactgaaagctttgtgctgccctacttgtacaaacgtcttaatgtttactggatagttggaccaaattgattttataatgtaatgtacttaagaaatttgttccaaaattcggcacaaattaggaaaataaccaaaccatacctttctatttaatctttgcttctctcagatacttactattttcttggcttttttgaagattaagactgaaagatcacaactgcatttctcaccactaacacttcattgatttcatttttacatcttattaattaaatgcaagaaaaaaattatatttgtgattttattttggtctactactgacattcttttctatttccactcaatctctctctccctctctctctctctctctcacacacacacacacctgccagacatttgtagatataacctcccccaaatcatgtcattcatactaatgactgccctctctatgtgtaaaaatattttataatttatggacctgggtggggatttgtacagctgtgcaatattaatctatacactgcaggttttgctaacagctgggcaaaggctgaggtgaggttttaatgatgtcctttagcccatcagtaaccaaatgacccagaaagtggttcaggggaacctaccttgtgcagctgtgctctttgaatgaatgaatcatgttagaatgaaattctggtgtatttatggagaactttttcctttgaagcctaaacacattttgattggtcgtatttaaattccaacaagctgaaaagcaaaagcatttatgtcagtttcacagatgaggctccaagaggttaactggcgattactctggagttacagcatcttaaagttggaagggactttaaagggcctctgggctaatggttcttacccttttcctgccttcacactggcttcaggcaacagatccccatcaggcatgtctctcactgcacacagatgttcacacactgggaaagaatgtgactccaaggagagcagctcagaatcttcaggccagaacatgtgtaatttgccacaccaatgttctccattaaaaattactacctcagtccacccctctctttatcattttacacataaaacatggcagcagaggggtaagggattcacttaaggtcacataccaatatgtgtcacaacttgaactatgtgtgccggggtcttctgatcccccatgtccagtgctggttttgctacagctgaccagccccttgcacactcacagtagaactggaactagctcctcaaagagtgaggcagagctggagacgagtgccccagggtcccctgctgcagggaatcaaagaccccgtcacaattagcttagtaaaaccaacactatctggtgtcccatatccgcaagcacttaaaatgtcgttccaatcttcaaagaaattctttcattccatttttatctgcttttacccaggacattgtttcccagctccccagtagttcactaggtgatttgcatctcattagaagctccagaagtgacatctcccagactgctgcctggcattgtgggtccctaagcatcagatctaggtcttggattttccaagttgacacttttttaaaagctgagttaatgctgttttcccactgggtgcagtttgggtggccattttcgccataattcctgctcccgtgctggatcaaggttagggaactgccattgtcaaagatgaagtcagtcatctccacgtgaaagtacgtggtggatgagaatattctggggcctcagaataaaggagtttaaagactcctaaaaatagaaagatgctacatgatgcagatattctgaacactacacaaagcaaaacaaaaagacagcaagacaatagcaaaccattgctgaagctgtataattgattctaaacgtttgccttttaaacattttcccctggatccaatcctcctgagaccgcagagtttttgccctacatttatattttgctttaaagatagtctccctaggtcagaatgcctttttggctttgtcatttcttcatactacaacctccagaagagcactgaacagcactgtacctctggaaaccagagatagtatttccatggtcagcaaaattgttctcttggaataagagaaatgattttcccagtgtccagggaaataaggagcccttatgtctactttgggctcaagccatttgatgcagcttccagcacaaagcaagtgcctgatggtgcctagagcttccgccatccagaattccttttgtccagtgaatacttccctgagcttatgccaccttttcaaaatggcagatagctaatctgcagaattgatctaagctcttaggaaagggttaagtccatggtttttccaacactggctacaaattaaaatcactgggaaggaggaggaactttgttttaaacaagtaacaatgccagaaccctacccctgaccaattaaattaggatctccaggggtgaggtcatgatatctgtatttttaaaaagcccttcagatgattctaatatgcatccagggtggagaaccactccagtataacaagaaatacaacagccccttcgcagcacctgctaatgcctctggcaccatgttttatcttttcatatattatctgtcattctcactacaaccctacaaggaagggtcatcattcccaagtga

SEQ ID NO: 364 - DNA, 38115 bp, Homo sapiens
gaggacttcaagcaagagagggacagatttgccttctgtgtagagaccgccctctggtggccacatggaggatggcaggagagaatggcgccgaaagaaaagcggcaggctgagctcataaagctgcgaatgctgttccttcttcctctttttcaaaagacggattttgggccgggcttggtggctcacgcctgtaaccccagcactttgggaggccgaggcgagcggatcacgaggtcaggagatcgagaccatcctggcaaacacggtgaaaccccatctctactaaaaaaaaaatacaaaaaattagccaggagtggtggcagacgcctgtagtcccagctactcgggaggctgagccaggagaatggcgtgaacccgggaggcggagcttgcagtcagcggagatcgcgccactgcactccagcctgggcgacagagcgagactccatctcaaaaaacataaataaataaataaaataaaataaaataaaagacgggttttgctctgttgcccaggctggtgctgtggtgcaatcttggctcagcctgtaactcctggcctcaagcgatcctcccaccttggcttctcaaactctgggatgacagatgcatactaccataccccgcccatccccagtgtctggaaaatgtgcccactggagaaatctattggccggattgtgactggttggatgctcccacggcaggaaagggggaaggacaagtggccacgtcgaggcctgcctgaactccaagggtatccaggccgaggttgctcaaacccagagctgatttatttttatttttatttgtttttattttttgacacagtcttactctgtcgcccaggctggagtgcagcggtgcaatctcggctcactgcaacctccgcctccgggttcaagcgattctcctgcctcaatctctggagtagttgggattacagacacctgccactacgcccagctaatttttgtatttttggtagagacggggttcactatgttggccaggctggtcttgaactcctggtcttaggtgatcctcctgcctcggcctcctaaagtgctgggcttacaggcatgagccaccatgcctggcctgaacgaaacatttctatgctccaacttaaaatgaatgtagaacttattatctgagaatgacccagggaagtcatgggactgcccatattttcatgcaataaagggaaaattcttcccacaaataaattttataggacggtagaagcaaatatagggcattccaattacatttcaatgagttattcttgatgaagtcctggatacacaaagccagccagcaaataggattgaccaaagtcagaggatgctgtgaccaccccagggctctttttgtttgtctgtttgagacgggtctcgcttcgttacccaggctggagtgccgtggcacgatctcggctcactgcacccttgacctcctaggcttaagagagtctcccacctctacctcccaagtagctgggatgacaatcataagccaccacacctggctaatttctagaattttttttttcatttttttcatttttttttctttttagccggagtttcactcttgttgcccaggctggagtgcaatggtgcgatcttggctcaacacaacctccgcctcccgtgttcaagcaattctcctgcctcagcctcctgagtagctgggtctacaggagagcaccaccacgcccagctaatttttgtatttttagtagagacggggtttcaccatgttggccatgatggtcttgatctcttgacctcgtgatccacctgcctcagcctcccaaagtgctgggattataggtgtgagccacagcagccggccataggacataagcttttttttttttttttttttttgagacggagtctggctctgtctcccatgttggagtgcagtggcacaatctcggttcactgcaagctccgcctcacgggttcacgccattctcctgcctcaacctctcagtagctgggactacaggcgcccgccaccatgcctggttaagtttttgtatttttagtagagacggggtttcaccttgttagccaggatggtctcgatctcctgacctcgtgatccgcccgcctcagcctcccaaagtgctgggattacaggcgtgagccaccgcgcccagcctcagctgtgttcttaactctatttttccttcactggggatggtaccatttccccgtcctgttaagtgcccttgactgctcttacctttagctcttggaattccgccatctaccctaacttcacctccatctaaatcctgctcactcttcaaagcctgcctctccacgcatcctccctcctaactccatcccaatgcccaacagctctttgctaagcagatgcctttatttacagacaaagaagtaaacaggcaaaaggaagaggcttgtccaaggtcatgccacagactgaactctcactgggaggacagttcagggtcctgatacccaatctaaggcagcagctttgtagcacatcaggatgggggcaggtcatgcctggccatgttcacttccagaacgattatagctttaacaacatttttttttttttgagatggaatctcgctctgttgcccagactggagtgcagtggtgtgatctcggctcactgcaacctctgcctcctgggttcaagcgattctcctgcctcagcctccggagtagctgggattataggcatgagccaccatgcccggctaatttttgtagttttagtagagagggggttttgccattttggccaggctggtcttgaactcctgacctcagttgatccacctgcctcggcttcccaaagtgttgggattatgggcatgagccaccacgcccagcctactacagctttaacagtcttttttttttttttttttttttttttgagattgagtctcgctgtgttgcccaggctggagtactgtggtgtgatctcagctcactgcaacctccgcctcctgggtttaagcaagtctcctgcctcagcctcccaaatagctgggattacaggcacatgccaccatgcccggctaattaacaacattattttttaatttttgtagaaatgaagtctcactgtgttgcccaggctggtcttcaactcctgggctcaaacgatcctcccaccttggcctcccaaagtgctgggattacaggcatgaggcactgcgctgggcccagaactaccttttattggaggcatggagtccacagtgggtggaggtctcagtgccttgggctcaggggctcagcgaaaggccgcggccaggcctagatgaaggtgaggcaggtggaagcggggaccccacagctttccttgtgctcctcgaagagctgctccagggccgtcatgtagagggcgtgatagtgattgacttcctcctcggtggggtggaggcgctgggggacggggatggggcggcccactgcagggagagggagacaggtgggcgagggatccctgatgcccacgcagctgctggtggccgtccccccggaggtgggcactcacccacagtggtgatgggcacagcaaagggcagcaggccccaggaggtggctgagaagagaccgcgaccccagaagatgcaaggagagaagcccatgagcttcttgaaggtgagctggcaccaatgctgccaggagcctgtggcaaaagccttaagtctaaagatgtcattctccccaaaggagtacacgggcaccagggacgccctgggaaggagcaagagagaagagggggctcaggctgctggactgctccgagatgggcacccccaggggctacaagtccttcccactacgtccagatgctacctcccagggtcattcaaagcacatgactatggctacaaagaaagatctagaagacaggactcgcatttctttctctttctttttctttgttttagagagagggtcttgtaaccacacctgtaatcccagcattttgggaggccacggtgggaggatcatttgaggtcaggagttggagaccagcctggccaacatggtgaaacccccgtctctgcaaaaacataaaaattagccaggtgtggaagtgggtacctgtaattccagctactacagaggctgaggcacaagaatcgcttgaacctgggaggcagaggttgcagtgagctaagatcacaccactgcacttcagtctgggtgacagagtgagactttgtctcaaaaaataaataggctgggtgcggtggctcatgcctgtaatcccaataccttggaaggctgaggtgggtggatcacctgaggtcaggagttcgagaccaccctgaccaatatggtgaaaccccatctctactaaaaatacaaaaattagccagacgtggtgacgtgcacctgtagtcccaggtacttcagaggcttgaactcgggaggtggaggttgcagcgagccgagatcacaccactgcactccagcctgggtgacagagcaagactccatctccaaaaattaaaaattagaaaattttaaaaaataaataatttaaaaaattttaaaagagacaaggccttgctctcttgcccaggctggagggcagtggtgcaatcatagctcactgcagcctcaaccttctccgctcaagccatcctcccacctcagcctcccgaatagctgaaacttcgggcgtgcactaccacacttggctaatttattttattttatttttgtagagatgatgtctccctatgttgcccaggctggtcttgaactcctggcttcaagtgatcttcctgccttggcctcccaaagcactgggattgcaagtgtgaaccaccacgcccagccgggactcacatttcttgagacacagttgtgtagtgggccttctcatagtcattttctcattcggtctttgcaataacaacatcgtggcaaggtaggtatcagccctcttcgcaagtaaagaaacaagtccggccgggcacggtggctcacgcctataatcccagcactttggaaggccaaggtgggcggatcacttgaggccaggaattcgagaccagcctggccaaaatggtgaaaccccgtctctactaaaaatacaaaaattagcccggagtggtggtgggcgcctgtagtcccaactactcgggaggcggaggttgcagtgagccgagaccacgcctttgcactccagcctgggcgacagagcgagactctgtctcaacaacaataacaaaaaaagaaacaagtgcaaggtcttgcctttgagttggggtcagagagggaagccagggcttctgagaccgagggccctgctatttgcattatggtcctgtctccacggatgtgggagggagcttagggtaagcgggccccatgtttggtaccgagtcatgccctggagagcccacgtgggcctcggtgcagggcagggcgctggtctctgggcacccggatcccccatgcagggacctagatgtctggggactgagagagggcataaaccagcagagaactgacaggtagggcctgcacgcgcactcacccgtgcctcagcgccaggcgcacgaagcctttgcgcttctggagcgtaaggcagtgctccccggggactgaatacagggcctcgtgcgcaccccccaccatgatgaccacggcctgcccgagctggggctgggacaggatgaagtccaggctctggcggctcaccggacagagtcctgtgggcaggaggaggtggaaagtagttcccatctgcctccacggcacccccgcccctcacccagcctttagttccaagccccctacccccatctccaaggcggggaacctacccaaatgctcactgcaagtctgggcagtgctcaggctggcccctgtcctgggtgggggacttattatgggggggggtggtcccagaggggctggggaacatctggtcaggagtctcctcccgttctcctcctcccattcggctcaccaaaggacatgatgtagtcgcgatagaccgggaggtagaagaggccagccagcacggctaaccagggccggagccccgggaagagctgggagaagccattgctctcggtggagaaattacagaggaagcctgtacacatgatcccatgagggtgggcgcccagcacgtagttccgatccgggggcagctctgctgttttcaccagcttcggggtgttgagcaggatgaagggaggatggaaggcaagacaccggctgaaaagaggggccctccaccccaacagagttccgagttaaaggttcttaggatagggtcaagggccaccccagcagagttccgagttaaaggttcttaggatagggttaagggcccaggttttttttttttttttttttgagatggagtcttgctctgtagcccaggctgaagtgcagtggcacgatctcggctcactgcaacctccgcctcttggtcccggttcaagctatcctcctgcctcagcctcccgagtagctgggattacaggcatgcgaaactatgcccagctaatttttgtatttttagtagagacgcagtttcaccatattggccaggttggtcttgaactcctgacctcgtgatctgcctgccttggcctcccacagtgctgggattacaggcgtaagccacctcacccactctctctttttttcttttctttttttgaggcagagttttgctcctgttgcctaggctggagtgcaatggcatcatctcagctcaccacaacctccgcctccctggttcaagcaattctcctgcctcagcctccagagtagctgggattacaggcatgtgccaccatgtccggctaatttgtttggtatttttagtagagatggggtttctccatgttggtcaggctggtctcgaactcctgaccttaggtgatccacccacctcagcctcccaaagtgctgggattaaaggcttgagccaccacaaccgcctttttttttttttttttttagagacggtctcactctgttgctcaggctggagtacagtggcgcaatcatggctcactacagcctccaactcctgggctcaagcaatcctcccacctcggcctcccaaagtgcttggattacaggcatgagccatggtgccccaccaaggccccgctcttgaacatcatccactcccaggccgggcgcggtggctcaaggctgtaatcccagcactttgggaggccgaggtggctggatcacttgaggccaggagtttgagaccagcctggccaacatgttgaaaccctgtctctactaaactacaaaaattagccaggcatggtggcgggcacctataatcccagctactagggaggctgaggcatgagaatagcttgaacctaggaggcggaggttgcaatgagctgagattgcaccactgcactccagcctcggtgacaggagactcagtctaaaaaaaaaaaaaaatccattccctgtcccactgcctgagcttaggcagcggggagctcaggccccagcacaaggaagggctcctaggtgtgggagggagatggggagaggtaggaagcagtttttctgcagggtgacccatcaccttgacaggataataatcccttagttgtctccaaattgcccggttccttatccactccgaacgccttccacctgcggacaatgagatactggtggacgaacccccggagtcacctcccctcaccccccatgtccccaccatctctggctacctgggcccccatccggagctcaccttggttgggtgtgtcccagtccacatagagccacaccaagtaaaaaacagagaagggccagagtgacgtgaagaggaggacaaagacaagaagggagaagaaagggcctgggggaagggagagaaagaaaagagttcacttctgaaactccatcattccctccagctgctcccttcccttcctccccttcagaacaaccagctctctcctctggccctctcccagaccagtcacctggtcactgtcctcaggcatgcaagccagcagcccagccactctccctccaagccctactcccctggcagaccccaggcacccacgcctccccagctctcacccatgaagaggaaagtgagcacatattggtaggcgcccactgcttctagatgctgcttctgcaaggttttggaagtggttgggggctgcagggttgtggcaactcccattgcagaagctcccctcttccagcaggatcccagaacccggaggacaaacgatgaaggcttggatgtggacctgggcagactttctccctacaggagcccagctttgggggcctggctaagtcgcaaatcacctcccagagtagcgtgtgtccgtaggtgtgtgagtggggagatctttggatccagagccccagatgtctctgggttttttctcagcctgatctttgaacttcctgtcagtcaccagtctgggctggctgctgggtggggctgggaggcgtaaggggtgtgcaagggagaggtgacacccgagtgcctcaggaattgatgttggagtggacaagagtgatctggctagccccacccactgggtcccaggtgctggaaggggccagaagccctgctgagactatttgacctccagtcggggtgggggcagggcctggtccggggcatctccaggaatgtcaaggtcaccacccctgcctggacctcccccgccatgcacaaacacacacaggctgcaggtctgtttcccactttaatttttttctttttcttttcttttcttttttttctttttttttcacacgtctcggtcacccaggctggagagcagtggcacgatctcggctcactgcaacctccgcctcccgggttcaaacgattctcctgcctcagcctcccgagtagctaggattacaggcgcgccaccacgtctggctaattttttttttttttttttttggatttttaatagagatggggtttcaccatgatggccaggctggtctcgaactcctgacctcaagtgatccacccgcctcggcctcccaaagtgctggaatcacaggcgtgagccaccgtgccctgccgccagtctttaatttcacttccccacctgcagtcacccagcggacaggcgaggccaggcggtggggcgcgcctccgtgaggaccaggtgtctgtcggcggggacaccatagcgcgcctggtgctcctcgaagagctgcgtgagtcgccccacgtagcgcgcttgcagcgtgtccacctgggccggactgggcggggggctctgctgcacgggaatcgccgaccccactgcgggcgggacgggaggcgatctgggctgggatccccggttctcctcctcttttcctccttggggataggcgggaacagagttcagggctggcgcggtggccaaaggccagtctgggtggccccaacccgggacggggagggagcgggccctgggccaggatcgcggggcggaggccggggctcacctacggtgcggatgggcgcgcggaagggcagcgggaggccccggcggcccaggaacagctgcagggccacgcttagcagcggacgcagagcctcctgcgtcctctgcacccacgagctctgcgggttcgggaactgctggaagagctcattctccctggagaagacaggcactagggaggccgcaggagagcatggcgcggctgactcctggccccggggtccgcgggtggcgccactctcctcctccccggcccggcagccctggggcgtccccaccgggtcacgctcgggtcctcacccgagttccagagctgacttaaccaatctcttctgattccgaatcggcaagctcagttgtccgggttttgcctccagcgcctgcaggggccctcccacgccaggacagccacctggccaccactgaggcagcggggccttgacaaaggagaccaaacctggggggagggcagaagctgggggacccaacgcctgggtcttatttacttatttatttagggacggagtcttgctctgttgcccaggctggagtacagtggcctgatcttggttcactgcatccttgaccttcagggctcaagtgaccctcccacctcaagcctcccagtagctgggaccacaggtgtgtaccaccacacctggctaaatttttgtttttgttttttcttgtgtagagatggggtttcactgtgttgcccaggctggtcttgaactcctggccttaagcgatcctctcgcctgcgcctcccaagtgctgggattacaggtgtgaaccaccgcacccagccaaagcctgggacttggaaagaagagtggagaggacatggggaaaggagagctgggccccagtgtcccctgggaagaggatggtggggcgggagacagcagcaaggtcctcctcttctcaccacctgacatgatgtagtcctggaagaagaggagatggaaccaacaaggcagcatgagcaggtgtggcgggagtttggggaagaggcaggagcagcccgtgggctctgtgcagaagttggcgaaggctcccacgaccaggaccctgtgagggtggaagtcaaagaggtagttccaggaggtgcccaactttgcagttttaactagctggggagcagacgggcgcaccccaccccaacggtgagattgcactttgggagatggtggtcccaagagtctattctgaagccccaaccgcacccagcaccccacagcccaggtcctcactgagagggggaagtagtcacagaaatgtctcaaactgcccagttgcaaacccaggcagatctgcgggctccagccctgggtatgtttctatcccaatagagccagaccaggtagaggaccgccagcatccaagcccagccgaggaatgcaagagccaggctgccaggtgcacctgggctggaagatggggcagggggagctcacagtacaggtgtttaagaccattcagttgttgctcctacccatccagtggcctgagtggtgggagctgcagaccagtcttctgtggcaggctgaatgctccagtcttcagtagggaactgctagatagcacagagggcacctgcacgccttcagaccagtctgcaacctcaggttgagtagcagtgaactcaggagccggagcagtccattcaccctgaaattcctccttgtcacagccttttcagcagcagcctgctcttctttttcaatgtcttcatgatctctgtagaagtagagatcaggcatgacctcccacgggtgttcacaggaaatggtgccacgcatgcgcagaacttcccgagccagcatccaccacatcagacccactgagtgagctcccttgttgttgcttgggatggcaatgtccacatggcgcagaggagaatctgtgagacacagagcaaggtaggtaggttaacataagatgcctctgtgagaggctgctgatcagccctggggtcagtaaacacaagaagccgtggctcccggaaggctgcctggatctggttagtgaaggttccaggagtgaagcggccagcgattggagtggctccagtggcagcagcaaacttcagcacggccctctggccagtatttctggagggtatgacactgacatcagcggggttttcaatggcaacaatgccacgagctgccagcagaagcttctcccaggtcctcttcagatttgggatgtagatgccatcacttttccttttatacatgtactgttccatctgtaagtcaaggttggtgccacctaattggtttcctgctgcaaggaaattaaggacatcttcctccttcatttgcaggacatcaagggctccggatgttgtgaaagtttctctttaagttacaacaggaatccagaacaacgccggatggagccctctgtgggtagcgtggaaagctttttttgttttgtttttttgttttgagacgaagtcttgctctgtcacccaggctggagtaccgtggcacgatcttggctcactgcagcctccgtctcctaggttcaagcaattctcctgcctcagcctcctgagtagctgggattacaggcctgtgccaccacacctggctaatttttgtatttttagtagagacagggtttcaccatgttggccaggctggtctcaaactcctgacctcaagtgatctgcctgcctgcctcggcctcccaaagtgctaggattacaggcgtgagccactgagcccggcttatttatttttttgagttggagtttcattcttgctgcccaggctggagtgtgatggcgcgatctcagctcactgcaacctccccctcccaggttcaagcaattatcctgcctcagcctcccaagtagccgggattacaggcgcccgccaccatgcccagctaatttttgtattttttagtagagatgcggtttcaccattttggcctggctggtcttgaactcctcacctcgtgatctgtccgcctcagcctcccaaagtgctgggattacaggcatgggccaccgtgcccagcttaattatgtattttttaagtagagacagggtttcaccatgttggccagggtggtctcaaactcccaacttcaggtgatccatccacctcagcctcccaaagtgctggaattacaggcgtgagccatcgcgcccagctaatttattttttgtagagatggggggggtctcgctatgttgtccaggctggtcttgaactcctggcctccagtgatcctccgcctgccttggcctctgaaagtactgggattataggtgtgagccactgtgcccagcctgggaagtccctcttttggtctgtgccctctcatgcactttttttttttttgagatggagtctcactctgtggcccaggctggagtgccggggcacaatctcagctcactgcaagctctgcctcccgggttcatgtcattctcctgcctcagcctcctgattagctgggactacagatgcccgccaccacgcctggataattttttgtatttttagtagagacggggtttcaccgtgttagccaggatggtctggatctcctgacctcgtgatccgccccccttggcctcccaaagtgttgggattacaggcgtgagccaccgcgcccggcccctctcacacactgtctccagctcaggcaatacaggggaaggggaaagtgggagccagggaagctcccaggttcccacgagggtctaacattctgcctctcccttttcctcttgtcttcgcttttctgggtctctcccctctacgctgctggcaggaggggagatggggttaatgggcagaccaatggactcaagacttacaaactgtcctttattcagagtgagactgcggaacattaataatttatcacgcggggagtccccagaagccctgtgcccacgaacccctgtgggcggaggagagaggcggggactccgggagcttcctgagagggccgtgtcttgggagcaaggtgacatattcagttcaggcacgcggaacatgaactcaggaagtggggagacagagagacccatcccccaactcccaggacgggggccaggccccctaaaaaggcacaatggcagggcaggtttggcagagtggttgagtgtcaggggtcgacaaaggacaccatgatgtagcgtgtgccccaggtcgttggcagcccctcgtggtagtgggtgaggcggccggggtgcaggagtgcccagcccttcctcggggaggagatcacacagtcgtagcgcaggaagcggcagccacctccctggaaagagaagggaaaggaaacatggagtgagcagacgtggggcctggggagcaggcagatacacggggcagggcggccagaccggggggcacggtgcagcagaccggggtgacaagggagatggcagatatggcagacaccggaggctggggtgcctgcagacaggaagatccaggaggaagcagaggccgcctgcccagaagcgatccaggagctgatacccacaaagtcactgggaaatgggcagggaggggagctgggggatgcacgcaggggctctaggtggggacccgagggtcctgaggtgaagcgtgggtgggtagtgtgactggggcgcacctcatagtccaggcccttgtggttgagggcaacgttgagggtgaaggtggatgagtcgtggtgtggccgcagagacggctgctcgtctggccggtagcgaaccacaaagttcatcaccgcccgcgcctgggggagaggagggaagaggctgcagggacagctgcgggcgcagggggtcttttattttgtattattattattcttttgagatagtctcgctctgtcactcaggctggagtgcagtggtgcgatcttggctcgatcttggctcactgcaacctctgcctcccggtttcaagcaattctcatgcctcagcctcccgagtagctgggattataggcacctgccaccacacccggctaatttttgtatttttagtagagacgaggtttcaccatcttggccaggctggtcttgaactcctgacctcaggtgatccacccacctcagcctcgcaaagtgctgggattacatgtgtgagccaccacgcccggccatcgcagggtgtcttcagggagatgacggtccctgtccagggaggggaggggaggggcggcgggacccctgcgtaggaggctctcgctgctcactggcattaaattagggccaagcctcaccttgggtctcagcctggcgccctccctcccctggggtgcctcctgcagcgtctcattcccctgggaactaaaatgcatggagcccaaatgctgccggggccgaaaggggtctgcgtggagacttcctgtccgggactggggtggggaaggtggggaggcagctggcaggtgggcagcgcaccttggtgtggtaaccgggaaacaggctctcggtcatggggcccacatacgtccgcagcagctgcagccactggtcctcgtaccccacctgcttcatgtggatgtccacggtgggcacattctcgtagcctccagccagccttgaatcctgggggcggcgggcactgagccacccgcccctccagccatggcgctccccaccccagggcagtccagcctccttcctcccgtcctccagccttcacacctgtgttcctctgtgcagaacagtcttctttgctacttctcggcctgactcactgctcccggcccttcaagtctcagctaagatgtcacctgtcctgtgaagctccctactcctcccaagtctgggtcaaggcttccccgtggcttctattgcacccaggctgctcatcgcagccttagaagctgtgtggtggctgctgctcacagcagggcagagctcgaccggcatgaggcattcctgcagtgcagtctaggacagtggcccaggaatgatttccttttctctttttttagagacagagtcttgctctgtcacccaggctggagtactgcggcatgatcatagctcactgcagcctctaactctggggctcaagtgatccttctgcctcagcctcctgaatagctgggacatgccaccatgcccggctaatttgttggtttttctgagatggagtttcactcttgttgcccagcctggagttcaatcttggctcactgcaacctctgcctcccgggttcaagcaattctacctcagctcccgagtagctgggactacaggcgcccgccaccatgcccggctaattttgtgtttttagtagagatggggtttctccatgttggtcaggctggtctcgaactcctgaccccaggtgatccacctgcctcggcctcccaaagtgctgggattacaggcgtgagccaccgcacctggcccaaactcggctaatttttaaattttttgtagagacagggtctcgctatgttgcccaggctggcctcaaactccccctgctcgagcaatcctcccgcctcagcctcccaaagtgctaggattacaggcatgagccactgtgcccagcagtaaatatttcttgaatacatgaatgaatgcagttgtgaccccagggtctgcctcccccctgggaacccctctttgctcccattttcctgattccattgtttgtttaccagatcctgcacctcctcctctgggaaggcctctgccctcctcgcccaggcccttacctcatgccggccgcctgaccactggccgtagtgctccatctctgccaccagctcatcacacatttgttctgacagcagtgggaaccagtacacgtccgggcatggctgaggatggggcgagggagaacagggctagctgacgccgcagaacggggaaggggacaggcagcaggcagaatgggaaggggcagggaggagcagggaaggctttgtgagagcagccggggacccgccaggtaggggctgagggagtggcaaggctgaggaccggtttctggcacaggagaggtggcagagggtcctggagcccctcgtgctgggacagtggtttccaaacttccgtaacagtgcatacctcttttttttttttttgagatagggtattgctctgtcaaccaggctggagtgcagtggcacaatcatagctcactacagcctcgaccttctgggctcaagcgatcctcccgcctcagactcccaagtagctggaactacaggcacatgccaccatgccaagctaattttttcttttcttttttttttgagacagggtctcgctgtgtcacccaaggtggagtgcagtggcgtgatcttggctcactgcaacctctgcctcccaggttcaagcgattctcccacctcagcctcccgagtagctgggactacaggtgcacgccatcacacctgactaatttttgtgttttttttttttttttttttggtagagacaggatttgccatgttggccaggctggtctcgaactcctgacctcaggtgatctgcctgcctcggcctctcaatgtactgggattacaagcatgagcaccactcctggcctcatttcttatttaatttttttgttgttgttgtagagacagattctcgctatgttgcccaggctggtcttggacttctggcctcaaccgatccacccaccttggcctcccaaagtgctgggattacaggcatgagccactgagcccagccccattcttcttttaagatgtgatttcaagcataacaccagtatacccaatatacaggagaagaggctgtctgatcaatgctggctttgggggcaagagtcctttctgttcggcctctgccttcatcttgtctgaacagaaaaccctcagatctctggggaactcagtgtgaaaactttgaatccaggcgggggcccccaagaggcgatggccatgagggcagggggtgggtggggaggctgcgtgggctcacctgctccacgattccttccccttccagggcccggctgtagttctcgtggatgtactgctccttccagtcctgtgagagggtggggggcacatcagatctgtgcccccctcgctcccagcccccaggggaccgccccctcccactcagtgtcctgcgctggcagcagccatcacgtttggtgtcttccttagcacaaggcggggaacctgtgtgctctgggcgtggggtccccactcacgacggggttgtcgaagatctgccagaggtcggggtgcaggtgctccgtgtcgtatctggaagtggccaggagccggccaaattcatgctgattgctcagatggaggaagatgccctgtagtggggtgggggtgtccgtgatgcaggcgatgcctggagtctgggggactgcccccaggccagaccgtgcacccgcgctcaccttgtctcgaaagctcttacagaaggccatgtccgggtctgtgtcactgcccgagaacacatccctctggggcagctccatccgcagggtatcaccccggatcacataggcctgggagatgtatggtacattccacacacccctggaggcaccgacaccgcggtcagctgggaggacagccccccaaattctgcccagctcatcccgggaagtccttcttccctcagggtatcccagtccctgaacataaggcccctgcatgtcccttgtcaagcactgctggtcccaaccaccccacctcccaaaatgcggtcagttcctaccccaagctgtggcacttcttttttgtttcttgtttttggtttttgagacggagtcttgctctgtcacccaggctggaatgcagtggtgtgatcttggctcactgcaacctccacctcccaggttcaagcaattctcccaccttagcctcccaaatagctgggattagaggtgccagccaccatgcccggctgatttttgtatttttggtagagatggggtttcaccatgttggccaggctggtctcgaactcctgacctcgagtaatccacctgcctctgccttccaaagtgctgggattacaggcgtcagccaccgcggccggcccttgttttttattttcttgagaaagggtctccctctgtttccaggctggagtgcagtggtggaaacatggctcactgcagcctcaacctcccaagttcaagtgattctcccacctcagcctccgtagtagctgggaccacaggcacgcaccaccgtgcccagctaatattttaagttttttgtagagataggctcttgctacgttgctcaggctgatcttaaactcccaggctcaagcagtcctcctacctcagcctcccaaagtggtggcatcaaaagtgtgagccactgcagccagcctcatggcacctctgactggtgaccactccaaacccctgagagtagggggcttgggtctacctgggccccgggtcggaggaggcggggggctgcaggctggcgggactcacactcgcttccgctgcaccagctccacgtagtcctcggagcgggcgtagtactcatcggggctcagggcgccccagaagttggaccacagcttgccgtggcgggacagcatgggggcgatcaccttcctgcggacaggtgggggtgagggctgggcagacgggagcaggcctggggagcccggtgcccagggcaggagtggggttcccggggcctgttggggtgccctccggctgcggggagagggggtaagccacctgttctcctcaatgaggatacgcagggtctgcaggttggtgaggacagcgtcggcgtccaggctgaagtagaactcacactcggggtcctgccgacacaggtccctggaggtgagaggcgagctgagacggcggcaggtggggaggcggtgtggatggggtaactggcccatgcccccaggagaagaggagggaggcagtgtctatccttccttccccaggctctctgctgtctgggtgagctggcaagggcaggagtgacagcatgggggctgcaaggatgcgaatggggaggcccaggaggggctggatgggtgacaggtgaggcaagggccaggcagcaggtggcagcacccctgaccctacagcctcatcccaccctctcctccccgcaagcacccgctcacatggccatgtccctggcctcgcctgggctcagagcctcctccggccccacgagcttcacagctgagaagtggtcctggagctgcggccaggagtcagcgatgtggggttcatggaagacctcctgggaggggaagacatagggggatgggctcagagggcagggaggcggcacctgagggatgggggtgcaggaaggagatgggggtgggggcacgagagttctgatcagggcagggaaagggtccctcaggagaggctccaacaggggagtctcacgttgttgtgcaggaaaagggtgaccctgtcggggggatagtccaggagtagcagccgctgcaggaagcggggcagaaacggagtaggctgttccacaaacacggccagaaacacccgggggggaggctggaagatgcaacacgcagggactcagagagaagcccggacttccctgctgcccccacccaacctccaccctgacaggtgcagggacccaggagcgatgcccccaccgccccccagtccgctgtccttgtacctcctgctcagcacgctgccctctcgtgcccctccctggcacccccacctcacctgcccccccgggagtgtcctccggtcctggttgcagaagccacagcctccctcaggagtccagccattggggacgtagtttcccaggtagttgagctgcagctgttggggacagactgaggctgagtggctgaggcctccaggggtggaggtgggggtcaggcacctctgatatgggggctgggaagggccagcttctcagaagggttggaggtgcctgggggttggggcagggcggggcgggggttgagaccactggtggcaccttagtgggaccgtttccatggaccacaatggggagcgtgtcgtaggccacgttccggatacgcacacggttccgatcaaactttaaaaccacttcatctggggaagaaaaaggccaggcttcagaccccctttctctgggagctaccaagcaacacattcttctaaatatggggtcccaaattctccagggaataaagggacaccagggctatcctggagtgtggctcgttgtgggcaggaacctttgggttctgaccaggctgctggcccagagagctccactgcctactacctgcgtgatcacaccgcagctgggcgaggaaggggagggtgagctgagcgggaggccagtaggagcctcagcatccctacccctcctcatattctctctctccttgtttttttttttttttatttttattttttgagatggagtctcactctgtcacccaggctggagtgcaatggcgtggtctcggctcactgcaacctctgcctcctgagttcaaaagattctcttgcctcagcctttcaggtagctgagactatgggcacatgccactacacctggctaatttttgtatttgtattttttgttttttatgctgagatggagtctcactcccaacacgcaggctggagtgcagtggcacgatcttggctcattgcaacttccacctccagggttcaagcgattctccttcctcagcctcccgggtagccaggattacaggcgcgcaccaccatgcccggctaatttttgtgtttttagtagagacagggtttcaccatgtcgaccaggctggccttgaactcctgacctcaggtgatccacctgcctcggcctcccaaagtgctaggattacaagcatgagccaccacacccagcctaatttttgtatatttagtagagactgggtttcactatgtcagccaggctggtctcaaacttctgacttcatgatctgcccgcctcagccttccaaagtgctgggattacagatgtgagctgtcgcacctggccttttttttttttgagaaggaatctcactctgtcacccaggcaggagtgcagtggcgcaatctcggctcactgcaagctctgcctcccgggttccagtgattctcctgcctcagccttctgaatagctgggattacaggcacccgccaccacgcccagctcatttttgtacttttttttagtagagacgggttttcgccatgttggccaggctggtctcaaactcctgacctcaagtgatcctcctgcctgggcctcccaaaatgttgggattacaggcgtgaggcaccgtgcctggcctctctctctccccgttctccccatcccctgaggcaagtcaccaacccctccacaagctgttttcctcatctgtacaagaaggataaccagggaccttccctttgttaaatggaatcacagaagtagaccgggcacagtggctcatgcctgtaatcccagcactttgggaggttgaggcaggcggatcacctgaggttgggagttcgagactagcctggccaccatggtgaaaccctgtctctactaaaaatacaaaatgagctgggcgtggtggcgcatgcctgtaatcccagctactcgggaggctgaggcagaagaatcacttgaacccgggaggtggaggctgcagtgagccaagattggaccactgcactccggcccgggcaacagagcgaaactctgtctcaaaaaaaaaagtccctggcccggtgcccaggcacagcatgtgtgcaacagatgccagacacgtttttgcttcccttgcttctggtagtaccatcagcacagtgcaacttacacaaccagccactcagacgcctgacaaaaccacatagaggtgggcttggatcagcccagctcctccagaagcctctcccagctcaagacccctagctgcagaggctgcgcatcgcccacctgcggctgtcttcctcctcacctaaagccccgttgaggttctgaaagatccgagacttatgatccagattaaggctgagtttctcctaaatggaatgagatgcgatggagtggttaaaatggaaggagtggaaaggacatcatttctcacttttctctctctttttttcttctcttgcttttgttgcttaggctggagtgcaatggcacgatctcagctcactgcaacctctgcctcccggtttaattgattctcttgcttcagccttccaagtaactgggactacaggagagtgtcaccacgcctggctaatttttgtatttttagtagagacggggtttcaccatgttggccaggctggtctcaaactcccaatctcaggtgatccacccgcctcagcctcccaaagtgctgggattataggcatgagccaccatggttttcctttttttgtgagagacagagtctcattctgtcacccaggctggaatgcagtggtgcaaaacatcctcaaactcctgggctcaagtgatggtcccacctcagcctcccaagtagctgggattacaggcgtacaccatgaagcctggctaattttttctttctttttttttgtagagatgaggtctcaactatgttgtccaggctggtcttaaattcctggactcaagcaatcctcctgcctaagcctcccaaaagtcttggatgacaggcgtgagccaccacgcccaggcacacatttttctctttgcaaccccctttgctccccaaatcccattcagcctgaggcctccactcccacagagctgcgggatgcgcccactcctctgccttccctaccctcagtcctgggtccaggtagagccgtgtgtagaacagctggtcgtcgtcatcatccttgtacttccactggcgcacgatttggtggatggtggtggcaaaaccgatgaatcctggcggggagggggagtgttgacctcgagactcccagggtcccagggcctgtcccccaggctgtctccagccctcaggcgcctttaacactctgtgtcccaccgctcttggcccctctgccttgggcactctgccactcaccaccagaattgaggaagcgcttccccgtgcccacctcagggtactgctccgccagcccccactcgggccagcagaagctctctgcagagaagagcaggcggctgccactctggacgaacttcttcagcagctctgtggggctgccggccagaatcacgtcgtagctgggtgaggaaggggaggatgggcaggggtccactgggaacctcagcatccttaccccgctccctatccccagccccgttacctatccacaaacatgatgatcatatcctcccggtcagcgtatttctccatttccttctttaaccaccggaccttctgtcctccaccaactgttcgagccacatcaccccctcgccactcctctcccaggcccagggtctgtggagaagattgccccgtgccaggcaaggggtggggagttgtggggggaactcctgaccaggcttaccgtggggacctgggcatccagacttcagcccacccctcctgctgggaccccctcccaggggcctttccctctcctcacccgcacagtgtagttgaagaactccgcagagcgcaggaaacgcaggtacccctcggtttcagctgtggccacagtgatcaccagcagcttctctgttaccagagggaaatggcacttgagatccaccgcccagctccgggcctcacgtgctttgctgtcctccctctcactcgacttccctccctttcttccttcccattcttaaactcttctcacccaggaacactctgaccccaaggagggcagggtgggagtggtgcccaggaattccgagtccctttgcatagggaggctggaaaccccagttcagggtagtgatgggcgaggggcttggcgcgactcagcctcaagagcacgctgggcgggggacgggccagacacctcctcgagcctccgaccctctccgggccaggctggcaggcacgccagcctctgccccctcggccgtgccgggcctccccgggatctcacctgggttgaccgggtctcggccccggggccggtcggaggctgaggccgcagggggcagcagcagcggcagcagcagcaggaaccggggtccaggccccgaggaggtcatggtggggagcgggcccagacagcacccaggatcctgggatctccgctacgcgcctggatcccagctccggaggggagctctggaaagggggcgctcgggctgctgtgcggccgccgcggggagcagcttggctggggctacgccctgaaaaaaaggcgtatccggaggctacagaaagctccagatgccggcgccacagacaaggcgaggattgtcccgggcgcacgggaggcgggggaggggcggcggctcgggccggcgggcgggagacagggactctgggctgagccagccgcttgacacatgtggaagctgaaacctggacaggggaagtgacccctggcggagggtcgggcgggacgcgggggcgggtcctggccgcagccctgcccagagagtgcgggcggaagacggggagagcgagaggctggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcgggtatgtgagcccccgcggttcgcccccttccccttcccaagtcagtcctagaattttcttacctagtcattcctcttttttggtctcgctctttcgcctaggctggagtgcagtggcatagtcatagctcactgcagcctcgatttcctgggatcaaaccatcctcccacctcagcctccggagtggctggaactgcaagcatgaggccccacgcctggttaatttttaatttgttatgtggtgacgggctctcgctatgttgcccaggttggtctccaactcttggcctcaaagcgatcctcctgcgtgggccttccaaagtgctgggattacaggcgtgagctgccgcgcccggccccagctattcctcgtaaatcccttcctcagccctcgggtcctggcgttgacccttcattcacgttttattggtgcctgctccaagccgggcgctggggatgaagaggagaaagacccctcttatccaagcattggctttttctggaaggggggcagaaacgcagacctaacactgtattttactgtgatttgtgatttgtgctatggcagagggaagcacagcgcctgggaacagggagacgtggcatctagcccaggttctgggaggcaggggactgtgaaagcttgaaggaaaaatgaaaaagcttgaattgagtcttgaaagtctagttagggtttctctcagtgggaacctcacgtgcaaaggcagtgaagcaagaaaaagcaagtcgcttaggaagccaagttcacagtttggatcttacagagtaataagaaaggatcgaaggctggggaaaggttacattttgaaaggcattatacacactgcccaggagtttgaactctgtagggaaacactggagagccagcaaagactttttttttttagacagagtcttgctctgtcacccaggctggaatgcagtggttctatataactcactgcagcctcaacctcccatgctcaagtgattcttccacctcagccacctgagtaggtggaactacaggtgggtgcaggccaccatgctgggctagtttttatattttttgttgagatgggtgtctcactatgttgcccaggctggtcttgaactcctgagctcatgtgatcctcctgcctcggccttccaaaatgctaggattacaagtatgagccactgcgcttggcccttttagtttttctttctttctttttttttctttttgagacggagtcttgctctgtcccccaggctggagtgcagtggcgcaatctcggttcactgcaagctctgcctcccgggttcacaccattctctggcctcagcttctggagtagctgggactacaggcgcccgccaccacacccagcttatcttttgtatttttagtagagacagggtttcaccatgttagccaggatggtcttgatctcctgacctcgtgatccacccgcctcggccccccaaaatgctagaattacaggcatgagccactgcgcttggccctctcagtttttcaaaggcatcgcagtctcccagccatcagttttttcatgttggcctcaaggtctgaaataccccgctgtctcccctagccaggtcattcaccagttaggccttaacctagacttaccttcttctgggaagtcttccctgactactccaaggccaggttgggtgtttctgtcctgggctctgcagcactttatacttccgtatcctagcctactccatgctgtacttactgtgtttgtttcattaatcatttgtgtttgccactggactgtaagctttggcatccctaaaacctagagcactgcctggcatttggaggggagacagagtagtacagtgatcataatcatatttttttttgtttggttggttttgggtttttttttttttttttttttttttgaaacagggtcttgctctgtcacccaggctggagtgcagtggcacaaacacagctcactgcagccttgagctcctgggctcaagcaatccttgcgcctcagcctcctgaatagctgggactacaggtgtgtcccactacacctggctaatttttgtattttttttgtagaaacatggttttgccatgttgcccaggctggcctcgaactcccgcgctcaaacaatccacccaccttggcctcccaaagtgctgagataacaggcatgagccactgcgcctggcaaggtcatgctttttgatgctgggtagttctttgactcctgacctggccacttgttagctatgtgaactttggacacatttcttaatctctgaatgttggtaaattggggatgatgatactgtcccatacagctgttgtaagggttaaatggttcaagtgttgcaaagagctgagcacgtgcctggctcatagtaagtgtccaacaagtgatagctactggggctgctgctgttattattatgcttaacaggtggttaatgaataaagagatatattatgcaaaattatcagaatctggcaaacagctgataaggcaatgaggaaagaggttttttgttttttgtttttgagacagggtctctctctgttgcccaggctggaatgcaatggcgcgatctcagctcgctgcaacctccacctcccgggttcaagcgattcttgtgcctcagcctcccgcgtagctgggattacaggcatgtgccaccacaccctgctaatttttgtatttttagtagagacatggtttcaccacgttggtcaggctggtctcgaactcctgacctgaagtgatgagcccacctcagcctcccaaagtgctgggattgcaggggtgagccactatgtccagccgaggaaagaggtttaaaataacttctaggtttctggtttggatgtctgcatagacggttccatttgcgtagagagaatctgcaggagaagcagacttggatgggaatttttttttttttttgagttgcagtgtccacagggccagtgggtgatttcttttttccttctttctttttttttttttttggagacagtcttgctttgtcactcaggctggagtggtggcgcgatcacggcttgctgcacactgcagcctcaacctcccgggcccatgtagtcctcccaccgcagcctcccaagtaactgggactacaggcatgtgcaaccacgcctggcttattttttaattttttgtagagatggggtttggctatgctgcccaggctggtttctaactcctggcatcaagcgatcctttggcctcccaaagtgctgagattacaggcgtgcgccaccacacccggcctcaccaggcgctggctgcatggccagttctggagcccgggagcaggttctgtgttgagggagtcactctgggagtcatttgcttgtgggtgatcatcagagccctttgtttggagtcaaaatcccaggaagagtgcatagactgagcagagaagagggccagccacctccatagaggcagggagagcagccgagctggagccggaggattcctggacatggagaaggcctgcagttttgtcaaggaagcaagcaaagggtctctttctactcgatgaaggtagtcggcaccgccacagggtggacagggctcaggtccaaggaggaggaggaaggcacactggagccgctctggggcccagagcgtgggtgggtggtcccccaggatgaccaggcaggtgtcagattttggggttcaaggagaggatgggaggtgaaaaagtgacacatcacgtgagttgctgtgaaggagaaggagctgtgaagccgagtagacacatgagcgtcgccagctctttgatggaaagtgccggttgaggaggaggggttgaagatgggagagggagggaatgggctggaggtgaaggctcggggtcagtggtgggacttggggcgctccagggcaggggtgtgcccacttggcatcacgtttgtgggtaggtggcctggaagatgagcgtatccaagcatgggtggcccctggttcctttgaggtaggaggtgagatgctgagtgtgagggccatgtgtattgagggcccaggacagcctggaagccccagggcgctgtgacctccccagtcagcagtgagctgtctccaggccggggctcactggctgggactgggattgagaggaaggcggagaaaacaggcaggagaaactgaaagggtctcagctggcgggacaggaagtgtgggcccagggcttggcccgggaggagacaaggggaccaagggcttggcaatggggatgagatcagagagctgcagcttccaccccgggtgccttcctcgccctgcccagagcggcggccacactgctctttcttggaagccctgtaactttgcgtgccctgctccatccagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggtgaggcggatggaggaggaagcgggggatgggactgagaggagggcgggagagtccgcccaactcaggctgtgggaggacccaggagctcctggtgcctctgccagtgactggctcccatggctgtgagcaaccacaccccctttctgtgcctcagtttcctctcgtgtatgtgaaataaacaagagagactggataagctctgacacgaagccttaggcttgggggcatggaggtgactgtcagctgggattggagaattggggtggagggcagaggctggtagcgaggggccgacttagagccaggagggcagggccaggtgtggtggctcacgcctgtaatcccagcatttgggaggctgaggtgggcggatcacttgaggtcaggagttcaagaccagcctggccaacatggtgaaaccccatctctactaaaaatacaaaaacaaaattagccaggcatggtggtggacacctgtaatcccagctactcaggaggccaaggcaagaaaatcacttgaacccaggagatggaggttgcagtgagtcaagatcgcaccactgcactccagcctgggtgacagagtgagactgtctcaaaaagaaccaggagggcacatgggcatggggagtgatgaaccagagaaagctgctgtctttctgggcaagtgccaagcaacggatcacccttgacccctaggaaagaaaaagaagaaaacccgaggtgatcattttaaacttcgcttccgaaaaaactttcaggccctgttggaggagcaggtgagaggagggtcggcctgggaggaccccacagggaaggggtgagcctggcccgggcaggtgttcgctgcgtgggtgggcggaggagttctagagccggccccttgtctctgcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgagcatgagacctgctgtccactcccactccctccttcccacagcctccccagacctctctcccctcatcctggcttcccctctgtctgcaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaagccttcctgtttggtcgtggtgtgtttgaggtgatggtaatgggtcacccgtctctcctgctcacggctctgtctctcttcctcctgcctcccactcacccctgccaccgtccgcccctctgtgtccctgatcgcgagagattctgtcccattttcctgccacccccgagcccctgccctccttggctgcttctttaagtctttttggttattgatttagttgtttaaactattttatttatttattagagacagggtctcgcactgtaacccaggctggagtgcagtggtgcggtctcagctcactgcaacctctgcctcccaggttcaagggattctcctgcctcagcctcccaagtaactgggattacaggtggccaccaccacgcccaactaatttttttatatttttagtagagttggggttttgatgtgttggccaggctggtcttgagctcccaacctcaggtaatccacccgcctcggcctaccaaagtgctgggattataggcgtgggccactgcgcccggccatgtttttcctttttatttctccagttgctatattttcaaagtacagctaggttccagggatgggtgacagggaggtggcgggaggactgtggaacatgtgcagaatggtaccgcggagggaccttggcctgtcttcctctcaaggtacttaggcaaaggggagtggtccttgtccttggtgctgccagactgagggagcagttgtccttaggaagcccctgttaccaggggctgcagtgtgtgaagttattagcagtacggaaaacccagaagtttctgggaaacatgggggaattcatggtatagagcaaatttgtccaacctgcagcctgcatgtggcccaggatgactttgaatgcagcccaacacaaattcataaactttcttaaaacattatgagattcttttgcgatttttttttcttttagctcatcagctatcgttaatgttagtgaattttatatgtctcctaagacaattcttcttccaatgtggcccagagaagccaaaagagtggacacccctggattagaggcccctggtctgggtggccctgggtgctgtgactcatgtgaacttcttatacccataccttgtctaaatgaattgcaagctgtaatctcgtaaggtccttttggttgctgtattaaggcccagaaccctgttaacctcatagcaaagcaagtgcttagtaagtatccattgaacagatggcctcattaagatattagagagatccagcaaagtcaacgttaggcaccattttttttttttctgagatgcagtctcgctctgttgcccaggctggagtgcagtggcgccatctcagctcactgcaacctccacctcccaggttcaagtgaccctcatgcctcagccttctgagtagctgggattacaggcgcctaccactatgcccagctaatttttgtattttttgtagagatggggtttcaccttgttggccaggctggtttcgaacttctgacctcagatgatccacccgcctcggcctccaaagtggtgggattacaggtgagagccaccgtgcctggccagtcaccatgttaggccttcacttttgggtactttcctgggggttggctcaagtattccccagggttttcttgaggaactgcctccctttctctgaagacttgcagctgggcaggcagtactggttttggtgtcagcttcatgttggggggctgatgtcaggattcagagacaatccaggtgaggtggtttttcaagatggctcaaaaatctttgtcctcccattaaaaagtggagtgttacggccaggcaaggtggctcacgcctgtaatcccagcactttgggaggctgaggtgggcagatcacttgaggtcaggagtttgagaccagcctggccaacatggtgaaaccctgtctctactaaaaatacaaaaattagctgggcatggtggcgtgtgcgtgtagtcccagctactctggaggctgaggcagcagaatcgcttgaacctgggaggcggaggttgcagtgagccgagatcacgtcattgcactccagcttgggcaacagaatgagaccccggctaagaaaaaaaaaaaggccgggtgcagtggctcacgcctgtaatcctaacactttgggaggccaaggcaggtggatcacctgaggtcgggagtttgagaccagcctggccaacatggtgaaaccccatctctattgaaagtacaaaaattagccgggcgtggtggtgggcacctgtaatcccagctacctgggaggctgaggcaagagaatcgcttgaacccgggaggtggaggttgcagtgagctgagatctcaccattgcactccagcctgggcaacagagtaagactccatctcaaaaaaaaaaaacaaaaaaaacaaaattagccaggcatggtggcatgtgcctgtaatcccagctactcaggaggctgaggcaggagaatcgcttgaacccgggaggcagaggttgcagtgagctgagatcgcgccattgcattccagcctgggcaacagagtgagactccgtctccaaaaagaaaagaaaagactatttcggggctgaacaacaccatctgtgcttctccgtggcatcctaggctgggattcccgtccagcttgcactgtcagcacaatctctttggattctttcctaacttagctgactgtttcatattttgtggttataaaaagaggcacactggttctgttcaatgtaagatttctctccccagtgacgtactccgccttccaaaatgaccttgagaggacagggctggaccctgaaggcctctggttgctctctgatgccatccatgacattctctaggaagctgagtccagggactttggacccccattgaaaaaccataattcggccaggcaggtggctcacgcctgtaatcccaacactttgggagcccgaagcaggcggatcacttgaggtcaggagttcgagaccagcctggccaacatggtgaaacccagtctatactaaaattacaaaaatcagctaggtgtggtggcacacgcctgtaatcccagctatttgggaggctgaggcaggagaattgctggaacccaggaggcagaggttgcagtgagctgagatcacgccattgcactccagcctgggtgacagagcaagactcagtctcaaaaaaaaaaagaaaaaagaaagaaaaccataattccccaaggacagcctgaaacaattttgccagcttccttcatgctagggagattttttcctaccttgggagacacctggtctttgggaaatgtatactctgctctaaggttctagaaggtaaacctagtgtcatgtgataagggcagcacccccctttcctgggagcacagaggaggaagaggttggtgccagggtttggaagtgtggacacgggtggttactcctaaaaacttcaatgaggctgggtgctgtggctcaggcctgtaatcccaacgctttgggaggctgaggcaggagggtctcttgatcctagtagtttgagaccagcttgggcaacacagggagaccccatctctacaaaaaatttaaaaattggccgggcacggtgactcatgcctgtaatctcagcactttgggaggccgaggcaggcagatcacgaggtcaggagatcgagaccatcctggctaacacggtgaaactccgtctctactaaaaatacaaaaaattagccggcctggtggcgggcacctgtagtcccagctactcgggaggctgaggcaggagaatggcgtgaacccgggaggcggagcttgcagtgagccgagattgcgccactgcactccagcctgtgcgacagatcaagactccgtctcaaaaaaaaaaaaaaaaaaaaaattaaaaattagccaggtatggtggcgcacacctttagtcccagctactcagggaaggatggcttgggcctgggaggttgaggctgtggtgggcagcaatcactttactgcagtccaacctgggcaacagagcaagaccctgtctcaaaacaaaacaaaaaaaagatcttgattttaattgatgtgagttaggagagccaagaattctgggaagcagggcaattgtgtcttcagtcttggagaaatcctggtctgagtactaactagtggtgtagctcggacaggtcacttcacctctctgatgctgttggagccatgctgcagctattgcaagaattcaatacacctagcccgagacctgacttctagtgagtacgcagcaaatgagagcgcttgatgatactgccaagacctaaagcatgttgttgagtttttcacagccagctccctggggactaaacccagcacctggcccaattgtcaggtagccagcagtttgcatttacatttctttttttgagacagagtgtcactctgtcgctcaggctggagtgcagtggcatgatcttggctcactgcaacctccacctcccaggttcaagtgattctcgtgcctcagcctcctgagtagttagaattacaggtgcccaccaccatgccccgctagtttttggatgttttttattttttcttttaatttttttgagacagggtctcactctgtcacccaagctggagtgcagtggcacgatctcagctcactgcaacctctgcctccctggttgttcaagcgattctcctgctgcagcctcctaagtagctgggataacaggcacccgccacctcgcctggctaataattttgtatttttattagagatggagtttcattatgttggccaggctggtctcgaactcctgacctcaggtgatccgccaaccccggcctcccaaagtgctgggattacaggtgtgagcctctgcgcccggccagtggtttacatttgtgtttgctcctaggctgtgggttctttgagggcacaggcccactccagcttctagcagggaagcagctcagtatgtgttctgaaaaagggcaaatgtctccataaccctttgtagtcacatgtccacccgggaagaaatcaaaactcaacctggtgaccatattaaggcacacacttaaatgccgagttgtaaaactgggcacaggttgtttttcctgaagggggaagaagtgagaagaggcaggctggtgttgggaaaaggaggtagacatgtgggggtggcacactgaagacttttggaagtgcctggaggtgtcagcagttgtaattgacttttgtcttccttcactatagggagcactctcatggcctttcaggattgtaagacactttttgtttgtttttcaagacggagtctcgctctgtcgcccaggctggagtgcagtggcacaatctcagctcactgcaatatccatttcccaagttcaagcaattttcctgcctcagcctcctgagtagctgggattataggtgtgtgccaccactcctggctaatttttgtatttttagtagagttggggttttgccatgttggccaggctgctcttgaactcctgacctcaggtgatccgcccaccttagtctcccaaagtgctgggattacaggtgtgagccactgctcctggccctaatttttatttttttagtagagatggggtctcgctacgttgcccaggttggtcttgaattcctgggcttaagggattctcctgccttggcctcccaaagtgctgggattatggccatgatccactgagcctggcctgtaaaagacacttctactgagcctggcctgtaaaagacagaagacggtgtggaaggagaggattgcagttggtcacagacttgttggccacaggaccctttatgtagggagcagctcaaaaggcaccagggcatctggccaggcgcagcggctcacacttgtaattccagcactttgggaggctgaggcaggcggattacctgaggtcaggagtttgagaccagcctggccaacatggtgaaaccctgtctctactaaaaatacaaaaaaattagctgggcatggtggcgcacgcctgtagtcccagctacttgggaggctgaggcaggagaatctcttgaacctgggaggccgaggttgcagtgagccaacatcgcaccactgcactccagcctgggtgacagagcaagactctgtctcaaaaaaaaaaaaaaaaaaaaaaaaaaaagcaccagtgtttctggctggagcccagccaaaaggatcccaaggatcccagccccaaggtgaaggtgtgtccagggcccaggaagcagcctggtgtgatggtggagcacggtttatccggaggaaagggagcaatggggatggagaggtgggccaggcccaggcagcatgtcaagttcataactgtctggggctttcttctggcggggccaggagctgccaaggcagggcggtcggtggttctccaggagtgcattaggaagaccgtgcttgagacgcccagttgggggaaccctgtagttgtgggggggcaggagagtatgagggcctgccccaggaccagcagtgg

SEQ ID NO: 365 - DNA, 11029 bp, Homo sapiens
tctatattcagagtgatagtttcttatgtatttaaaatgttttctattcatggctaagaattatgtacaatagcagggagacaactgctcttagctgtatggtgaactagatattctgaattgtaaccgccccctcccacctcctccatacaacatccacatgctggataaattacagcaatcatactttatttatttagagatggcgtttcactcttgttgcccaggctgaagtgcaatggtgtgatctcagctcactgcaacctccgcctcccgggttcaaggaattcttctgcctcagcgtcccgagtagctgagattgcaggcatgcaccaccacgcccagctaattttttgtatttttagtagagacagggtttcaccatattggccagactggtcttgaactcctgatctcaggtgacccgcccatctcggcctcccagagtgctgggattacaggcgtgagccactgcactcagccagcaatcatacttttacatgcactgatgagactgcaagacagggaaattcctcatgactcacaaatatattaacaaaatggtaaacaggccactagccaggatgcccttgcctgcacagctggggactaaggacttcaggtcacagtgatgagggatatttataaagacaaggctttggacctaaaagagaactgggaagctgagcctaagatcttcacatgaagccaggagactataatagaagagctcacctaaaacaagttcgtcagagaaagactgggctaggaaaaaaaccactaaggctgggcacggtggctcacggctgtaattccagcactgtgggaggccgaggcgggcggatcacaaggtcaggagttcgagaccagcctggccaatatggtgaaaccccatctctactaaaaacacaaaaattagccaggcgtggtggcaggcacctgtagtcccagctactcaggaggctgaggcaggagaatcgcttgaacccgggaggtggaggcggaggttgcaatgagctgagatcgcaccactgcactccagcctgggtgacagagcaagactccatctcaaaaaaacaaaaaacaaaaaaacaacacctgcgttttacccagttctgcaatgatgggggtatagatgggagatcttaatgctagatatgttttccctgatactttgtcaactttcatcaaggtctagggttcaaaaatacattatgcttgcacatggaaattccaagccacaaatgaaagtggccccaagtgattgcatcacctggagtctgaaaggtaaatatgcatcctctctggagaaaagcatcttcattttaggtaccttaggagtcccaaagtatgtcctcccaatttaaggggaaaaaaatctgaaacacacaaggaaataagccagtacgcacaagggtcagcaggaaaacttttttaattcttaagaaattaagatactggaattatcagaaacaatataattatgtaaataaaacagagtggaaataaatgagcaaagaacaacagaaaatcaaaaataaccaggaaaattcaagaaagaatcaaacagaactccaaaaacaaaaaattactgaaattaaaaattcagtggatgggttaaataagagactgggcttatgtgaaaaagagtgggtgacctggaatatagacctgaaacaattattcagaataaactatctggataatatgagttaagatacaaagaacaagaggagaaagccttacataaaactgactaagattacaaaaggaaataatagatagaatgtggagagagactatttgaagaaaaaatggcagagaagtttccagaataataaaaaacattaagccatcagacacaggatataacaagaaagataaaggaaatccctatctagacacattatagtggaatattctagaataccgaagacaaaggtaaaccttaaaagcagccagagacctttttcaacaaatagtcccagtacaagtggatgttcataagtcaaaaaaaaaaaaaaaaaaatctcaaaatggatcacagacttaaatgtaaaactagagaatttttttaaaaaaattaaaagtatgagaaaaatttcggaagctagtgctcggcagagttcttacttttgacaccaaaagcacaatccataaaaggaaaaactgataaactgcagaaaaattaaaatcttgtactctacaaaactctattaaaagacaggccatacattggaggctaggcatggtgactcatacctgtaatcccagcattttgggaggccaaagcgggagaactgcttgagaccaggagtttgagaccagcctgggcaacatagggacctcgtttccactaataataaaaaaaaaaaattagctggctgtggtggcaggcacctgtagtcccagctactaagaggctgaggtgggaggattgcttgagccctggaggttgaggctgcagtgaactgtgatctcaccactgtactccagcctgagtgacagagcgagactgtcttaaaaaagaaaaaaaaagaaagacaagctatatattgggaggaaacagctgcaagcaacatatctgacaaagaactagtatgtagaatacataaagaactctcaaaactcaaaaataaaaaaaaacctaaaaatccaattagatataaagtaacatttcacctaacaggatatgcagatggcaaaatgagtacatgaaaagatactcaacaacattaccaattaaagaaataaaaattaaaaccagagtaagttatatatctatcactatatacctaccagaatgcctaaaataaaacacagagacacaactaaatgttgttgagaatgcggatgaagtggatcgcccatatgttcttggtgggaatgtaaagcagtctgactcacccaggaaaacagttcagcagtttctttaaatatgcaattatcatatgacctaacaactgcactactgggcagttatccagaagaaatgaagactgtgttcacaaagaaactaacagcagctttactcattacggtcccaaactgtaaacaacccagatgtccttcaatgggtgaatggttaaacaaactacagtatattcataccatgaaatactactcaacaataaaagtgaactattggccaggtacagtggctcacacctgtaatcctagcactttgggaggctgaggcgggtggatcacctgaggtcaggagttcgagaccagcctggccaacatggcgacactccgtctctactaaaaatacaaaaattagccaggcatagtggtgtgcgcctgtaatcccagctactagggagaccgaggcagaagaattgcttgaacccaggaggcagaggctgcagtgagctgagatggcgccactgcactccagcctgggcaacgagactccatcccaaataaataaataaaacaaaataaaataaaagtgaactattgatacagcaacaaactggaagaatctctgaagaataaggctgactggggcaaaacaaacccaatcccaaaaagggatttggtttataatcctgtaagacacaatctcgaacaccttaatcctgaatggtgaaatcccaaaagatcaaaatgcctaatctaaaatccataatgtctaaaatcccaaaaatcacaatcagaggatactggcatcatgataggtagaactacaactttctcattgtctttatttggaaattaagtacggtttaaggaggtatgtatgggtgctgagttgataagaggtgttctttgggacttaattttaggtgtcaagttgattggattaaggaacacctagaaacttattagtgttttgagtgtgtctgtgcaagtgtttccagagattagcatctgagtgaagccagtggaagacactggttgttcttaaagtatttcaaatgactgcagttataaagctgagcatacacaattaccaaccacagggctatgcattgatacatttccctttttgacctatttctttataaataccactcatctgttcataactgtcatacccatgtgactgtcattagtagagctgagaactgcttatgcttgcaaacatacgtatgttattgttgcctattttattgtgtaaagtggcctgtgtttgtatttctcaaatcctcttttaaaaatgtgaataatcagccaggtgcagtggctcatgcctgtaatcccagcactttgggaggctgaagcaggcagatcacgaggtcaggagatcgagaccatcctggctaacacagtgaaaccccgtctctactaaaaatacaaaaaaaattagctgggcatggtggcgggtgcctgtagtcccagctactcgggaggctgaggcaggagaatggcgtgaacccgggaggcagagcttgcagtgagccaagatcgtgccactgcactccagcctgggtgacagagcaagactccatctcaaaaaaaaaaaaaaaaaaaaaaaagttaataacctgaagtcaggggtttgagaccagcctggccaacatggtgaaaccccatctctactaaaaatacaaaaattagccgggcatggtggcgcacacctgtagtcccagctacttgggaggctgaggcaggagaatcactcgaacctgggaggtagatgttgcagtgagctgagactgtgccactgcactacagcctgggcaacagagtaagactccatctcaaaacaaacaaacaaacaaaatgtaaataaatatcttttaaaggtttttaaaattattctttccagaattacatatttgggattatgattatcagggtttcaaccttcatgatcatggcatttgggattatgtatttccggattatgagtggctccccaaaaggctacataatacagaattccacttatataaaatccttgaaatgacataattataggaatggagaacatatcagtggttgacagaggtgaaggagaaaacagaagtggcagggaagtagacgtggctataaaaggacagcaagaggggtccttgtagtgatggaaattttctgtatctccactgtgtccatgtcagcatcttggttgtgataccatactagaatcttacaagatggtatcactggaagaaactaggcaaagggtacacaggttctctctgtattatttcttatgattgcatgccaatctacaactgatttcaaaattgaaagtttaaccacagcaaaaaagcaatcagaaagaaaagtcacattatatccaaaagaatgacatttggaatgacaaaagatttctccccagtagtaacaaaagtaaaaagatagtagactaattcttcaaagtactgggggaaaaaaagacacacctcaacttagaattatgtacatataaaatcaactttatagaatgaattgaaaatacttttgataaatgtaaactaagagtttgccatcaacagatgtcactagaggaacatcaaaagatgtgcttcagaaagaaggaaaattatcctaggtgaaaggtctgagatgtgagaataataatgaataaacaaacacttctaacatataaagtaaatctaaaccaacaattatctgtacaaaaacagtaataatcacaaggtctaattttttttctaacagatggtgtctcactatgttgcccaggctggagtacagaggctagtcacaggcacaatcgcagtgcactgcagcctctaactcctggcctcaagggatcctccggcctcagccattcaggagccagaactacaggtgtgcaccactgagtccagctcaaggtctaattttaaggtgaaaaatcacaagctataactaaaatactgaatgattttaacacgaaagttgcaagaggggtgacttggagagttccaagactctcaattagagaggaagataaagatataacattatactttttaagtacggatgtaatattccaaggaaattcccccaaaacaaagaagagggggcagaggggtgagggtggaattaaaaaacatttttgattccaaaagaaaaaaaaagagtggaagaaaaaaacataaaaagcacaaaataaggtggtaaggaataaatgcaaatacatcagtacacataaaaatgcactcaactaaccagttaaagttcagattagatttaaaaataattggccgggtgcagtggctcatacctgtaaccccagcactttgggaggctgaggtgggcagatcagaaggtcaggagttccagaccagcctggccaatatggtgaaaaccctgttactaaaaaaaagaaaaaaaaattagccaggcctggtggcaagcacctgtagtcccagctactcaggaggctgaggcagtagaatcgcttgaacccaggaggtggaggttgcagtaagctgagattgcgccactgcactccagcctgggtgacagagtgagactccgtctcaaaatagtaataataatcatcatcatcatcatctagctatatgctgtttatgagacacactaaaacataaggacattcatcaacaaagcaggatagaaaaatctagctaaactatgcgcaatgctatcaaaaaataaaaacgtcaatgaaaacaaattcccagaaaaatgtaataaaaatgactaacattaaagaaatagaaaggctaataattctataatttttgaaacctaatcaatagttaagaaattttctcacaaaaaaatgcaaagttcagacaattttataggcaagctctatccagcttttaaggaacagattaatttaaatgtttttcttttcttccaagagaacagacagagggaaggagagagagacagcactccttaacttattcttagtatccacaatctattaagtataaaaagacaacaatctactactatataaatgggcaaaagacatgaaacaagcttttcagagagcaataaggaatgaataataaacatgggaaaagatgctcagcctcattaacatttaggaaatacaaagttaacttccactctagtcaaaatggagtagcagaggcacgatttaccttctccaccttaaattaaaacctatataaaatgtatacaaggaagtttttcagatgttagacaaaagccagtgcaggacagtgactcctgagagatggaaaacaaagaaagccctataattgcgcaagcttctacatggggtttctaagctgtggcactaaggctagggaagggaacctccctgggtagagaatttaggggagccaaggtaagatttgcagggcagaatattgggtttcccttaagtcttcagctaaacaccaagcagtgtatgcatgtgaggtaaggaacaggagatacaactgggagctcaatagggttcagaatatttcatgttcccaacagacagaatgcagaaaccgtgtaaccaggaagattattcagaacggtattaccttcgtagtgggtcaaattagccctaaactaaaggctgtcccagtcctgtcttattaagcttaaaagcaagctataaaatgatcggattgtttccaagtaactttatgtccccaaacagagttcaagatacttaaaagaactccagcacccaatattaaaaacagaaattaccaggcatgtaatgaaggaagttacaatccaatatgggcagggtgggggttggggtagggtgggaatcaatcaatagaaacagaccagaaatgatgcagatgacagaatgggcaagcacactgaaagagctattatcaatacactccagatgttgaaaaaaaaaaaaatagaggaaggcatgagcatgtgaaggagacacatgggagataaagacccagacagaaattctaaagactaaaaatatgtcggaggtgaaaaatacctggatacgattaaaaggaaattagatactttagacagaaagattaataaacaatgaggacacagcactggaaagtacccaacatgaaacacagagagaaaaaggctttttaaaaagctgcacagaatcagcacactgggagaaaattctgaggggcctaacgtacatccaagtcatcagagccccaggagaagcatgagaggagcagagagaaaaccataacagaagaaaaaatgccccccaatttccaaattctatgaaaaccataaacccacaggtaaaatagctgcagcagcagaaacgtgaaaaaaaaactacagcaagcacatcataatcaaacttcttacaaccagtgacagaaaaccttaaaagcagccaggaaaaaaatgacatcttacacatggaagagcagagataacagtaatcttgctggaaatcacaggtagataccacttaacatccactaggttggcaaatttttaagtctgaacttaagtgttggagatgctatgaaacaaaggtaactcacagtgccaagagaggtataaactagtacagtcacttcagaacacaaatttggcattattttatcaatatatcaagcaatataactgctagatacaatgttcacagcagcattgtttcaacagcaaaaacaaataaacaaaactcaaatgtccatcaagaatgaataagttgtagtatatttatataatactatatagcaataaaaatgaaagaaagtcacagaagtaaacattttgccatttatataaaattcagaaacatacaaaattaacatttcacttacagatacatacgtatgttgtaaaactataatagacaaatgacaaacacaaaattccaaataattatttgagagggagagggccttagggaacttctaaaatgtcgacaacatctgtatcttaagctggctgatgagtacacagatatttacatttattatccctttatatatacgtttatgtatttttgtagtatgaaatacttcattaaaaaaagagtgaaaatgtaagacttcaaaaatgaagactaccatttatgtataacaataaaattagtgtaaaaaagtatacaaagaaaatgttcaattctttatctttccgtgctctatataatcagtattaatctaaagaccataatcctagtatgaaaaaaataacaagctttgacacaaaatctaagcatctgctttcctggcactcttaagttagacaagagtaaatatgttagcctctcaattctgcctcttcatctttcatctatacttagatttttctttatctttggacttctttggacttctgcttcggtctctctttttactcctttctctttcataaagatctgtttggtattttgatttatgactattactataatggccatccctctctcgagatcggctacgacttcggttctgagttcggtctctcttttcactcttttgtttctcccaacagctttcttcttcttcatagtgaccaaaccccatttctctatagatatcctgtcaaaggaagggggaattacaagtgaatcagtaaaataatcattttgtgggcattttcaattaataaaacttagaaaagtctaccattagaaggctgttataacagcttaaatgtgaacactaccactaatgtcaagaatcttgtaaattacaaagcaataaaataattcagaaaaaggtttaacaacgtcattgatttgtatctactattttggctgaaacgaaggatcagcttcaaaaatatggaactgaaatagctcaactgaaatcagaacatgtctctagagcaatctgcaaaatcaaaaattctgattatgtatagtcttattcccagctccccacccttcactcccccaaaacgtggtcccattattgatctgcaatgaaactactaaaattcccataagaatcctataagaagatatcattgaaataacttagcaggaagagatcttagacaagtcagtaagtcttaaataagaaaatggaggctggatgcggtggctcacgtctgtaatcccagcactttgggaggttgaggtggatggatcacctgaggtcaggagttcaagaccagcctgaccaacatggagaaactctactaaaaatacaaaattagccaggtgtggggacgcatgcctgtaatcccagctactcgggaggctgaggcaggagaattgcttgaacctgggaggcagaggttgcggtgagccaagattgccccactgcactccagcctgggcaacaagagcgaaactccatctcgaaaaaagaaaatggataatgtatacttgggtctgagcaattaatttttaaagtgttttattttataacagctcctctctagatgttcaaatacatcttccatgtttagaaagacagaagttagagaggagaattttttttgagacaaggtcttgctgtctcccaggcaggaatgcagtggcacgatcatggctcactgtagcttcaacctcccaggctcaaccgatccttcccacctcagtctcctaagtagctgagaccacaggcatgtgccatcacacctggctaatttttgtatttttttgtagagacggggtttccccatgttgcccagggtggtctcaaactcctgggttcaagtgatcccctcccacctcggcctcccaaagtactgggattacaggcatgagccacctcactcagctgattaggcttatgtcaaaattattatatttctttaaaatgagtttttaaacactggtagaatcctttgccccaaagataataaaattgctacatttaattctactcttagaccacagccaatgctctttcaagagatactttgtaaaatttaactttcttaagactgcccaaaggaaaggaaaattctaaggactaaactcccaagggtctcaactctatcaccagataccactgtagcagacataaatgtcaaggcttaaaattcagagtgatgaatacccatggttaaggactgggttttaagcaaattattagttattccatatactgtctagatactgtacaccttgagtttgacagtgtgtgaaaacagatgtaacaggattgttatagtaataatcacactgtgtaatacagtattataaact

SEQ ID NO: 366 - DNA, 5513 bp, Homo sapiens
actgttcttcttgtctgtttcttactgattctcatgttgcctttttatggactagacactgtagttttaaaattatttatagaaatgacctgagacctatgatatatttttcaagagaggatttacgtttgtttctagctttgcctaggagtcttcaatcattttaattcagtttcagggactgatttgcttttaagcagggctgtagtccctacaggggtggtcaacttcatttcactacctaatatacctattatgtgtggagtactttgctagatgttgggtaggtcttgtgagcagagcagacctctctttggtctgtatggagcacggagcttgattataattggcaggtgtgtgtgtgtgtgtgtgtgtgtgtgtgtaaataaataaatatttatttatttatttattataggccgggtacagtggcttacacctgtaatcccagcactttatgaagtcaaggcaggtggatcacttgaggtcaggagtttgaggccagccttgccaacatggtgaaaccctgtctcttctgaaaatacaaaaattagccagacgtggtggcaggtgcctgtaatcccagctactcgagaggctgcggcatgacagtcactcaagcccgggaggtagaggttgcagtgagctgagattgtgccactgtaatccagcctgggtgacagagtgagactccatctcaatatatatatgcgtgtgtgtatatatatatatctatatctttaagatagatatatttatatagctaagtaattaataaatatattaagttctatgaaagcaatgagtaggctgctatggttgtgaatatttggactacacaggggataagaatgggtctaccataattagcagggacaggttttgtttaagccaaaaactaagagggcttagaacagaaaccgccaggcagaagcagttaccagtgtgaagactagatgacaaccaaaaaagtatgtgggaggagggaggggaggttgcgcagtggggagttgagattgacttagaactgtattaatgagctttccccccaacccccatttttctcccatttaccttcagaaaaattagtgatttggctaccagtgaatctaggctccaggtgtagctctgtagttttggactagttacctaattcttcattcacaacaaaacagaaggagagaggaaaaagagagcaaacatggaattgggatgggaagtaagagagcacatgaggagagagactatgtcaagtttcttcgtattccttttttaattacagaagaaaagatgggataaaaatattccatcttatttctctgtttaaaagaaagagtaggccgggcatggtggctcacacctgtaatcccagcactttgggaggctgaggcaggcggatcacaaggtcaggagtttgacaccagcctgaccaacatggtgaaaccccatctctactaaaattacaaaaattagccgggcgtggtggcgcatgcctgtaatcccagctacttgggaggctgaggcaggagaatcgcttgaacccgggaggcagaggttgcagtgagccgagatcacgccactgcactccagcctgggcaacagagcgagactccttctcagaaaaaaaaaaaataataataataaaataaataaaagaaagagtaaatgaatcaaaatgaagagaagccattttatctgcctcctggatgaagagtttcattgatgaacctgaaatgttttggttaacatgagaaaggagggtgagaagatgcctgagatgtgagctccttgaggacaggagctgctttctctctccagcctggcacaagacaaggaacttagttgaatgaatgagcaaataagtggttctctgctttgaaggaacttggactgtcattaccttgcaaatcaggtttaccatttatttgctttatataagttccagaaagaaactatttcctctcataatattactaccctaaacttctggtctgatctatggattgtagagcttaaatttcctcaaaccccaacagtcagagattgttacaccaagataaatagcatatttctcagcgccttgtattttctgtctttggccacagaccttaggacttaggctgatatttgagaaggaaaaactggaatttagtagaattatacttcctgtatcttaattttccaactcttatataaggtttgctttttctagagagagactaatctggaatgagaatgaattctcatcagtaaaggcaaagctttaagtgggtcatctgactttgcttttgtgctctacattcaccctgctcataaaaggtcctttcatgagttttctaggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatgaatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggctacttagcaagctgcttatggcataatctggggtgggggtgcatagtaaaggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacagtgaaaccctgtctgtactaaaaatagaaaaaaattagctgggcgtggtggcgggcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttcccttccttcccatctgattccttatcagtatttacacatgattagttcttgcctaacctaatagaccctttcttgagtgcaaatcagtggctatttttgctagggtataaaaattacctatctaatcaccttgacaaagttaccctgttatttccaataacttacttcctatggattcttgtagattttcttttttttttttttaatttttttattttcagatgttttctcgctttgtcaccatgcctggcctaaattctcgtaggttttctatgtaaacaatcagattttctgcaagtattagtctcctttctaattgttataattttaatttctttttctttttaaaatttttcgtagagacaaggttttgctatgttgtccagcctggtcttgaactcctgggctcaagcaatcctcccatctcagcctcccaaagtgccattacagtggcatgagccactgtgcctggccaaatttcttttcttgttgcgaaggcagacttttcatacaatactgaatagaagtgatagtagattactttatttctgattttcaaaggaatgctttccgtttctctctgttgaagataattgcgtattgtttttttttttaaatagtaacttttatcaggttaaggaaggtttcttctatttctatttaaaaggattttttaaaatcttgaattcatatgtttttatctaatgcattttctacatcagttgaaatggttgtatgaactcttttaatatgggtgaattatatttatagattttatgttaaaatatccttgtatatcttggataaactcaactggatcatgatttatcttttttatatgctagattcaatttgttgatactttgttatgatttttgaatatatattattgtgtaaaagtgagcctgtgattttctttcttgtaatgtttctgtccagttttggtgcctggttttgctctctccttagaatgagctgggaactagtcactcttgttttctcacctataatagcatctgggtccagtgttttttatgtgggacaaatttgaacttgtggtcaacctctttaattgtaagaatattcaggtcttttgttcttcctgggctagttttttattctttttctagagattcgttcatttttcttagttttatttgcctataattgtggataatctgttttttatctgctacttctgtaattatttccacatttgatttataatattaacttgtgggccaggcgtcgtggctcacacctgtaatcccagcactttgggaggccgaggcgggcggatcacgaggtcaagagatcgagaccatcctggccatcatggtgaaaccccgtctctactaaaaatacaaaaaaaaaaattagccgggcgtggtggcaggcacctgtagtcccagctactcagaaggctgaggcaggagaatggcgtgaacccaggaggcggaggttgcagtgagccgagatcgcaccactgcactccagcctgggcgacagagcgagactccatctcaaaaaaaaaaaaaatttacttgtgtcttctctttttacctgtttgttaatttatcaaataactacttttggctttgtttcatttttattatacaataaaa

SEQ ID NO: 367 - DNA, 22810 bp, Homo sapiens
aatgaaaccatttttgtctcttagtgaatggattttacacctcagtgaacaggtaagagggtttatctttgtgaagtagaagtctttctcatccccttaagaggctacccacttctgcatataaagttaaactatatgagtttgtctccaaaatttataataactggattacctccttgatcccttcaaaatgaagtgtctgataaaaaaagagaattaaatttaaatgtgtcttatgaaagaacattatttaatcaaaagaaagataattattcttctattcttactctccttaaatataaaatgttttcattggttcagaacaatatagccaaaatcacagaattagaaatttattgtatttgaccttattctaaaatgtttattttttaaaacctcacaataaatttaaaaatattaaaatataaatactttggaggtgattattcaaccagtctagcaagttatttgacaatcgttctctgaatgtattatttttcatttctagataattctaaggcactgatagcatttctggcatttctgattattgtgacatcaatagccctgcttgttgttctctacaaaatctatgatctacataagaaaagatcctggtaagagttgattttaaatttttaaataataatggtattagtaatggtgcaaacgcatatccatatggcagtgatggaaccagttaaatgaaatatgtgaactagagagaagacagcatacagcccacttcatgacacaacttttaatcaaaaacttttagtatggttttattggtttgaattaaacattaatattattttctaaatttactaataatgttgtggacttgtttaataataaccagtgaaaagaatgtgtgtggtttttagtacaaagtgggtcagagggatctaggagtgtcaaaagaaaaagaaaggagggagatgtctggggaagttaatgtgtttctttggtcagaaacaaccacatcttatgaaaaacagaagatttaaaataaaatcatttagctacttatgtgagtttagcagacaattcttggttgttttctttcctccctcaccctcctctctcctctctgactctgctttctcccatccttctgtcctccctctgctcaaggctcttcctcccttccctcctttcctcttctcctctcctctcttccccttttcttatccctgacttccttcctttgttccttcaatatattcattaaatataagtaaaataccaattgaattttgtgcttcttgagaatatagaaacttatttttcctattttcacagcaatttagatgaacagcaggagcttgttgaaaggggtaagtatgtatatttttgctgatgactattccttcccctgcatttgaatccattcattttatttatttatttatttatatttattttaagacagagtctcattctgtctcccaggctgaagtgtggtggtgcaatctctgcttattgcagcctccgcctccctgttgaagcaattctcatgtgcctcagcttcccaagtatctgggattacagacacacatcaccaggcccagctaatttttgtatttttagtagagatgggatatcaccatgctgcccaagctggtcttgaactgctggtctcaagtaatccacccaccttggcctcccaaagtgctgggattataggcatgaaccattgcgcccgtccccattcattttaaataagaattgggcatttttagtttaacttggacttttgttgatacagtgataaaacttaaattcctttactcactcagcacctgtgaagttcccagtgtacgccaagcattgtgccaggtactgagagtactacagtgacaggcacagactctgcccttaaagggtttagaatctaatagaggaaagcagatatctcaacaaatatgacggtaatttgatacatgccctagtagttgaatgtgtatagttctatagatatatggaagatagaaaactgtgtgcaagggcagaaatctggtctgttaagattgtggggaaccaatggacaaatgagggagtggtggagggacgagtggatggaagtcacagagatggggagatgggatgtctcctcaagtccctgccagggtggaatggtggctgctcccactaaagacacatttatggattggacaaagaacagcaatttgacttgggagaagaaaacacatttgtttatcttttttttcaacatttatattctttaattttttaaaaatgtgatttctgatccagtaaaaggggacaaagtttcagaaattgaacctttgtttacaataaagaaatgtacttgctttctcatgcttaagacaggaataatttcagaactcctttgtctgtgttaatctgtgttggaagtgtttccctctggtaatagcaggtaccaggtctctatgcagaaactttagggctgaatctttggagctccttaaaaggctttatttttctttgcagaatgtaacactatctgatcccttattacatatttattcatttggtcattgactatcctctcctaactagaatgtaagctttgtgaaagcgtggaggcttttttcttattcactgctttatgcccagtaccaaagtgagtacctaggatttgataaatattagtgaataaataacactgacatagggtatcgtgaggattcattttgataggctgagggaggaatgaagagtacaatcagtaataaacacctgagcagaacaggaaaatccatctcaaggagttaaggtggacttggaaagtgtcaatgaaatattttatctcaaaattggtaccgattgcaccttggaacgcagtagaatttactcactcagaccccatgaaaccctgaatgtggccctcagttcagaatgaatgaataccaggcattcccaacaacctaaagaaacaattgcacatagccagtttgagagctgtgattgtatagaaagtttccatgggcaataagataaatgggtcaccctcatggataacttctttctttatctgataaactggtaaaattaatatgattactgaaagaaacactatcagtagtacatggaagagtaggagaaacataattttacatatgcgacagcttaaattctcttacctttctaaagctgttggttttcaagttccatatgcaattgtagctttttatggttagtatactttttaatcttcagtaagttatttcacaaacatggtatataatgtgtttcatatacttgaagcataacaaattaatacaacttgtttcaccatttagtgtaaacagatgatcaaattaagctgagtcatgggtataagggtattaatcatattgtcttatttcatttgcatgtttacagtatttcacaagttgaaaatgaaaatacaaagaaaaataatattgtattataaataaataattatagtaattgctataaaatgcatatagtcaaacgtgaatgtccttataatggtgatgtttggtctgggatcccttctcttaagcatagaaaatggggaagaacattctagtagagagaacaatataaagcccagaagagatctgaagtacaagattgaaaagtcattgatttataggtaaatgtttgtatgtgagtgagatttctcagatgaaatgtgtacgaggaggaaagaagctaaaggattgagtacacggtgtaaatttaatgaaatgtgtatgcccacctgaaagacacatgtaactagtattgaatctttaatatgtttccagatgatgaaaaacaactgatgaatgtggagccaatccatgcagatattttgttggaaacttataagaggaagattgctgatgaaggaagactttttctggctgaatttcaggtgtgtgttgcttttgttatatgatgataaattcgacatcaagacagttccactttaagtgtatttatattgccatttgcctttataatttatcccacttgatattgcaacataagcaaagtagatattattagcagatctctatgaaccagaagagagactcatagaggttgacgggattatagtgtagagctagtaaatattttaatgtagtgctttattgtattatgaagttgtgtcacaaaatgtatttggctgattttgtagttgtactctagatactcatccaagtatctgtttttaaatgaatttgatagtgacacaacaactaatcctaaatttgtccccactcaagagatttgttctgaaagttgtcaatcattaatttgtaagaaaaaagttttttttttaacataattcctgatcttaattttgattactctaagcaaatttttttatcaatatgaagaaaatattttacaggatatctcatttactcaaaacggtcattggtaagggggaaattatttttcctgaatctgctgtgatccaagaaatcgttgtttctttcagagcatcccgcgggtgttcagcaagtttcctataaaggaagctcgaaagccctttaaccagaataaaaaccgttatgttgacattcttccttgtgagtatttattgagtgctgaattcccatatattaggctacttgattattcactatttcacttgtttatttttcttttccttaaacagatgattataaccgtgttgaactctctgagataaacggagatgcagggtcaaactacataaatgccagctatattgatgtgagtaaaaatttgcatttttcttatacctacatatttcattcagctccttgtttgtcttggtaaaattttagaaatattattaaaaatattttgaagtgagcccatatgtcactgatataaacaaaaaattatcaatattagcaaggatagttatttattatgtgactattggtattaggtataacatagaattttcctctacaaacaaaattatattaagaattaatttaatatactctggtgtctattatgtgctagatattagactaaatattctatgcatatatttctcacaagaagtccacatttgcctcagccatgtgccgtataggtgaggactgggaggctcagtttagttaattaccttgttgttgttcacacaattggtaaatatttgagttgaaattcaaccagagtctgactgactccaaaatgttatgctttaatttcatcacactaaatttcagcagacattcctcatcaacatgatcatctatccattggatttatgcagaaatgtaaatgtccgtacgtggttaatttatttaaaatattttaaaatttaatttattatacaaatgttaattaatgtattacataggttaaataattttaaacagtataaaaatatatacagactgaaaaaattctttttgtctccccaaatctgccattttcccagtgtcctcacctaccagaaataactatattttctattcaaatatatatggtaattatggtatcaggttacttatgtttccccaatggaacttagagctccctgaaagcatgtgtcttctgcttttagataggtgattgacatattgtagctattcaataaatacttattaaataaatgaatgtatgcgcaataatgtgtcatgagatagaagtttcaggaagttacttaaattaatgttgaattcttgtgacccatgtttcaaatttaatccaatggcaaaggtcatccctctctgaagagctcctttagttactgaggtgaatttaggagtctgagataattctggaagaagccagtataatattttatctgcctctgtactcctttatcttggtaacaggagcagagaaagcagacatagtaggtaatgaaatgaaagttattatatctcttatctgaaatggcaaagaagtctagggaatcatattccagcagaagttaagaggtgaaaatgcgggtaaaatctaagaatgatttgtttaaagaaattgagtaaaaatcccaaaagtaactacatggctggtgagcttgtttaaatagtggtagatgatcctataagagttggcaggatataaaatgttgaaatgtctagagcactcttgtaaattaccacagcatcgcagatgaagatgaaacctagtattaaaattgtttgaagtttacagcaaagatacatgaaagtcatgaatattctttgcaaatgctaacatgtttagcacaattaaatgcctgaccaccaattaataagattcccttaatactttgaaactgcccagagaaattcacaatcacaaaatgatggatctgaagcaattcctctaactcacaatttttcctgttaatgagtaattgaatgttcagcaaatgacatatctctgcatgtgttttcaatagggtttcaaagaacccaggaaatacattgctgcacaaggtaatttctttgataatccaatattctttttgaaaaatttttatagcacttttaagaaaatttttcttatcagcttttatttgtttacctcctaggtcccagggatgaaactgttgatgatttctggaggatgatttgggaacagaaagccacagttattgtcatggtcactcgatgtgaagaaggaaacagggtaagaaccaagaagattcatagtgtgggtcttggggttaggaaaacaaggtgttgaatggcattttgaaaagccacatgtatctgcctgatgactaaaacagagagttctctattttaatcagtgttaacatttaatttaaaattttcatacatgtagaaaactaaaacttttaacatacaaatatatgtctatatgcataaaatttcaatgcttctgattaattgctagactcttaacttgattcctgtttctttgcagtattgttataagttcagtatatttcactgttttaacttcacaagaccttaatactcgaaacaaaactgaccttgggcagataggtggtgagtcatgtaatgtgactttaggaataaaagcctctctgtccccctacctaaaattaaccacaagcaatcatatcctttttgctgacaactgattatgtcctctcttaacatgcatctaagcctggaaagatcatcctgctaaaaagtatgaaggaaattcttcaggacacattagtgggaaatagaatatatttcaagcatcacagcttaaggtttatatgtgcttaaactatacaactgttttgagaatttcaaatgagtataggttttgttttcactgtttaaagaaagtttgataaaaaattggcttaaattaaaaattaaaatacttaataattttttaaaatgtagaacaagtgtgcagaatactggccgtcaatggaagagggcactcgggcttttggagatgttgttgtaaagatcaaccagcacaaaagatgtccagattacatcattcagaaattgaacattgtaaatgtgagtttgctttttacataatttttgttttgatacttttttataaaaatataattatggaatattaaaagtgagaaaataaaatatatcaggaaaaattatttttgataacctttaggatgaaagctgtggttagaacaatgacaaaaatcaatagggtcaaatttaagtcactggtcaagacgtttttgtccaactcaaatcgaaagaattatactgtattaattaattatctgttttaattattaaaaaaagagggaaggtccattaaatgtgttgaaaatataatcaaattattaaaagaataagcaatttgtcttcattgtcagtgagttcctacttttatgaaaaaaaattatattatttccataagagaaatgacagcattagagaacactgtaagaagtataaagttctaactatgcagcagagatagaatgtttagttcagaaaataaggaggtcattgtggccttagataatagttaaaatagagatcgtcatgcatgttatataattccattatatgaaaaatccacaataggcaagtcaataaagacagaaagtagatcagtggttgcctggagctgaggaggtcaaacagaaatggggagtggctgcaaataagaacaggctttcattttgtgatggtgaaaatgttctataattagatattggtgatggttgtactatttagtgaatgtaatatgaataccaaattgtacattttaaactggtgaactttatggtatgtaaaatgtgtatctcttatttccaacaaatgaattttatttttaattttttggggtacatggtaggtgtgtatattcatggggtaaatgagatgttttgattgaggcatacaatgcataacaatcacatcagggtaaatggggcatccatcatcccaagcatttatcttttctttgtgttacaaacaacccagttatactcttttggttattttgaaatgtataataaattattgttgaatagtcaccctgttgtgctatcaaatacaaggtcttattcattttatctaattatatttttgtacacattaaccatcaccatttccacccctgccatacccttccaatcctttggtaaccatcattctactctgtatatccaagagttcagttattttaaattttggctcccacaaataagtaacaacatatgaagtttgtatttctgtgtctggcttatttcacttaacgtaagtcctccaggtccatccatgttgttgcaaatgactagatcttacccctttttatggctgaataatacttcattgtatatatgtactacattttgtttatccattcatcagtcaactgatgcttaggttgtttccaaaagttgactactatgaatagtgctccaataaacgtgggagtgcagattatctcttcaatctactgtttcctttctttgcggtatatacctagcagtgggattgctggatcatatggtagtgctatttttagtttttttgagaaacctccaaacagttctacatagttgttgtactaatttactttctcaccaacattgtctgagggttttctttccttcacatccttgcaagcattcattcttggctatcttttatatataagttgttataactggagcatagtgataacttaatgtagttttgatttgcatttctctgatagtaaataatgttgaccacctttttatttatctgtttaccatttgtatgtcttcttttgagaaatgtctattcagatcttttgcctatttaaaaatcagattattagatttttcattataaagttctgtaagcttcttatgtattctggatattaatgctttgtcagatggatagttggcaaatattttccctcattctgtggcttgtctcttcactttgttgattgttttctttgctatacagaagctttctaacttgatgtaattctacttgttcatttttgctatggttgcctgtgcttgtggggtattgttgaataaaactttgcacaaaccaatgccctggagagtttccccaacattttcttttagtagtttcatagattaaggtcttagatctaagtctaatccattttttttatttaatgtttgtatacagcaagagatagggctttagtttcattcttccacatatgaatatccagttttcacagtacaatctattgtggagactgtcctttccccaatgcatattctgggtacctgtatcaaaaatgagtccactgtagagttgtttcattgctctatgtatgtttttatgccagtaccatgctgttctggttactatagctctgaagtataatttcaaattaggtattgtgattcctctagttttgttcttttcactcaggatggctttggctattctgggtcttttgtggtttcatataaatattaggattattttttctatttgtaaagaacattattggtattttgatagatattgcattgaatctgtagatagttttgagtagtatggacattttaataatactgagtctttcaattcatgaacatggaatagctttccattttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtatttaggtttttccaaatataagataatggaatgtgcaaacaagtataattggacttcttcctttccaatttggatgccttgtgtttctttctcttgtctgatggctctagctgggacttccagttgaacaacagtggtgaaagtgggcatccttgtctttatccagatcttagaagaaaggctttcagttttttctcatttaatatgatgctagctgtgggtgtgtcatatatgactttcattctgttgaggtatattccttcgttaccctgttttttgaggtttcttattatgaagagatgttgaattttatggcataatttttcagcatcaattgaaatgatcatgtcttttgtccttcattctgttgatataatgtatcacaataattgatttgtgtatgttgaaccatccttgcatcccttggataaatgccacttgatcaggatgaatgatctttttaaagtgttgttgaattcagtttgctagtattttgttgaggatttttgcatcagtattcatcagggatattgaccggtagttttcttttttttgatgtgtctttgtctggttttggtatcagagtaatactggccttgcagaatgagtttggaagaattcctttctcttccattttttggaatagttagagtagaattggtactagttcttctttaaatgtttggtaaaatgtggtagtgaagccattaggtcccgggcttttctttgctgggaaacttttcatgacaacctccgtttcattacttgttgtctgttcaggttttgggtaccaaaaataatggcaacaacaacttttcaagacatggagagcaaaataacacatgaattgaaacaagaaaatggcaaaatgtggaggaatgaagttaaaatatagcattttcattatattacactttgcttgttagtttgtttacacaatgtctgttgtcttcagtgtaaaataatgcattataagatatgataaccccaaatccaaaagcattcaacagatacataaaaataaaaagcaagaaattaaaacagaccaccagagaaaatcaccttcacttaaaggaagacaggaagaaaagaaagaaggaagaggaggccacaaaacaaccataaaagacataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattctttgtaaatggaaacctaaaaagagaaggagtacctatacttatataacacaggtatatttcaacacaaaaactaataaaagagacaccgattgtctctacataatgataaaggagtcaattcagcaagaggatataacaattgtaaatatatatgcaactaatactggagcacacagatatataaagcaaatattgttagagctaaagagagagatagactccaatacaataatagttggagacttcaacactctactttcagcattaggcagatcacccaggaagaaaatcaacaaagaaacattggtcttaatgtgcattgtagaccaaatgaacctaatagacatttatagaacacttcaaccaatggctgaagaatacacattcttctcctcagcccatggatcattctcagggacataccttatgttatgctacaaaacaagtcttacaaaattaaaaaaaaattatataaacttttctttgactacagtagaactagaaatcaataacaagaataagtttggaaactatacaaactcatggagagtgaacaatatattcctcaatgaccactgattcaatgaggaaatcactaaggaaattttaaaatttttcaaaacaaatgaaaatggaaacacaacaaaccaaatcctgtgtgatacagtgaaagcagtactaagagaaaagtttgtaagagtaagcacctacattaaaaaagaaaaatttcaaataaacaacataatgatacatttcaaagaactagaaaagcaagagcaaactgaactgtaaattagaagaaaaaataataaagatcaaagtagaaataaatgaaactgaaataaaaaaatacaaagcatcaatgaaataaaatgttgtttttaaaaagagaaaattgacaggccaggtgcagtggctcatgcctgtaatcccagtactttaagaggacaagtcgggtgtatcatttgaggtcaggagtttgagaccagcctggccaatatggtgaaaccccgtctctactaaaaatacaaaaaaatattagccaggtgtggtggcatgcacctgtaatcccagttacttgggagactgaggcagtagaatcacttgaacctgggaagccgaggttgcagtgagccaagattgcatcattacactcaagcctgggctttgcagtgagactttatctcaaaaaaaaagataaaattgacaaacctttagtcagactaaggaaaaaagagtggagactcaaatgcgtacagtcagagatgaaaaaagagacattgccactgatacttcagaaatttaaaagattatgagatgctactatgagcagttatatgctaatgaattggaaaacttagaagaaatggataaattcctagatacatgcaacctatcaagattgtaaaatgtctcttgatagagctgtttaaaaaactacaagtctttacatgggggttaagattttctcttaatttcatttattgtagggcttttagtaatctaaattttatttttgtatagtctagctatattttctacaggagaaacagacttagtctatatatctccgtaggtcttcttaggtttccatggtattactaattgttatgtctatagagtgctgtgaaacaatcctatcaatagtttctggccaaacacttgtttgactaagccacaaaggcacctgctccatagatatgaggatatatttctagattgatgcctatctggctacattctgtagtctgggtttactggtgttaattaactcagtttgtgtgtttcttttgttatctaaatgtagatggttctttatacctggccatagaattatgacttatgcatcttatggtggttaccttgaaattagaacaaacctgagctctaatctggggctgactttcctcagtcgtctctctacattctgtgttgacaatgctaccatgtgaaggcctaaggaatacaatgttcatcaaataattaatcagactttgctcacatatgaattagttctgtttgctggcctatcaagcagaagtattttaaacagttgtgagaatgacctttaccaaatcattttaaacacaaatccaaaaagcttccacccatgcaccccacttttatggtgtatgtttattttgggttttttttgcttgacagcatgcaagttcctagaaattttggttatacttttaaagaaagtattaccttacttaccttactgttaagttattgcttacagggtagtacatgcaagtcctgcacaatatcttaactactagttattgattagaaaggaaaacacaaccatggttgagaaaatatataagacacctgaggaaactatgaactcttttgagtagtttatgtttacacgaggagactttgtactggtactcccttccacttatttatgtttcatagtttgctttaaaaaaatcatctcaaagaaaatattatctcttgactagaaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcaggtaggaaaaacgaacaaaaaaaaaaaacaacaacaaaaaaactccaacagaatccacctgcctagggctgttagagacatctttccctttggcaattgctattttgggaaacaacctatgggagaagcttagattcttatattggcttcacacctgacagcttttccatgatcatgcctctgcttttttttgcttggtttgccagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggtatgttctaacctttagtgattattctcactttggttttttggacttaaatcttttccaagtgataataatgatattttttaaaaatccaaattcttcacaacctcaaacagtagatgatttcctgaaaactaaaacgtggtaatcaccagaaatacttagaagcatttttcattagtgcctaaaagtactgtggaagaaagatgaccacaaaatatataatttttaaaataatgaactactgttaacatatatcagattggcaaaaaaagtaaaaatgctgaaaatagatttggcatcatctcataaaattaaactgaagagacagaatagtatagtaatcaacagctggttttagaaactacacttacaggtttcaaatcttgcttttaattattaatacgagggtgagtggtattgtttattaagtaattttagtctgactgcacctcagttaagtcatctgtaaaatggagacaatgataatacctcacagacttataaccacaaaagtaatacaaataaagcacttaaacaagtccctggcccatgctatgcatttggtgattgtaagtgatggtaattactgaaaatgtctgtatttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgatttaaaaaaaacatgaaaatgtacaatgcttgtgattacagatacatagatagcagtgtagaaacataaaaacaaattgttaaccaggtaaaaagaaattatttacagtggaaaataaagtacagtggaaagacagtgccaaactcagggaactaaaggtggcggttaaagaggattatcagaagtataccatttccttgaaaatactggattcaaacaaaataagcagtaaagagtagttaaatctgggtttggcccattggattacaaaaaaataattttcttattaaaagaatacttttcttattttaagttctaaaaactataaaaaaaggttttctaaggaataacaacttgcttttttatctcttgaatatactgtgaaatttattatagttttacattcagtaatttggcttactgacccaataatcactaaaggaagtaacatacaatgttctttagtttttaggaataaaagttgtgcaatacagagtacatggataatctatttgcaaagtaattcttttctgaaaaaataatctgaaaatagaatttgctcatattccagaaaactctgagagtgaacttccagaatatttaaatattatagatatcaatttactttgccatgaattgttccaatatgagcaaatttatggggaatgtatattttatttaaatatgacttggaggactctagattatcagttaactatctgtatttgttcttgaaattgtaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccaggtaatgatagtgacaacaataataataattacagataacttttattcagtgtcatctactttctaggtgtttgctatgcacttgacatagtgcttgcatttagtcttcaccagaaccaaaggagcacagatgagaaaactaggacacagtgagttaagagaaatgcctgaatctacacaactattacataggagatttctttagacccagaaatctgattctattgctaatacttttagccattcctcattaagctggtataaaatgaagtgtcaaaataatagtatatagccacaaaactggtctgccaaaggcaatacagcatatcacctttaaaaatcgtatctggttttggtttgtaaaggaaatcattagaagagtttatgactgcttaggaagttgaactggctggagctggtagacacacagtaaaggataagtacatgtgtcttaacctatttattaggcaattattctcacagctaacctagcatgtagttcactataatttcagagagtttgcatagctgtcctcaaattgctcagttgtcaaaaaaatgttttgtgttttttttgttccacctatgatttccaggttactgagtcattccataatctaccaaactggtaaattcagagtttctaaagaccaggagtgtgcttttaatcacatgcagaaccatttaatgtttaggatcaaagtggggttaaggtgggggtggaggtggagcatgcaataatgaccaagtgactcaatcccccagaagacctgtacttataatggaagaactagcagacacagggtagtctcaaacagagtagtgttttattgttgttttcttgcttttctagctgataaattaaccttattcaatatacctgccctactaatccacataaacacataagctgttagagacagttatacatttaagttaaacattcttatgaatgtttatttactatagaaaagacagacaatttttttcactaaataaatgtgcttgagtttctgctatgtgccaagtacaattctaggcacaagagtcaaaatgatctgcaagtggacatgggaagaaggatgagaggatgtgatccagatcacagatggaagctgtgaaattattccatttaagcagacagtaagacagaagatgagagtagaaatgcaagtcggttggtaaatttggtattgggaagttgaggcagctcttgcctgatgatctttcatttttcaagaaaatgtgaggctaggtcatcagttgagagttgagagatacaagggcgagtagggcaaagaagagctcaatgcttgaagggtataaactagttacctcaaagtataaaaacaatctccctaggcagaggcagtaagattgccagaagttatcatttgatcacctgaaatttatgattataagtttaaagaggaattagtcagttggttgtattgttttctatggcagcattgagctctttgggggtagaggctgtgtatgcagatagttgagttaaacctatctaggttttgaaaagtgactatttgaaaatagtgaggcaaacgagttgagggtgtttacaaatgaatgatgactgaggtggaaaataaaaagcaaattggccacatgagggaggtgagagaaagtagtaaggataataagttggagactttgatagaattacagattgctaggttgaacatatcagaataaatgactaggaataataggggtaattttcaatagcacagatagttgaacttatgattttagaggtgatgtaatatttggaatgaaacctacaaaggtggaatgatgaaagtggatgactgggaagtggagggaaagtcatgggaggtgaagaagctaagaaatgaagagactagagtcttggatagattattcttgtcaatgttgaattaaccaaaaatgatgacagaccttggaaagaagagaatatacttagccaagcctaaaactaaatgaggtggagtgattcagaaatcaatacctgacacttcccagtgaagccggtggatagaagctagtatagtatgatggcaggaatatcaaagtgcttggttgatttgaaagcaaatgagtagaaatggtttgcaagtagaatcagggatcaaggagaacacgtatcttttcttgaagctgtgaggtaaatggggtgtgaggaggaaagtcaactttttcttaaaagggctgctgagttattggtggtgtccttagctgacatccaggttttaattggtggaaagaaaaaaaaaagggtgaagtgactgttgggagaagatgattaagataaatgggagttcacagatgacagacgatgggcatcagagggcagggaggaaggcactgatgggttagatgtaagagactgggttgtatctgaggatacaaataaccattcaggaataaaaatctggggaatgtggatgcactgggaagcttagacttgtgatggcaagtgaaacaggtagagatttaagagtgacagatcctttgtgtcttagatgaaggtgagccattaattccacctataatcctgagtattgctacagggcataggctgcctcggtgactacactcacaagagcacaaggtgttgtaacagtttccaaaacatctggtccttcatgcagctcatggtggtgttcaagtggcctaaaattcagtgatgatattttctttcactcaattacgtagcaaagaatgaggtttgaaacagggtgccataattagtttgaatgagggtactatgctgaaaaaatatatgtctatatacacacacgtatctacatgcgtgtgtgtgtatataaaatcttaccgaattgtacatgaggagccttctcagtttcagttatttgtaacattatctattatcattaaatattattcacttgacaaatacttatttaaggactagtggaaagactgtaggcaggggtgtcttccagaagaaattggtatttaaactgatacctagagggtaagaaaagttattagagcaaccaaaaggggaaagggtagttcaagcaagaaaaaaaaaaaaaagtgtttatgtgccaagagttgaagaacagcttggcccttccaagaattgaggaagctggtttggtagaagtattgagggacccagtaaggtgtaaggctggagaaacagtcaggggcgtatcaataaagactttttatgctattttgaggaggtttgttgtcctcttatagtgatggaaagctgttcatcttcagaagagcatcttctgttttgtgttttagaaggattagagcaggcgagattgaagacaaagaggccagttaggaaattgttgatgttttacaagcgagaaatgaaggcagactggattaagtaggaagaaagaaaactaaaaggatttgtgtatagaaatgatggatcttttctgactaattaggaactgtgggtgagaggaaagcaatctggaaggtgtaaacaaattaagaatgaactttcaaaacatgtgccaagtctcctaagaatgtgttgtctccaaagtttatttctgatcatttaaaataacttaccattgcttttgcaatatagatcaacatcggtctagtggtttcaatttatataagaacaaactatattatttttctatcaagcagctctgaagaaggagacatagtctgttacatatatatctttagtgcatactagccctgtcaaaaggactaaatgcctgagcaatttaaagaaaaaaaatcagaggcaaaccgaaaaattatggcctatagggagcatatgcaaatttcacaaaaattaatgaaatgcttttccttagggagcatcttatgatgcaataagccaatatttacattttaaaggagtttttctgttttttttttttttttcagagacttccttcatataggagctggaggacacagcacattggaaatcaagaagaaaataaaagtaaaaacaggaattctaatgtcatcccatgtatgtagtttatttttttattttttgtatcagataaagttaagctcttttggatttgtttaatgtgggacacacagtcatataaattatcttgaagcaagttttcaacatttggttgttaatagggaagaagttactaggtattaaaatactagttattgcaagaacttataatcctgaacatttacaatgggctttggagggtagactgtattcagtgttttctttttaccaattatttcagaaatgggttgtcataaaagagaaatatataaagctgggagaaaaaagagcaagtctcttttacccattttctttcatttttagtttatttcagttatttactccagggtaattgacaaatagtaaaaattacatccatttgttctctatatgtttcctttttatcccttataactgggaggttgaaagtaaggggaaaatactctataaattctaaatcttcaaatttaacagatcaaaatatgcacagtttcaatacttgaattctactatttaagcatattaaaatgatcacatatggtaattttattcagctgcataaactaaaattagcatggataaaatataacacaagttgataaattagatgaccaaataaatcagatcagtgcatggttgacctagttaattttcataggagtccttatgaatgtagtttaaaatatggaattgatggtgatatggttaatcaaatcatttgaccaagttattataaattatagaaattaagaaacagtgagaaattataggtcaaataattttctgggctaaataattaatcaaagctacccatataagattgttaatttaatattactggagtataattgagggaaaaaatctacgctatgtattttgtaaacttatatcaagcagaattataatagtccatgggaaattaaagtatatgtatcaaagattaaataatcatatataatgatatgatatctctttgttgtttgacatggaattatgttccatgttttttcctggaatcctttttcttagacttttgttgtataatttgtttatcgacaagtactgaattttatataggatcttatttcatgtagatcagtaagttttcataatacaatctgtccctttttaaatactttcaaatttccacatgacaatgaagaagaaatttaattttttcaaggaagacttactactgatttatttcacatagatgactataacagagtgccacttaaacatgagctggaaatgagtaaagagagtgagcatgattcagatgaatcctctgatgatgacagtgattcagaggaaccaagcaaatacatcaatgcatcttttataatggtaggtacttaaattgccaaaacccaagatccaaacattttaaaataatatctatgttattagggccattcattaagcgattttataaaagaataatgagcttggtcataactacatatagattgacatgagagtttcaatttcaatgctacaatttaacttaatgaaagatttaaaaatactataacctaataacctgagacaaaataagataatgctattggttatattttatgacaaatatagctataatcacatcaattttaaaaatagtaaaatttgagcaaatacaagtatttgaaaatgtttatacatactcagatacccaaattgtaggcaatgacaaatttgtatatttgtatggttagaaacttttcattcagataaactgaattattaggtgagtctgtgtcatatccccccacttttttaattaactgagaattcaaacaatgaaactttagtcatttattaaatatttattatttatacactgttggatttacttattttccaaagtttcctaaagcacacattcatagaatattagtttaattaggaaatataataagaatgtaaagacactaattaaaattagtatagacacgatgaaggtaatttgaaatgcttaagtaattcctttttacaatcacattaacctttatagagaaacaaaaatgtgtgtcttttgtggaaaggaaaatttgtttcgcaagatatgttgtaatcttgatttcacattattagctaagaattactattatctgtataattattttacatatagctattacattgtttcttgtaagaaacataagaatattactatttgtatgtaacagcattgatatcaaactgactatatttccaaatggttactttaagaatctactgagctctcttctgtagtaacgaagtcccaccctttttttgtctaaaaagagctactggaaacctgaagtgatgattgctgctcagggaccactgaaggagaccattggtgacttttggcagatgatcttccaaagaaaagtcaaagttattgttatgctgacagaactgaaacatggagaccaggtttgtacttttgag

SEQ ID NO: 368 - DNA, 179399 bp, Homo sapiens
gtggattatattctcatcctcaaatcaaagacctttatactcagtcctgcattcttcctgcatggccgtttgtgtatgtcaggatgccatttgggaaacaaaatccactctaattattcctaagcttagtggattttaacatggaaggagaagcctaaatcagcagtgtctgggctgggtctccaggaataactcttgacctcgaagcattgacccacctagggagctgctgtgtctgctccatgaagaaggtctggaggcggcatccaccccctgcactcatatctttgggttcgtgtagacagtactgcagaccctttctagggaggagaggcctgggctcaagacatagcagcctctgccagaagtgtttcttcaggatgcagctgtgcctgccagtgccaacaccctcagcagctcaaatcggcctccatcccctgccctgccagtagcatgagtgtgtctgtttgagggaactcggttcacgtctaggatcctggctgcacgggagtcagagtagaggattagagcttcttgtcactgtagggcaggatgtcctgcccaggggacaggcagggtgaggtgagcagtagggctttggtggtgagaactttcctgaaacagcccctcctacgtgctcagcaagagggaaagggcgttccactggcccccctagatgggtaagagcacttggccagaaggtgggaggaaccacgtttgaaactgttggagcagaaattgtctagatgtaagttctgagctggcaggtgagaggcttgtcaggttcttaggcccccaggacagagaattggattgtgttcaatccttggtgtgtgtcacacgcattggtcatgcatagcctgcttttctctgttagttacttgtaacaacctactgagcaatgcaaatcctcctccacatgaaggctccaccttggcagtggcctacattggtcgcgtcagcttgagagagcatcatgcccctagtgctgtctaaatgttcactgcctcacgtaaccctcacaacagcacagtcagatgtgggctctggtgactctgcttcagaagagaaagctgcagcccccagatagtaagtaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggctgtgttcacgctccaggagactccactaaacacccagcagggagagacacagcacatcagctgggaggtggagtgacttgggaagtgggcttgactgactgggagaggtgcacagatcctctgtgggtgggaggagggtggggcctctgctgctcaccagagggttccacagagggtgtcacacgtcagaaaaaagaaatggcttcgtttatcacttatatcaaactgattgcttctttctcttttgtttttctccttctgtttacaagattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccacacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtcccaggcagggaaggaagagggtcttaagaggcgtcaggatgggagtggtgaggatggtaagagtagagagcctccaacctgaaaatgtgacctcttaccttagaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccagctctgctgccgccatgctaggatgtggggccagggcatgggaatacttttcagcaaatctgtgagcccttggccctggaagggcttgcccaagcctctacccagcatctggatacagttggaactgggtccagaactgagtccagctattcccactgtaaccagaggatgccaagcgctgacacagtgtgtgcagacagtcccagtggccccagacagggatcctggggctggtaggggcctgggggagggcagggtgactcaggttgtgtgcaccttctcatgttcaccctcccacatgcccttggggcagttggctttcctgaaagtctctcggatgcccgcgctaaggcagagtcaggaggccagggacgggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggtttctaaacttcactgaaagaattggatgagacaggatcttccccctcggtgggattggacacccctactcacagtcatgcctgggccgtcacttattgcagatctgcctgtgaggggagaatgtgccagtttctccttggaccctacaactttcaccttcagcccctatactcctgtatgccctgagcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaatatcttttacacattcatttgctctttggaatcaatttcccccctttttgccaaggtgcggggttcttatctgcctcacgttgagtgtattttgcattggtgtgtgttcaggaagtttccatgtcctaaatccagcaagcatgtgagaggctgttcttggagcacagccacaagcccaagccctggagtccctaagagagcagagtctactctgagaggcaaggttgaccaaggagctgtctgctcagctcggccagtctctcagaggtgctgggggtgctgctctgagtgggatggactgagattgccctggaaaccttgcactgcagcacccccctttgcccctgaccacctagatacaaaatttgccctctgagtgggagtcagcactgggagtgcatggatatgccagccactgccacaggcgagcagtgccagcaaagccacaaggagggaatgggcttggcagtgtggccaagctctccctttgcctctgccctctgtacctatccagctgtccccagggactagaaaggctaacatgctggctgcctgggtcccaaaggcctaccatccagtgcagtttgcttaccatgctcctggcactgcacttttggctctgtgggcagtgagacagacatcatggaacatgtttacagaggagacagtcccccaggccactggaaaattgaaactgatgagggtggggtacgggaaaccaggagatccagcaggaagaagttgaagctgtccagaaagctctctctgaataagggctgctaagttgccatcttcaaggtccagaaagctctctagggaaagaggaaagaattccagagaccccaggccaggcctgtgaaagttatgagaaagagcttcttgctggcatacagtagggtctgcaggctccccgatacctaaaggcattggaccagacacttctggtggctacccagggcctggcagttctttaccccaggagcaagcctaggggaggcagggagcagtgtatccctaagactggtactgctggagtgggtctggtcctggaaaggagggagcccccaaggctggctatagaaactcaaaagatgtctgtattaactttttcggtgggggggtggttttgttttgttttggcagcatagaaacaattgattctctatattgtgtatccagaatccttgctatttttttttttttcctaagacggagtctggctctgtcgcccaggctggagtgcagtggctcgatctcagctcactgcaacctccgcctcccaggttcaagcgattctcctgcctcagccacccaaccagctgggattacagggacgtgccaccatgtccagctaatttttgtagttttcgtagatacgggctttcaccatgttggccaggctggtctcaaactcctgatctcaagtgatccgcccgcctcggcctcccaaagtgttgggattacaggcgtgagtcaccactcccagccccaactctattttttttttcttttttctttttttctatttttgtagagacgggggtctcatcacgttgcccatcctggtctttaactcctcgcctcaggcgatactcctacctcagcctcccaaaggtgctggaattaaaagtgtgcgccaccgcgcccagcctagcccagtacattattattacacacaaatggtgtttgtgttttagtgtttcatcaagaaagatgtttgctgtaggttctagttagataactgtcagatgagggaggttcattttcctaccatgagataagcatttatctttttttttttttttttgagacggagtttcactcatcgcccaggctggagtgcagtggtgcaatctctgctcactgcagtctccgcctcctgggttcaagcaattctccagcctcagcctcccgagtagctgggattacaggcatgcaccaccatgcccggctaatttttgtatttttagtagaaacgggattttaccatgttggccaggctgccctcaaactcctgacctcaggtgatccgcctgcctcggcctcctcaaaagtgctgggattacaggcatgagccatgacacctagtggcatttgtcttcaatttctgttttttgtttttgtttttttttaacgagacagattcttgctctgttgccaaggctggagtgcagtggcacaatctcggcttactgcaacctccacctcggggttcaagcgattctcctgcctcagcctcctgagtagctaggcatgcaccagcacgcctggctagtttttgtatttttagtagagacagggtttctctatttttgtttttggtcacaagtgaatgttcaatcttaccagtcctttttctgcttctattgagacaagatttgtttgcctctctaatcagttaatgtattgggtaacatagttatatgttgtttaactacagggatatgttctttttttttttttttttttttttttttttttttttttccagagacagattttcactctgtcacccaggctggaatgcagtggcatgatctcagctcactgcagccttcacctcccacatacaagcgattctcctgcctcagcctccagagtatagctaggattacaggtgtgcaccaccatgcccagctaattttttctgtttctagtagagacagagtttcaccatgttggccaggctggtctcgaactcctgactgcaagtgatccacccacctcagcctgccaaagtgctgggattacaagcgtgagccactgcgccccaccttacagggatatgttctgagaaatgtgttgttaagctgggctctgtggctcacgcctgtaatcccagcacttggggaggccgaggtgggtggatcacgaggtcaggagttcaagaccagcctggccaagatggtgaaacccgtctctactaaaaatacaaaagtagctgggtacggtggcaggcgcctgtaatcccagctacttgggaggctgaggcaggagaatctgttgaacctgggcagcagaggttgcagtgaggcaatattgcgccactgcactccagcctgagtgatagagtgagactccatctcaaaaaaaaaaaaaaaaagacaaaaagaaatgtattgttaggcaattctgctgttgtatgaacattgtacagtgtaatgtgtaattaaacctagattgcagagcctactacacatctaggctatgtgatatagcctactgctctgggctacaaacctgtacatgttactgtactgaatactgaaggcagttgtaacacgatggtaagtatttgtgtatctaaacatagaaaaggtacagaaaaggcagggcgtggtggctcatgcctgtattcccagcactttgggaggccaaggcaggcagatcacctgaggtcaggagttcgagaccagcctgaccaacatggagaaaccccatctctactaaaaatacaaaattagccaggcgtggcggcacatgcctgtaatcccagctactcaggaggttgaggcaggagaatcgcttgaatctaggaggcagaggttgcagtgagccgaaatcatgccattgcactccagcctgggcaacagagactccatctaaacaaaaaaagagaaaaaatggaggctgagtgcaggggctcacacctgtagtcccaacactttgagaggcagatgtgggaggatggcttgagctcaggagttcaagaccagcctgagccacatagtgagaccctgtctctattattattattattattatttttttttttttgagatggagtctcgctctgttgcccaggctggagtgcagtgggcgatcttggcttactgcaagctccacctcccaggttcacgccattctcctgcctcagcctcccaaatagctgggactacaggcgcccgccaccacacctggctaattttttgtatttttagtagagacggggtttcaccatgttagccaggatggtctcgatcttccgacctcgtgagccgcctgtctcggcctcccaaagtgctgggattacaggcgtgagccactgcgcccagccatgtctctattatttttaaaaaataacaattaaaaacaaaaaccgtgtacattagcctaagtctacacagggtcggggtcatcatcatcactgttttccacctcttcctcttgtcccaccagaaggtctgtagggccgataacacgtggagctctcatctgcggtgacggtgcctctggaatacctcctgaagaacctgtgagactgttttgcaattgacttcttttttttttttttttttttttttttggaacagcatcttgctttgtcacctgtgttggagtgtggtggcacaatcatggttcattgtcattgcagctttgacctcccgggctcaagtgatcctcccaccccagcctctcaagtagctgggactataggcaccaggcctagctaattttgtttatattttacagaggcaaggtctcactgtgttgcccacgctggtctcaaagcaatcctcctgtcttggcctccccaaagtgctgaaacacaggtgtgagccactgtgccaagcctaaccttttttttttttctttttttttttttttttaataatagaagggccgggtgcagtggctcacgcctgtaatcccagcactttcggaggccgaggcacgtggatcacctgaagtcaggagtttgagacctgcctggccaacatggtgaaaacccatctctactgaaaatacaaaaattagccaggtgtggtggtgcacacctgtaatcccagctactcgggaggctgaggcaggagaataggagaatagcttgaacccgggaggcaggggttgcaatgagccaagatcacaccactgcactccagcctgggcgacaagagcaaaaccccatctcaaaaaaaaaaaaaaaaaaaataataataataataataataataatagagtacaatcttaaaatataatgactaagccagtaacatagtcacttattaagtatgtactgcacataaattatatgtgctataactttatacaactggtggcaccgcatgtaacaatgtactacaacatgacagctaagctgtcactaggcaataggcatttttcagctccattatactcaacgggaccaccattgtgtatgtggtctgctgactaaggtctacagcagcacatgactgtatttgattttctagcagacactatacttgcatttctctgataacttcaccctattcatgatactttgtccttctatatgtttgtttgtttgtttttgttttgtttgtttgttttttttgagatggagtagctgggattacaagcacccgccaccatgcccggctaatttttgtattttcagtagaaacggggtttcaccatgttggccaggctactcttgaactcctgacctcagatgatctgctgtccttggcctcccaaagtgctgggcttacaggcgtgagccaccatgcctggtcactactgtacatttcaagacccccagtggatgcctgaaacctcagtaccaaattgtatatatattggttttttcttatacgtatgtacttacacatgataaagtttaatttacaaattaggcacagtaagaggttagcaactaataaaatattgtatatgtagtactttttttttttttttgagatggagtcttgctctgtcacccaggctggagtgcagtggcatgatctctgctcactgcaaactccgcctcctgggttccagcaattctcctgtctcagcctcctgagtagctgggattacaggcgtgcaccaccgtgcccggctaatttttgtatttatagtagagatagggttcaccatgttggtcaggctggtctcgaacccctgacctcgtgatccacctgcctcggcctcccaaagtgctaggattacaggcgtgagtcactgtgcccagcgcagtactttcttttccagtgttttgtgtgtgttttgtagagacagggtctcactatgttgcccaggctggtattgagctcctggcctccagcaatcctcctgaatatggtctgaaaatatttcattgtagtgtgtgctatgagtaactgtgttctcaaagcaaaaacatagaaagcggtgtactgctgtattatattttaagattcattaatgtttgtagttcatttttctcactgtatattattttattagatggatatgcttcaatttatccactatttgggtcatttaagttttggggctaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagttttggggctaatagccaaaaaatgagcgttctgtgtgtctcttttggtgcagttttgctcgcatatctaatggatatatacttaaaagtgaaattactggactatagagtacgaacatactgaaaagctcacaaatatatggaaattaaatagaacacttaaccaatgggtcaaagaagaaatcacaagagaaattagaaaataccttgaaaagggtgaaaataaaaagaaaacataccaaaatttatgcagcagaagctctgctcaggggaatatttgtagatataaacaactacattaaaacatctcagccaggcgcggtggctcacgcctgtaatcccagcactttgggaggccaaggcgggcagatcacgaggtcaggagatcgagaccatcctggctaacatggtgaaaccccgtctctactaaaaatacaaaaaagttagccgggcatggtggtgagcgcctgtagtcccagctactccggaggctgaggcaggagaatggcgtgaacccaggaggtggagcttgcagtgagcctaggtcgtgccactgcactccagcttgggtgacagagcgagactccgtctcaaaaaaaaaaactcaaaccaatacataattgtataccttaagaaacaaacaaacaaaaaactaaataaaaagttagcagaaggaaggccataataaagattagagtcaagataggcccggcgcggtggctcacacctgtaatcccagcgttttgagaggcggaggcaggtggatcacctgaggtcaggagttcaagaccagtgtggccaatatggtgaaaccccatctctactaaaactacagaaattagctgggcgtggtgatgcacacctgtaatcctagctactagggaggctgaagcatgagaatcgcttgaacccgggaggtggaggttgcagtgacccaagatcacaccattgcactgtagcctgggcaacagagtgagactccatctctaaatacataaattggctgggcgtggtggctcacgcctgtaatcccagcactttgggaggccaaggtgggcagatcacctgaggtcaggattttgagaccagcctggccaacatggtgaaaccccgtctctactaaaaatacaaaaattagctgggcatggtggtgggtgcctgtaagcccagctacttgggagactgaggcagaagaatcgcttgaacctgggaggtggaggttgcagtgagccaagattgcaccattgcactccagcttgggtgacagagtgagactccatctcaaaaaaaatagataaagaaaccgggcggcatggtggctcacgcctgtaatcccagcactttggggggccgaggcaggcagatcatctgaggtcgggagttcaagaccagctcttgaccaacatggagaaaccccatctctactaaaaatacaaaattagccaggcgtggtggtacatgcctgtaatcccagctactcaggaaggctgaggtgggagaatcacttgaacccgggaggcagaggttgcggtgagctgagatcccgccactgcactccagcctgggcaactagagcaaaactcggtctcaaataaataaataaaagaaaaaattaaaaagttaaggatggctgggcacggtagctcacgcttgtgatcccagcactttgggaggccaaagcaggtggatcacaagatcaggagacccagatcatccaagtaacacagtgaaacaccatctgtactaaaaatacaaaaaattagctgggcgtggtggcgggcgcctgtagtcccagctacttgggagggtgaggcaggagactcgcttgaacctgggaggcagaggttgcagtgagccgagactgcagcactgcactcccgcctggcaacagagcgagacttcgtctcaaaaaaaaaaaaaaaaaaagttaaggataggacatgactaccgactttacagaagtaaggattatcacacactactgtgagcaactgtttgccaaaaaatgggataatatagatgaattcctagaaacacactaccaaaactgattcataaagaaacagaattaaatagtcctgcagcaagtgaaactgcaacaatcgaaaacttcccaacaaagaaaagcccaggaccagatgacttcactggtgaattattttttatttatttttttaattttttgagatggagtctcactctgtcccccaggctggagtgcagtggtgcaatctcagctcattgcaagctccgcctcccgggttcaagcgattctactgcctcagcctcccaagtagctgggactacaggtgcccgccactatgcctggctaattttttttttttttgtatttttagtagagacggggtttcaccgtgttagccaggatggtctcgatctcctgacctcgtgatccacccacctcagcctcccaaagtgctggaattacaggcgtgagccactgcgcccggccttttttttttttttttttttgagatggagtctcactttgtcacccacgctggagtgcagtggcacgatctcggctcactgcaacctccgcctcccaggttcaagcaattctccagcctcagcctcccgagtagctgggattacaggcgcccaccactacgcccagctaattgtttgtatttttagtacagacgaggtttcatcatgttggtcaggctggtctcaaactcctgacctcatgatttgcccaactcggcctcccaaagtgctgggatttttttttcttttttctttttcttttttttgacagagttttgctattgttgcccaggctggagtgcaatggcgtgatctcggctaactgcaacctctgcctcccaggttcaagtgattctcctgcctcagcctcccgagtagctgggactacaggcacctgccaccatgcccggctaattttttgtatttttagtagagatggggtttcaccatgttagccaggatggtctcaatctcctgacctcgtgatctacccacctcagcctcccaaagtgctgggattgcaggcatgagccactgcacccgaccttcactggtgaattctaacaaacgtaaaagaaaataaagactaatctttctgaggccaggcacggtggctcatgcctgtaattccagcactttaggaggccaaggcaggcggatcacctgaggtcaggagttcgagacaaaccttgctgaggtggtaaaaacccatcattactaaaagcacaaaaattagccaagaacagtggtgggcgcctgtaatcccaggtactcaggaggctgaaaccggagaatcgcttgaacctgggaggcggaggttgcagtaagccgagatcgtgccattgcactccagctggggtgacaagagcaaaactctgtctcaaaaaaaaaaaaaaaaaaaaaaaaaaggccaggcgtggtggctcacgcctgtaatcccagcactttgggaggccaaggcaggtggatcacgaggtcaggagatagagaccatcctggctaacacggtgaaatcctgtctctactaaaaaaaaaattagcagggcgtggtggcaggcgcctgtagtcccagctattcaggaggctgaggcaggagaatggcatggaggcaggagaatggcatgaactcaggaggcggagcttgcagtgagccgagattgcgccactgcactccagcctgggcgacagggcgagactccgtctcaacaacaacaaaaaaaagactaatctttctcaaacttcattgtaaaatgaacgggaaagaaaactttctcactcattttgtgaggtcaatagtaccctaatactgaagccacctaaagacgttgcaagaaaataaaactgcagaactggccaggcgcggtggctcacgcctgtaatcctaccactttgggaggctgaggcagatggattacctgaggtcaggagttcgagaccagcctggccaatgtggtgaagaaaccctgtctctactaaaaatataaaacttagctgggcgtggtggtgggtgcctataatcccagctactcgagaggctgaggcaggagaatcgcttgaactcaggaggcagcagttgcagtgagctgagatcacgccattgcactccagcctgggtaacaagagtgaaactctgtctcaaaaaaaaattgtagaacaatgtattttattaatatagatgcaaaaatcctaaacaaaacaccttttcatgataaaaacccaagtgcagaagaaaactatctcaacattataagggccatattaaaaggccacatttcgccaggcgtggtggctgatgcctgtaatcccagcctcagcctttgggaggcctaggcgggtggatcacttaaggtcaggagttcgagaccagcctggccgagaaggtgaaaccccatctcaccgtgtgtacaaacactcattttgtatttctaaaactataaaaattagccgggcatggtggtgcacgcatgtagtcccagttacttgggaggctgacgcaggagaatggcttgaattaaggaggcagaggttgcagtgagctgagatcatgccactgcgctccagcctgggcgacagagtgagattctgtctaaaaaaaaaaaaaaaagaaacccacattaatattatattcagtggtgaaagactgaaagcttgaaagcttgtcaccttagatccagaaacaagacaagaacgcttgctgttgccgcttctactgaaccaaatactggaagttctagtcagagcaattaagcaagaaagaaacaggctgcatccaaattggaagtgaagaagtagaactatctctgttcacaaatgacatattatatatagaaaaccggccaggcatgggggctcacgcctgtaatcccagcattttgggaggcccaggtgggcggatcacttgaggtcagaattttgagaccagcctgaccaacatggtgaaaccctgtctctactaaaaatacaaaaattagccgggcatggtggcgggcacctgtaatcccagctacctgggaggctgaggcaggagaattgctggaacccgggaggcggaggctgcagtgagccaagattgcgccactgcactccagcttgggtgacagagcgagacgccatcttaaaaaaaaaaaaaagaagaagaaaagaaataaaaagaacttgtgtatcaaaggatgctatcaagagtaaatggcatatttgcacataatttacaaaataaaattttttaaatatgaaaagacaacctgcaggatgggagaacatttgcaagtcatctgatattggattaatactcagaatatataaagtactacaactcaacaacagaaacagacaacctgccaggtgcggtggctcacgcctgtaatcccagcactttgggaggctgagccgggtggatcacgaggttaggagtttgagaccacgctggctaacatggtgaaaccccgtctctactaaaaatacaaaaaattagccgggcgtggtggtgggcgcctgtagtcccagctactcgggaggcggaggcaggagaatggcgtgaacctggaaggcggagcttgcagtgagccaagatcgcgccactgcactccagcctgggcaacagagcaagattccatctcaaaaaacaaacaaacaaacaaaaaaaccacagacaacccaatttgaaaatggacaaaggacttaaatagatatttctccaaagaaggtatataaatggcctacgtactccaggggttcacatgggaagattgcttgagcccagggggtcaaggctgctgtgagccatgaacggtgccactgcattccaacctgaatgacagagcaagacgctctctctaaaaaacaataaatgaaaaatttaaacagtagaggttaccacagcctgagggtagggggaatgtaaagttactgtttaatggctacagaatttctgtctgagatgataaaaaaaagttctgaaaatagtggtaaaagttgcccaacattctgaatatagataatgccacggagttgtacacttaatgattaaaatagtcagttttggctgggcacgatggctcatgcctgaaatgccagcactttggagggctgaggtgggtggatcacaaggtcaggagatagagaccagcctggccaacatggtgaaaccctgtctctactaaaactacaaaaattagggaggccgaagcgggcggatcacctgaggtcaggagttcaaaaccagcctgactaacatgaggaaaccccgtatctaccaaaaatacaaaattagccgggcgtggtggtgcatgcctgtaatcccagctacacgggaggctgaggtaggagaattgcttgaactcaggaggtgaaggttgcggtgagccaagatcacgccattgcactccagcctgtggcaacaagagcgaaacaccatctcaacaaaaaaaaaagaaagaaaaagaaaaagccaggcactgtggctcacacctgtaatcccagcactttgggaggccaaggtgggtggatcacgagctcaggagatcgagaccatcttagttaatgcggtgaaatcccatctctactaaaaatacaaaaacttagccaggcatggtggcacgagcctgtagtcccagctacttggcagactgtggtggcgtgcacctgtaatcccagctgctagggaggctgaggcaggagaatcgcttgaatccgggaggcggaggttgcagtgagtagagattgcgctgctgcactgcagtgtgggcaacagaggaagcctccagctcaaaaaaaaaaaaaagttttggctcgatgtggtggctcacacctgtaatcccagcactttgggaggccgaagcgggcggatcacctgaggtcaggaatttgagaccagcctggccaacatggtgaaacccggtctctgctaaaaatacaaaaattagccgggcgtggtggcaggtgcctgtaatcccagctacttgggaggctgaggcaggagaattgcttgaacccaggaggtggaggttgcagtgagctgagatcgcaccattgcactccagcctgggggacaagagtgagacttcgtctcaaaaagaaaaaaagtaagttttgtattatacatattttatagcaatttctttttttttcttttttttttttagacggtttctcactctgttgccaggctggagtgcagtggcttgatcttggctcactgcaacctccacctcccaggttcaagtgattctcctgcctcagccttctgagtagctgggactacaggtgcgcgccaccatatccagctaattttttgtatttttagtagagacggggtttcaccatgttggccaggatggtctctatctcttgaccttgtgatctgccagcctcagcctcccaaagtgctggaattacaggtgtcagccactgtacctggccaacaatttcttaaaatgcaaaactaaacaaaaggagagtttagcataaaataatatgaaatacataggaataagtctgacaaaagatgtgtcaggcaagtacactaaacctcaaaacattgctaagactaaataaatgtatataaatatagctcacgaactggaagatgcaataatgtttagatatcactatctacaaattcatctgtacattaccacaatctttgttaaaattgaccagatttttttaaagaaattgacaagctgattctcaaattcacatgaaattcacaggaatttcatatgaatatgaatatgcaaaacaacattggaaagaatagtctggatgaagtggctcacgcctgcaatcccagcactttgggaggccatagcagaggatcacttgagcccaggagttcgtgaccagcttgggcaacatagtgagaccccatctctacaaaaataaaaataaaaaaatagctgggcatagtgataggtgcctgtggtcccagctactcagaaggctgagatgggagggtcacttgagcctgggaggtccaggctgcagtaagctgtgattgagccactgcactccagcctgggtggtagagtgagatcccatttcaaaataaacaataaaataataaagttggaccgggtgcagtggctcacgcctgtaataccagcactttgggaggccgaggccggcggatcacaaggtcaggagatcgagaccatcctggctaacagagtgaaaccccgtctctactaaaaatacaaaaaaattagccaggtgcggtggcaggcacctgtagtcccagctactcgggaggctgaggcaggagaacggcatgaacctgggaggcagagctggcagtgagccgagatagcgccactgcactctagcctggacgacagagcgagactccatctcaagaaaaaaaaaaaaaaaaaggctcatgcctgtaattccagcactttgggaggccgaggtgggtggatcacgaggtcaggagttgaagaccagcctggccaagacagtgaaaccccatctctactaaaaatacaaaaaaattagcctggtgtggtggcaggtgcctgtaatcccagctactcagaaggctgaggcaagagaatcccttgaacccaggtggcagaggttgcagtgagctgagattgtgccattgcactccagctgggtgacagagtgagactctttctcagaaaaaaaaaaaaaaggtaagcatatctcttccatatgaccactcttaggtgtttacttaagagaaatgaaaacgtgtttatatgatgacttgtacatgaatgttctggtgtttttgtttgtttgtttttcggtttttttaatttatgaatgttgatagtaactgtaataaccaaaaactggaaacaaccaaaatattcatcaacagataaatgtataaacaaactatgagacatccatgcagtggaataccactgagcaatgaaaaggaattttttttttttgagatggagtctcactctgtcgcccaggctggagtgccgtggtgcgctctcggctctctgcaacctccgcgtcctgggttcaagcgattctcctgcctcagcctcccaagtagctgagactacaggcgcctgccaccacacctggctaaatttttgtatttttagtagagacggggtttcaccatgttggccaggatggtcttgatctcctgacctcatgatccgcccacctcagcctcccaaagtgttgggattacaggcgtgagccactgtgcctggccaaagaatgcattattttaaaaacgtttttgttatataaattctttttattttgcccttattatgtttcattgacatataattgtacatatttatgaagtacagtgtgataatttgatacatgtatagaatgtgtaatgatcagagtagcatatccatcaccacaaacatttattatttccttgtgttgcgaacattcataatctactcttctgcctatttgaaaatatacagtaaatttttgttaattacagtcaccctatagtgccagccatagaacactaaactcatttcttttacaaagctgtactgttttttttttttttttttttgagacagagtcttgctctcttgggcaggctatagtggcacaatctcagctcactgcaaccttcatatcccaggctcaagtggttctcctgcctcagcctcccaagtagctgggagtacaggcgtgtgccaccatgtccaggtaattttcgtatttttagtagagacggggtttcaccatgttggccaggctggtctcaaactcctgacctcaggtgatccgcccgcctcggtctccctaagtgctggattacaggagtgagccaaggcgcccagcctcaagctgtacttttgtatccattaaccaacctttggctatctccctctccccactactcttccctacctctagaaaccactattctaagctgggcacagtggctcacgcctgtaatcccagcactttgggaagcctaggcaggcggatcacaaggtcagtagttcgagatcagcctggccaacatggtgaaaccctgtctgtactaaaaacttagccggacatggtggtgcacctgtaatcccggctatttgggaggcagaggtgggagaattgcttggacctgggaggcagaggctgcagtgagccgagatcatgccctgcactctatcctgggcaacagagtgagaccctgactcaaaaaaaacaaaaacaaaaacaaaaacaaaaattacccaggtgtaggccaggcgcggtggcccacgcctgtaatcccagcactttgggaggtcgaggcaggcgggtcacgaggtcaggagatcgagaccatcctggctaacatggtgaaaccccgtctctactaaaaatacaaaaaatgagccgggcatggtggcgggcgcctgtagtcccagatactcaggaggctgaggcaggagaatggcgtgaacctggtaggcggagcttgcagtgagccgagatcgcgccactgcactccagcctgagcgacagagcgagactccatctcaaaaaaaaaaaaaaaaaaaattacccaggtgtggtggcgcgtgcctgtagtcccagctagttgagaggctgaggcgaagaatcacttgaacccaggaggcggggaggttgcagtgagccaagatcaggccattgcactcctgcctgggcaacaaaagcaaaactctgtctcaaaatacataaataaataaacaaaaaataaagaaatcactgttctactctcttacttctatgagatcaactttttcttttttttgcttgcttgcttttttgagacagttttgctcttgtcatccagattggagtgcagtgggatgatctcagctcactgcaacctccgcctcccgggctcaagtgattctcctgtttcagcctcctgagtagctgggattataagtgcccgccaccgtgcctggctaatttttgtagctttagtagagacggggtttcaccacgttggccaggcttgtcttgaactcctgacctcaagtgatccacctgcctcaccctcccaaagtgctgggattacaggtgtgagccaccgcacccagccaagataaacttttttagcttgcacacatgagtgataaagtggtacttatctggccaggcccagtggctcacgcctgtaatcccagcactttgggaggccaaggcgggtggatcaagaggtcaggagttcgagaccagcctgatcaacatagtgaaagccccatctctaataaaaatacaaaaaaaattagccgggcatggtggcggctgcctatagtcccagctactcgagaagctgaggcaggagaatggcgtgaacccgggaggcggaggttgcagtgagccacgtcgcgccacttcactgcagcctgagtgacagagcaagactctgtctcaaaaataaataaataaaataaaaataaaaaaaataaagtggtacttatctttctgtgcctggctttttcacatcacataatgtcctgcaagctcatctatgttgcagcaaatgacagaaatctgggggttttaatggctaaatagcattccaaaaaattgtgctcccttgtgtatatagcattttatcagttcatctgtttttttttttttttttttgaggcagagtctcactcgatcttggctcactgcaaccaccaccttccaggttcaagcaattttcccgcctctgcctcccaagtagctgggattataggtgcttgccaccacgcccggctaatttttgtatttttagtagagatggggtttctccatgttggccaggctggtcccaaactcctgacctcaggtgattcgcccacctcggcctcccaaagtgctaggattacaggcatgagccaccaggcccggcctgtcattatttttattcttttctttctttcgttttgttttgagtttttgagacggagtctcgctctgtggcccaggctggagtgcagtggcttgatctgggctcaccgaaagctccgcctcccaggttcacgccattctcctgcctcagcctcctgagtagctgggactacaggcatccgccaccaggcccggctaattttttgtattttcagtagagacggggtttcaccgtgttagccaggatggtctcaatctcctgacctcatgacccgccccacctcggcctcccaaagtgctgggattacaggcgagagccacactgtgcccggcctcttttttttttgacggagttttgctcgttgcccaagctggagtgcaatggcactatttcggctcactgcaacccttgcctcccgggttcaagcgattctcctgcctcagcctcccgagtagctgggattacaagtgtgtgccaccatgcccagctaatttttgtatttgtagtagagacggggtttcgctttgctggccaggctgtcttgaactcccggcctcaggtgatccgcccacctcggcctcccaaactgctgggattacaggcatgagccaaggcacccaggcctaatggtcattattgtcattcattgattcagcaaatagtagagtgctgggtgctcagcctcttgctttgcagtagcttgggtgtcagaggtgtgtgaggcaggcattctcaggttctctcctgcccaataaaaccttttgtctttggggatactggtgacatcatgaatcccaatcctgtgcaatgtgctatgacaaaggaaaggacaggggttgaggcaaggggcagggacagcctatgacactgaaaaagaggccagaaacgcattcctacccgctctctcaaaatccatgttcagtggcaggatcatccaagaccctgatggggcggggggccttttttcgtctaggatggtatctgaatggctttaagggtagctttcttctgatcacatgagatttctgcttgtgtcatgaagaatgggtcagaggatcaggaggctgtggctgcagctggggcgggttgcggggacccaggacgaacagtagagctcggttaacgctgcaaggggagcctggcaggccgtacatcccaatgccaagcccgccgcctctcggcctgacaccaccggtggaaccaaaaaggggaaatcatgtcctttgtgcctctgtgtctgtggtaagcggggccctccagggggcggagccgccggcagggtccccccgtggcccgggtctcagggcagagctctgcctggggctcgcagatgtctgcaaggccgcggagggaggagggtccagacgcaagcccttatttctgatctggacgtctgcgagggtctgacccggctagtcgtccccgaggtgcgtgagtgcgagggtgtgggacacggccggatcgtcctagggccccgtggattagcaaggcaccgggaccactggagagggcttaacgggatagcagggagagggcgggctcgggaagagcaccctttaggcgaggggttctcggggaaccgaccggcgtgtcccagccccaggcccggtccaagattcgccggctccgccgctgcctccgcacccaggcggaccccaccgcaccgcgcccggctttccagcgctgcccgaacccccgcccagcccacgaggcagggattctgtggtcctcactgagtcatctggaccagaactagactagcccaaggtcaccgggcgttcctggcgaggccagggccgcgccgcgccgcccctggtgcatcccgggagccgcgccggtctgcggcacctgggcggcggacaggggcgcgggcgaggcgggcggggcgggcgggcagcggacaccggtcagagaggcggaactccctgccgccagccgtgtagtttgcctcgcgggcggcggcgcggcctcctgccggcctagccctacgcccgaccacaacgcccagaaggccgcgcggcgcgggcgggacctgcggcgacgagcgaggcggtgacatcaccgccgcatccagctccctggccccagctcctcccagcgcccgggccctcggcctcgcaaggcctgacgggaatcgtggtccacccccgggtacccccagctgctgcacgggcagcacggacttcagttcccggcgtgtcctgcgcgccgaggcacgttaacggcaggagggggtgggcaagcaaagggaaaagcagagccggggggcggagtaaggcggggtgggggtggggggtgggggcccacacccctccccctccccgctgctccttccccctcccccgacgtaaactgggatccctttccccttgtgtccgccatattggactctaactctggtcagccgcggcgccgggactgtggactcgcggttcctcccgcccagcggcctgccccgcagctcccgcccgccccagccctccccgacccggacgcgaccccgcgcagcgccccccggctggccggagcgcccgccgccgcggccgcctcagcctccccgccttccccgccctccgccgccgcccgcggcccccgcgcccgctctgcgcccctctccccgcccgccatgagcccagccgacgccaagcgcggggccaagcgccggaagaacaagcggggcggcggcggcggctcgggcgggggtaacggcggcgcgagcagcggcaaggccggcccggcggcggcgctgcgcggttcccaggccgcgggcctggcggccccgggcagcgcggcaggcctggtgggcggcgcggcggcggccaacgggcctctcggcgcgggcgcgagcgcgggcggcgccgcccccggaggctacttcgaggtaagcggcggcagcgggcaggggtcgatggcggtacgcggttgccgttccctcgcgccttggcggagctcggcctcccgctgtcggccccgggcctgggagcgggatgctgcgggcgggcggataacgggtcctgcggcgctgcgcttgccgaggtcccggggcagggcggcaggtgggccgtgctcggcgtgacgcggcctctgtcagcctcttgagaggagaacctgagcagaggcggcgggagggctacaccggggccgccgctcacggcgacgggctggtccgcaggctggagcagcccctcaacgggcggggacgtctccggggtgcagctccgcgcacggcgcttcgccttccgctggacccggcgggtgatacccgcgaggcccgggcttctgtcgtggcgcctcgcccgctgcggcggttccagagcgactgcgattccgggagtgagcaaagctgccctttcgctcccagggctttgaaatgtttctctggccaccttcgttattccgtgcgcgtgatgattgagaagggcctcccggaagttttcctttggtcctcctatgtggttatttgaaatctacctgacagccacctggagctggcagccctggcccctcctcccccgctttgttaagttttcaggggtatttagtggtttggttactcaggtatgtatttagggttcgaacttaaggaatttgaaaggtgatttttttcagttttgtttatgaagacagctagcacacattgcacctaccaattatggattcctgccacttttattcaaccgttggtcacaacatttcagagggtacactatttataagtgggtatgcaattggcgcagtcatttccagttatcccattgtctgctgaaagagaatagattttttttgaaaagttgcgttcttataatgttatttaaactcttaaattatgtagttttaaagatattgcaattaaaaaatgaaagaagcgttgggagtatttttgtgctaaatcatgacacaaattgttctttttttttttttcttttgagaacggagtctcgctctgtcgcccaggctggagtgcaataatggcgcgatcttggctcactgtaacctccgcctcccgggttcaagcgattctcctgcctcagcctctcgagtagctgggactacaggcatgcgccaccatgcccggctaatttttgtagagacagggtttcaccatgttggccaggctggtctcgaactcgtgatctcaggtgatccgcccaccttggcgtcccaaagtgctgggattacaggtgtgagccaccgcgcccggccgtttttattattattatattgttacattagggtcttgggctgtagtcctggacttcagtctcccgagattgccctcatccagtatcctggagatcaaaacaggccgcagttcttgggatcaaggatgagtcttgagcgtttggatctttggggtttttaagggcagtgtttgctgctgtcgggtaggggagggcggggggggtttgcctgtgcatatccttacacaaaatattgataatttttggtgtagctggatgtggaatatattcatttctattgattcaataaaaaccagttggtggcacaataaaattcttagttttagcctttcataccatttcaagttttaataatttacatttgctttgcaatacttaggtaaaatataactttattatttttatttatttttttttgagacagagtctcactctgtcgcccaggctggagtgcagtggtgcgatcttggcgcaccgtaacctctgtctcccgggttcaagcgattctcctgcctaaccctctcaagtagctgggactacaggtacctgccaccatgcctggctaattttttttgtatttttagtagagacagggattcactatgttgggcaggctggtcttgaagtcctgacctcctgatccacctgctttggcctctcaaagtcctggaattacaggcgtgagccaccgtgcccagccctgcctttattatttttgtcgcgttattcaaaatcagataactgtatgcctattattattaagatagggtcttgctatgttgcctaggctggccttgagcttgtgggctcaagggatccctctcatcttagttttactaattactaagggcacagacccttgccactgtgcccacctgagtattatttttgacaggactgtgatattctgttaaactagtatgcatcagggttttgttgttttaaaagagacacggtctctctctgttgcataggctagagtacagttgcctggtcatagctcactgtaacctccaatttctgggctaagcagtccttccatgtagctaggcctctaggtatgtgccaccatgcctggctaatttgttcttttaatatagatacagggtctcactatgttacccaggcttgtcttgaactcttgacctcaagtgatcctcccatctctgcctcccaaagtgctgggattacaggcctgagccactgcacctggcctatcaaggtttttgaccatgacccactcttatgacccactccaagaaataaaatccgttaagatctaggaaacatacacataaacacaaaaatttcacaaaacattttagggccgggcaccgtggctcatgcctgtaattccagcacttcgggaggccgaggtgggtggatcacctgaggtcaggagttcgaaaccagcctggttgacagatgatgaaaccccagagatggtgaaaccccgtctctactaaaaatacaaaaattagccaggtgtggtggtatgcacttgtaatcccagctactcgggagactgaggcaggagaattgcttgaacctgggagatgtaggttgcagtgagctgagatctaaccattgcactactgcctgggcaacaagagtgaaactctgtctcaaaaaaaaaaaaaaaatcccatccttgttgacacggtgagacctcatctctgctaaaaatacaaaaaatggccgggcgcagtggctcacgcctgtaatcccagcactgtgggaggccgaggcaggcggatcacgaggtcaggagatcgagaccatcctggctaacacagtgaaacccgtctctagtaaaaatacaaaaaattagccgggcgtggtggcgggcacctgtagtcccagctactccggaggctgaggcaggagaatagtgtgaacctgggaggcggagcttgcagtgagccgagatggcgccactgcactccagcctgggcgacagagcgagactccgtctcaaaacaaacaaacaaacaaaccccaaaaaattagccaggcgtggtggcgggcgccctgtagtcccagctactccggaggctgaggcaggagaatggcatgaacccaggaggctgagcttgcagtgagccgagatggcgccactgcactccagcctgggtgacagagtgagactccgtctcaaaaaaacaaacgaacaaaaacgaaaaaacaggccgagtgcggtggctcacacctgtaatcccagcactttgggaggctgaggcaggtggatcacctgaggttaggagttccagaccagcctggccaatgtgatgaaaccccatctctactaaaaatacaaagaatagccgggaatagtggtggatgcctgtaatcccagctactccggacgctgaggctggagaatcacttgaacctgggagacggaggttgcagtgagcccagatcacatcactacactctagcctgggcgacagtgcaagactgtgtctcaaaatccgtctcaaaaaaaaaaaaaaaagggcaggcgcagtggctgacacctataatcctagcactttgggaagccgaggcaggaggatcagctgaggtcaggagtttgagaccagcctgagaaacatggagaaaccctgtctctactaaaaatacaaaattaactgggtgtggtggcgcatgcctgtaatcctagctactcaggaggctgaggcaggagaatcgcttgaacctgggaggtggagattgtcatgccagctactctggaggctgaggcaggagaattgcttgaacctgggaggtggagattgtcatgagctgagattgtgccattgcactccagcctgggcaacaaaagcgaaactctgtctcaaaaaataacaaaaaacaaacaaaatattttaatacttttctgatcttttctgttccatgtaatctcattaataaaatctgggttatagtccacagaattagttcattgtgtacttttttttttttttttttgagacagagtctcgctctgtcaccaggctggagagcagtggcgtgatcttgactcactgcaacctccacctcctgggttcaagcgattctcctgcctcagcctcctgagtagctgggactacaggcgcgtgccaccacgcccagctaatttttgtatttttagtagagacagggtttcaccatgttggctaggatggtttctctttcttgaccttgtaatccacccaccttggcctcccaaagtgctgggattacgggtgtgacccactgcagcctctctattgtgtactattgagttgtgtgctgcaccttgacagttgcttttactgtattttaagcttttaaaatatgccaccatcttttatggtattttattttatttttgagacagagtcttgctctgtcgcccaggctggagtgcagtggcgccatctcggctcactgcaacttctgcctcctgagttcaagtgattcctcctgagttcaagtgattctcctgcctcagcctcccgagtagctgagactacaggagtgcaccaccacacctggcaaatttttttttttttttcaagacagagtctcactgcgtcaccccagctggcgtacagtggggtgatcttagctcactgcaacctccgcctcctgggttcaagtgattcttttgcctcagcctcctgagtagctgggattacaggcatgtgccaccacacttgggtaatttttgtatttttagtagagacggggcttcaccatgttggtctagaactcctgaccttgtgatccacatgccttggcctcccaaagtgctgggattacaggcgtgagcaaccacgcccggccattttttgtatttttagtagagacggggtttcaccttgttggccaagctggtctcgaactcctgacctcaagtgatctatctacctgcctgggcctccaaaagtgctggaattacaggcgtgagccactgcacctggccgatattttaagcttttaaagctgtctttagtttttaagtttctttgtaagtattttaataattgttcattaaagaaactctttatggtaactggggtaaaatattcttgacacagatcacagaaagtcttaatgtaattctgaagcctctgaattgtttccccacagatggtgagctttttggagtaccttgtatggtgcaaaatggcacccaaaacagtatcaaccagaaacagtgagtggtttctggccctatggttcccagggaggctttctgagtcctggcaagcagcctctacactccgtagtcaccaggccaggaggtggataagagagaaggccgagtggaaggactgtcttgattttcaggagtggtcacagtcccactgtcctgtgtgcgggacacagcactatgtgttatacccaggaccaccttcatcgaggtggctgctgagccaaagagggtgtttctgcatgtgggtagcttcaacaaaggaggaggaccatgggagaagtaggaaaacataacttagcttatagggtctttgactcaaaacagaattcttatacacaaagcttggggaaccacaaatttgttaggctctgttccatgggcaaggtatcaaccttgcgctacctcagttttcttttcttttttttttttaaatggagtctcgctctgtcacccaggctggagtgccctggcgcaatcttggctcactgcaacctccgcctcccgggttcaagtgattctcctgcctcagcctcccaggtcgctggggctactggtgtgtgccactatgcccagcttattttttgtatttttagtagagacagggtttcatcatgttagccaggatggtctcgatctcctgacctcgtgatgtacccgcctcggcctctcaaagtgctaggattacggtgtgagccactgcatttggccactaccttgggtttcttaatgatagggcaccacaggcttggtagctcatacctataatcccagcatttagggaggccagggtgggaggatcacttgagtccaggagtttgagatcagcctgggtgacgtggagagaccctccccgccactgctctacaaaaaattaaaataaaaattagccaccatagggaccgggcatagtggctcacgcctgtaatcttagcactttgggaggctgaggtgggcagatcacttgatgtcaggagtttgagaccagcctggccaacatggagaaaccccatctctactaaaaaatgcaaaaattagccaggcatggtgacgagcgcctgtaatctcagctactcaggaggctgagacatgagaatcgcctgaacccggggtggggggtgcagggctgaggttgcagtgagcagagatcacaccattgcacttcagcctgcacaaaagaatgagacattgtctcaaaaaaaaaaaaaaaaaaaaaaaaaaccaaaaaattagccaccatacagcgtatcctctgctttgatggtatgatcgttgtataaacatgctggtatgattattatggatctttggggtacatgagggtgcacttagaagccttccctgtattgtagaaattgcgaccacggtgaaattaggttatcattaactctagttcatatttgcctagtgacctgaggaaataggttgaagaaaaatgtagaacttcctgtgtcttaactaaaattaacaattttaacttttaaaagtttaaatggttaccatacacgctttagaaatggtgtacctgcagagagcatgtctgtgattcagtattttttctatgtgtacacctatgtaataaatatatcaagataaagaatataggttggcacagtggcccatagccatgatcccagcactttggaaggccgaggtgggagaatcacttgaggccaggagttcaggaccagcttgagctatgtagtgagactctgtctcaacaaaaaacttaattctaattagcctggccaggcgctgtggctcacacctgtaatcccagcactttgggaggccgaggtggaaggatcacgaggtcaggagtttgagcccagcctggccaacatggtaaaaccccattctctactaaaaatacaaaaaaattagctgggtgtggtggtgggcgcctgtaatcctagctactcgggaggctgaggcaggagaattgcttgaacccaggaggcagaggttgcagtgagcccagatcgggccactgcactccagactgggtgacagagcaagactctgtctctgaaagaaaaaaagaattagcctggtgtggtggtgtatacctgtaatcccagttatgtaggaggctcaggctagagaattgcttgagctcaggagtctgagggttacagtgagctgtggttgtaccacaacagcacttcaacctgggtgacagggagacctcatcttaaaaaaaaacaaaaaagactatagatagaacaattttccggatgttccctcatctccttcatggtcgtttctactactgatctcatctgtatcctttaaaaggattttgactttgaatttctttctttctttttttttttgagacggagtctccctctgtcacccaggctggagtgcagtggcgtgatctcggctcactgcaacctctgcctcctgggttcaagtgattctcctgcctcagcctcccgagtagctgggattacaggcatgcgccgccatgcccagctaattttcgtatttttagtagagatggggtttcaccatgttggccaggctggccttgaactcctgacctcaggtgatctgccagcctcagcctcccaaagtgctgggatttcaggcgtgagccaccacgccaggccctctctttgaatttcatagaacaagaatttttgtgctagggctctttggctcaacattatatttgagatgcatctgtgttgttgtcctagcagtggatcattttttttttcatggcatgtaaacttactgttgtgttaatattccacaattcatctcaccattctaatggacatttggattgttttatggctgctatgagtcaactgatgtgtctattcctttctgtacatgtgttttggtggacatgagcactcagttggtcatatggctgggggtagaattgctgggtgtacttcgatttgactttagtgggtactgcctgatagttttcctaaatggtactgttatatgctaatttttagaaattaacatgtagcaaaattgatactaattaaaaaaattttttgaaacagactctgactctgttgccttggctggaatgcagtgttatgacaatggctcattgtagcctcagcctgtcctgctcaagcagtgctcccacctcagcctcccaggtagctgggactacaggtgtgcaccaccatgcctggctaattaaaaaacaaaaatttaaggccaggtgcggtggctcacgcctgttatcccagcactttgggaggctgaggcgggcggattatgaggtcaggagtttgagaccagcctgaccaacatggtgaaatcgtgtctctactaaaaatacaaaaattagcggggtgtggtagcaggcgcctgtaatcatagctactcgggaggctgaggcaggagaattgcttgaacccaggaagcagaggttgcagtgagccgagattgtgccactgcactccagcctgggggacagagcaagactccgcctcaaaaaaaaaaaatttttttttttttgtaaagatggggtcccactgtgtttcccaagctgatctcaaactcctgggctcaagcagtcctcctaccttggcctcccaaagttttgggattacaggtgtaggctactgtcccagccaaaattgaatgtttaaaatgtgcattttgcatttgaattttaacaactgtagattcatatatctactaccacaatcaggatacagaacagtttaattgttcacaaaaactccctcatgttatagttacactctccccaactcctaaagtcttggcagccattactgtgttgcttggtatgattttatcttttggataagtcctgtaaatggactcatacagtccatttatgactgtgtagtcttttcaggaaggtttatttcactcagcataatgactttgagattcatccaagttgttgcatgtatcagtagcttgttcttttttactgctgtgtagtattctgttgtataaatgtaccacagtttgtccatttttccattggtggacattggggttgttttgaggttttggtgattataaatagagttgccataaacatgtctatacaggatttttgtgtgaaagtaaatttcaattttctaggtaaataccaaggagtaggagctggtcatatggtaacattatgtgaaaccgctgaactgttatccagagtggataataccattttgcctactcacgcaatgtctgagagttctggttgctctgcatccttgctagcacttgagattttcagtggtttttgtttacactattattattaatatttttttagtagagatggggttttgccatgttgcccaagctggtctcaaactcctgagctcaggcagtctactggtctggcctcccgaagtgctaggattacaggtataagccctggcctaaactgttttttaaaaaaccctttttgtgggctgggcgtggtggctcacgcctgtaattccagcacgttgggaggccgaggcaggcggatcactggaggtcaggagtttgagaccagcctggccaaggtggtgaaaccccgtctctactaaaaatacaaaaagtagctggttgcggtggcacacacctgtaattccagctactcgggaggttgagttgaggcaagagacttgcttgaacctgggaggtgaaggttgctatgagccaagatcacactactgcactccagcctgggcaacaagagcgagattcttgtctcaaaaaataataataacaataataataataattctttttgtggaaatggggtctcactatgttgcccaggctggtgtctatctccagggctccagcgatcctcccaccttggcttcccagtgttaggattacaggcgtgagccaccgcacccagcctaaaactagacagacagtttataattcctgaccttagtatgtgtgtgtgtgtgtctgtgtgtgtgtgtgtgtgtgtatgtattttttttttttggaagtggagtctcaccctttcgcccaggctggagtgcagtggcgcgatcttggctccctgcaacgtctgcctccttggttcaagcaattctcctgcctcagcctccccagtagctaggattacagatgtgcgtcaccacacctggctaattttgtagtttcagtagagatgggatttcaccatgttggccaggctggtctcgaactcttgaacttaagtgatctgcccaccttggcctcccaaagtgctggggttgcaggcgtgagccactgagcctggcctcttaatattttaataaataggtctgtagtggtatcatagttttaatttgcatctccctggtgcctaataatattaaacatgtttcctgtgtttatttgccattcctgtatcctcttgggagcagtgttttatcaagactttgcctattttttttttttttttttgagacaaagtcttgctcttgtccccaggctggagtgcagtggcacgatctcggctcactgctacctctgcctcctgggttcaagtgattctcctgcctcagcctcccgagtagctgggattacaggcgccttccaccatgcctgactaatttggtatttttagtagagatggggcttcaccatgttggccagactggtcttgaactcctgacctcagattatccgcccgcctcggcctcccaaagtactgggatttcaggggtgagccaccatgcccggcctactttgcctattttttgaaagttctccatgattctgaattcaaatcctttgtcatatataatttgccaacattttcttcaactgtgtagcttatctttttgttgagacagtgtctcattccgtcacccaggctggagtgtggtggcatgatctcggctcactgcagcctccgcctcccagattcaagtgattctcatgcctcagccttctgagtagctggagttatagggatgtgccaccgcgcctggctaatttttgtatttttagtagagatggggtttcaccatattggccatgctggtcttgaacttctgacctcaagtgatctaccggcctcagcctcccaaagtgctgggattataggtgtgagccaccggacccaacctgttaactggttttttgcagagaaaaaaaaatgtgaatgaagttccgtttaccaattttttcttttgtggatcatggttttggtgtcatttctaacatctctgttttagctcaaggttatgaagatttttttccttctatgttttcttctaaaaactttttagtttacttttttgttttttttgtttgtttgtttttggtcagacagagtctcattctgtcgcccaggctggagtgtagtggtgtgatctcgactcactgcaacctccgcctcccggtttaggtgattcttgtgcctcagcctcctgagtagctggaattaacaggcgtgtgccatcatgcctggctaatttttgtatatttagtagagatggtgtttcaccatgttggccatgctcgtcttgaactcctgaccttaagtgatgggcccacctcagcctcccaaagtgctgggatacaggtgtgagccactgcacccaggctgtaaaccggttttttgcagaggaaaaaatattaatgtgaatgaagttcagtttatcaatttttttctgtgtggatcatggttttggtgtcatttctaagatctccattttagctccaggttatgacgatttttttccctctatgttttctttttttctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgctcggctaattttttgtatttttagtagagacggggtttcaccgttttagccaggatggtctcgatctcctgacctcgtgatccgcccgcctcagcctcccaaagtgctgggattacaggcgtgagccaccgcgcccggccccctctgttttcttctaaaaattttatagttttacttttttgttttctttgagatggagtctcactctgtctcccaggctggggtgcagtgacaccatctcggctcactgcaacctctgcctcctgagttcaagtgatttttctgcctcaccctcccaagtagctgggactacaggcatgcaccactgcacctggctaattttttgtatttttagtaaagatgggatttcaccatattggccaggctgatctcgaactcctgacctcgtgatctgccctccttggcttcccaaagtgcggggattacaggcatgagccaccgcacctggcttttttttttttttttaattttaatttttgagacagagtgtcgctctgtggcccaagctgaagtttagtgccatgatttctgctcactgcaacctctgccacctgagttcatgtgattcttgtgcctcagcctcacaggttgctgagactgtggtggtgccaggtgtgcaccaccactcctggctaatttttgtacttttagtagagacggggtttcgtcacgttggccaggctgatctcgaactcctggcctctagtcatctacctgccttggcctctcaaagtgctggtattacaggcgtgagccaccacacccagcctagactgtttaagtcgtaggtgacattattgattttggatattgaaccagctttacattcctagaatgaacccctcttggtcgtttgtttgtttgtttgtttatttttgaggcagagtttcgctcttggtgcccaggctgcagtgtaatggcacgatcttggctcactgcaacctctgcctcccgggttcaagcgattctcctgccccagcctcccgagtagctgggattacaggcataagccaccacacccagctaattttgtatttttagtacagacggggtttctccatgttggtcaggctggtcttgaactcccaacctgaggtgatctgcccacctcggcctcccaaagtgctgggattacaggcatgagccaccacgcctgttggttgttttttttgtttttgttttttcaatttatatttttatttatttatttatttatttatttatttatttatttatttatttagagatgagtcttgctctgtctcccaggctggagtgcagtggcgccatctcggctcactgcaagctctgcctcccgggttcacgccattctcctgcctcagcctcccaagtagctgggactgcaggcgtccgccaccacacctgggtaattttttatatttttagtagagatggggtttcaccatgttagccaggatggtcttgatctcttgacctcgtgatccgcctgccttggcctcctaaagtgctgggatcacaggtgtaagccctgcctggtcatttattttttaattgctagacttaaattcactaaattttattaagcattattggtctgttttcatgagggatgtttgtcactagctttcttaaattgtttttgcctgattttggttttacaggttgaatatcccttatctcaaatgtttggaaccagaagtcttttggatttcagataatttcacatttgggaatatttgcattatgctgatttagcacaccaaatctgaaaatctgaaatcagaaatgttccagtgaatttttccattgagtgtcatgtcagtgctgaaaaagtttcagattttgaagcatttcagattttggatttttgcatttggaatgcttaatctgtagtattaatgctggcttcattaaagtaagatgggaattatttctttctctatgttagtatctgattttcaaggaattggttcatttcatctaagtatttgaatttatgtgtatagagttgtctgcagtattgctttattatccttttaatgtctgtgggagtctgtagtgatgtctgccctttcattcctgatattagtaacttgtttttaccttttattcttccttgccagtcttaatagaggtttcatcattttttaaacctttttgaagaaccagctgttggttttactgatttttctctgtttttccgttttcagtgtgtttgatttttttttttaaacactttgccttattatttgctttgggtttgttttttatttttatttttatgttttattttattttaagaggcagggtcttgtacggtctcctagtctggagtgctgtggcttgatcatagctcactgtaaccttgaactcctggactcaagggatccttccacctcagcctcctgagcggctgggactacaggtgcaagccatcatgtctgggtaaattttttttttttttttttttcgagacagagtcttgctctgtcgcccagcctggagtgcagtggctggatctcggctcactgcaagctccgcctcctgggtttacgccattctcctgcctcagcctccggagtagctgggactacaggtgcccaccaccacgcccgactaattttttgtatttttagtagagacggggtttcatcgtgttagctaggatgatctcgacctcctgacctcatgatccgcccgcctcggcctcccaaagtgctgggattacaggcgtgagccaccgcgcccggctgatttttttttggtattttttgtagagacggggttttgccatgttgctcacgctggtgtttaactcctgagtttaagcaatctgcccacctctgcctcccaaagtgctgggattataggcgtgagccaccgtgcctgggcttttctaatgtgaatatttaatgctataaacgtctctctgagccatacttaagctgtatcccacaaattttggtatgttgaactttcttttcttttctttttttttgagacggagtctcgctctgtccccatgctggagtgcagtgacacgatttctgctcactgcaagctccgcctcctgggttcatgccattctcctgcctcagcctcctgagtagctgggactacaggcgcccaccaccattcctggctaattttttgtatttttagtagagacggggtttcaccgtgttagccaggatggtcttgatctcatgacctcgggatccgcctgccttggcctcccagagtgctgggattacaggtgtgagccaccgcgcccggccacagaactttcttttttttttttttttttttgagacagtcttgttccatcgtccaggctggagtgcagtggtgcagtcttggctcactgcaacctctgcctcccagcctcaagcaattctcttgcctcagtctcttaagtagctgggattacaggcgcccgccaccatgctcagttaattttttgtattttagtggagtcagggttttgccatgttggtcaggctgttgtcaaactcctgatctcaagtgatccaccggcctcggtctcccagcgtgctgggattacgggcttgagccactgtgcctggccgaagtttcattttcattcagtttaaaacactttctagctgggtatggtgttgtatgctgtagctccagctactcagtaggctgaggcaggaggaccacttgagctcaggggttccaggctgtaatgcgcgatgataggacctgtgaatagccagccattgcactcaagctaggtccacatagcaagatcccgtctctaaaataattaagtaaagttctaatttcccttctttttgtttttttttttttttttgaggcggagtctcacactgtcgccaggttagagtgcagtggtgcgatttcggctcaccgcaacctctgcctcccgggttcaagagattctcctgcctcagccccctgagtagctgggactacaggcgcgcaccaccatgcctggctaatttttgtatttttagtagagatggggtttccccatgttggccaggttggtctccatctctttacctcgtgatctgcccgccttggccttccaaagtgctgggattacaggcgtgacttctcctttgacttacagtttatttagaagttggtatggtttggctatgttcccacccaaatcttgtcttgaattgtggctcccacaattctcgtgtgttgtgggagggacctggtggcaggtaattgaatcatgcatgtaggtctttcccgtgctgttctccgtgatggtaaataagtctcacgagatctgatggttctgtgagtgggagtttccctgggcaagctctctctttttgcctgccaccatccatgtaagacctgacttgttcctctttgccttccaccgtgattgtgaggcctccccaggcatgtggaactctttttaaacttttttttcccagtcttgggtatgtcttcatcagcagtgtgaaaatggattaatacagaagtgtgctgtttaattctgttatctctcccttttatttatttatttttttgagactaggtcttactctgtcacccaggctggagtgcagtggcacgatctcggctcactgcaacctctgcctcccgggttcaagtggttctcctgcctcagcctccctagtagctgggattacaggtgcccaccactgtgcccagctaagttttgtatttttagtagagacgggatttcaccacgttggccaggctggtcttgaactcctgacctcgtgatccaccccgctcagcctcccaaagtgctgggattacagtcttgaaaccaccgtgtccggccacctgtatctctctattactgaatttttgtctgatttttaccattgttaacatcagagatcattctttttatgattttaagtttttcaaaaaatttaaggttttatggtctgttttggtaaatgttacatatgaacttaaaaatgtatgtactactattattggatggtttctgaatgtcaattagatccagttggctgatagtttttttttggttgatggttttgttcgcttctgtattcttgctgagtttttgtctactagttcttttgattgctgaaagaggaatgttgaagtctctgcctaaaattgtagatttgttcacttttccttacagtttatttagcttttgcttcatgtatgtttgaagctgtgtttgatgcatatacatttaggattgttaggtcttggtgaattgaccctttgtcatttaagctgtatccctcatccttggtagtttgcttgtctctaaagtcgcttttgtctgatactactaatatagcctctccagctttctgctaattaatattggcatgttatattttttctatctttttgctttaaacctatctatattatttgaaatgaatttcctgtagatagctgcctgattattcttcattaattgtgcttattcatattttcatttttaattgtaatgtgtatgtgaaatatacttattggagaccttttttcctggcctaataactaatttaatatttatttggtgctattataggatgctgctttgcattgtatttgataaagttctctttactagactttttgaccttgtaggctttgtaaactgatttgctagattacatgaacatggtgacacaagccatcttcattttagagtttgaccagtatgagttcaaatcataggcctctatatgtcatgggcctgtataacatttattttgtttttactatggaagtaagttttagctgggctctatggctcacacctgtaatcccaataatttgggaggctagaggtaaatatataaatcccagaaccatctaaaaatctataacttggtgaccaaattctagataatattggggtccaaccgattttgaaaacttattatattttaatggaattaacagctgggtgcagtggtttacaaccataatcctaacactttgggaggccaaggcaggaggatcccttgagcccgggattttgagaccagcctgggcaacatagtgaaacactgttttttgtttgtttgttttttgtttttgagacagagtctcgctctgtcactcaggctggagtgcagtggcgcaatctcggctcgccgcaagctctgcctcccgggctcacgccgttctcctgcctcagcctccggagtagctgggactacaggcgcccaccaccacacccagagaattttttgtatttttagtagagacggggtttcaccgtgttagccgggtggtctcgatctcctgaccttgtgatccacctgcctcggcctcccaaagtgctgggattacaagcgtgagagacactgtttttttttttttgagatggaattttgcttttgttgcccaggctggagtgccatggcctgatctcggctccctgaacctccaggttcaggcgattcccctgtctcagcctcccgagtagctgggattacaggcatgtgccaccacgcctggataattttgtatgtttagtagaggtagggtttcaccatgttggtcgggctggtcttgaacgcctgatctcaggtgatccgtccgccttggcctcccaaagtgctgggattacaggcatgagccactgtgcccggccagtgagatactgtcctttttttgttgttgttgatggcgtctcgctctgttgccaggctggagtgcagtgacgcgatctcggctcgctgcaacctccacctcccgggttcaagcaattcccctgcctcagccttccgagtagctgggactacaggtacgcaccaccaaacctggctaattttttgtattttagtagagatggggtttcaccatgttggccaggatggtcttgatctcctgacctcatgatctgcctgccttggcctcccaaagtgctgggattacaggcgtgagccaccacgcccggctgagatactgtctttacaaaataaaagaagggagtcaggtgtggtagtgtgcacccacagttctagctactcaggaggctgatgtggggggatcacttgagcccgggaggtcgagactgcagtgagctgtgatcatgccacagcactcccgcctgagtgacagaacaagaccctgtctcaaaaaaggaaatgttttaatttctaaactaccttggagtaattccaataatgtttgtgggacagaattactgcttgttgttttcttgaggaaattgactttttcccttacgtaagttaatagagggtgatgtcaagtaaagaacattgttctcttgaatattttgagcaccatgttagatagagcttgaaactgaatgagaggttgtagaatctaattcttatggcacaggatttttaaaaataaactttttattttagaataattttagatttacagaaaagtcaccaagatagtacactggtcccccattacctgcaggggatccatcccaagacccctactggatgcctgaaattgcagataatactcaaccctaaaatatactatgtttttcctatatatagtacctttaccataggtaaagcttaatttgtaaattaggcacagtgagagattaacaacaataacagtaataggacaattatcacaatacattgtaataaaagttatgtgaatgtggtatctctctctcagaatatcttattatactgtgctcacctgtttttgaaccacagttgatcacaggtaactcaaaccactgagaagtgcagctgtggatgagggcgatgagggcatactattgagcctggagtttgtgcattctcttcagccagctctccctaatatggatattctagcgaaccttggtatatttgtcaaaactaagaaattagcattggtacaacattattaactacagattatttggatttttaaaatgtcctgtttctgttccaggatctaatccagtacaccacagtgcatttagcagcccagaattttcattctttttagttttctcacctatgaaatggtgaagctttttattttcttcaaaggattcctgagaagctaattaatattcagatttatagtatggtagtaatttcatgctcatgctaaaattcagtaaaatggttaacttttggctgggcacggtggctcacgcctgtaatctcagcactttgggaggctgggatggacggatcatgaggtcaggagatcaagaccatcctggctaacatggtgaaacactgtctctactaaaaatacaaaaaattagccaggtgtggtggtgcacgcctgtagtcccagctactcgggaggctgaggcagaagaatcgcttgaacccaggaggcagaagttgcagtgagccaagaacgtgccactgcactccagcctgggtgacagagtgagactccgtctcaaaaaaaaaaaaagttaaccatttaatagtgtactacaaggctgggcgctatggctcatgcctgtaatcccagcactttgggaggccgaggtgggtggatcagttgaggccaggagttcaagaccagtctggccaacacggtgaaaccccgtctctactaaaatatgaaagttagctgagtgtggtggcgcatgcctgtaatcttagctactgggaaggctgaagcaggagaatcgcttgaaccggggaggaggttgcagtgagcctagatcgtgctactgtatttcatcgtgtttgacagagcgagactgcatctcaaatgaaaaaaaaaaaaaaggaaagaaaaaaatagtgtactacaatctaattacttttcctaaaaatacttggtaattatttcacttaggtgaaagtagcccaccaaggcaaacattgtctacgagttactagttagagtacagtccctattgcccaggctggagtgcaattccgccgtcatagctcactgcagcctccaactcctaggctcaagagatcctcccacgtcaggctttcaagtacctgggactacaggcacgggccaccacacccagctaatcaaaatttttctgggggggatgagatcttgtatgttgcctagactggtctcaaactgttggcctcaagcaatcctcctgccttagcctcctgggtatttgggatgactgggatcacaggcgggagccactgtacctagctgtttctgtctttaaaagcacacaaaatcaggctgggtgcagtggctcacgcctgtaatcccagcacttcgtgaggccgaggtggacagatcacttgagggcagaggttcgagaccagcctggccaacatggtgaaaccccgtctctactaaaaatacaaaagttagctgttcatggtggcatgtacctgtaattccagctactcaggaggctaaggcaggagaattgcttgaacccagagggtggaagttgcatgaactgtgatcgtgccactgcactccagcctgggtgacacagtgagactccatctcaaacaaaaacagaaacaagaacagcataggaagacggctatagctattgttaatatttttccttcctttaaaagaataatgggagggtttggatcaatgatttcaattaaataccgctgcacaaactgaattgaactgttctttgtgtgtttgtacatttacagatgtccacacctgtattccactgggaatgctaagatggtcaaatcatagatgcatagaacttcagaactggaggggacaacgacagagcccctgtttattgccaagacagtatttgttagctgaggaaactgaggcccgaagacttgagtttgaaaaattcctctaattgttgtagtcggtgtcccctcacatacctttcaatttctgtggcttttgtcacttctcagtaccaactgagataaagaaaccaccttgctattctttttaaatttttatttatttcagagacagggtcttgctctgtcacccagtctggagtgtagtggcacaattatagctcattgtcaacttgacttcctgggctcaagcaatcctcccaccttggtctcccaaagtgctgggattacaggcgtgagccactttgcccagccctgtcctgctagtctggtcttccttactctcgccgtagtctactgcattttctcttctctgtgaacacactctgctgcttcctcctccctctggatgtcttccacctgcctttgtacgtgagcaccaggacgtcttgagctttctttgacggcccctctcttgttcctgccagactccggctgcacggacagctgagcgtccttgccgttcgcttccttttgccttgctgttccactgctgttgcggtgcctgttgggtgctgcggtgatcctgacctgcttgtgtagtgcggcctgcgtggcctgatcgggccgggtttttcttgcctctgcgcctttgtgcacgcttttcttttcttttcttttttccttttttttttgagatggagtttcactcttgttgcccaggctggagtgcagtggtgcgatcttggctcactgcaagctctgtctccctggttcaagcctgccgagtagctgggattacaggtgcctgccaccacacccagctaatcttttgtatgtttagtagagatggggtttcgccatgctggccaggctggtctcaaactcccgacctcaggtgatccacccgcctcggcctcccaaagtgttgggattacaggtgtgagccaccgcgcctggcctgtgcaggcttttctttccagtgagttcttctgtctttgcctgattcgcccctttctgagatggagaccatgcgctgtccccatgggaagcatttcttcaccgtccgaggccaggctgtaccttcccttctgagttcctgtggtgcctgtcctggctcggccacaccacttagactggattggaacatctaaactgcgctgtggcctgcttggcacatagtacataggcagaaacattgctcagggagccaggccatttgatgtgagcttctgcatttcttccctcttcacctttctttgggacgtcttttgtcttttgatttggaagaaagcatctatccatttttccaaagttaactgcgtgctccaggggttgttaactgatggtttttaatgagtctgttaattcatggaaactcagtgcagaatttatgtgtagtacgttatcttgaggcttctgcaaaacagctttgtcgtttctctcctgtgtcttgaatctttccacttctgttgggttattttcctttgtattcagattgtgtctttcttcccttcctcttcctcagtgtttttatttttagtttttgtggaggcaggagctcaccatgtttctcaggctggtctcgaactcctgggctcaagtgattcacctcacctgcctcagcctcccaaagtactgggattacaggcatgagctgctgcacctggctccctttgagcttttggcacatgactgtgatatccacctttctagaactttctttgccttcctgtgcatggcaccatgccattgtagttctcctcctgactcttgctttgcttactctccaggctttggtgaacttttatgtccttacaacaccttgctgtaggttattctatgttgagttcttcctctcaagttcacacttaatatgttaggcatatatgctggtagagatttcttttttcttttttgaacaggatctcgctctgttgcccaggctggagtgcagtggcgcagtctcagttcactgcagcctctgccttccgggttccaggcagttctcccatgtcagcctcctgagtagctgggagtacaggtgcgtacaaccatgcccggctaatttttatattttttggtagagacagagtttcaccatgttggccaggctgctctcaaactcctgcccttaagtgatgggcccgccttgatctcccaaagtgctgggattacaggcatgagccaccatgcctggctgcttgtagagatttctttttttttttttttttgagaccgagtctcactttgtcgcccaggctggagtgcagtggcgcaatctcggctcactgcaaccactgtctcccaggttcaggtgattctcctgcctcagcctgccgagtagctgggattacagctgcttgtcaccatacctggctaatttttgtatgtttagtacagacggggtttcaccgtgttggccaggctggtctcgaactcctgatctcaagtgatctgcctgcctcggcctcccaaagtgctgggattacaggcgtgagccaccgtacccggctgagatttctgatgacagaaactcaaatgggttatcagtaaccctctaacattgtggatatttattagaatgttgtttgaggccttttccccccatagctgtggcttgtgaactcaacttgtgtatgtttagatcaaactcttcttcccatattacaaaatagtgcttaggtattattggtttgtttgctaagtaacttatcaaaaggagttttgtctaaagatctcaggtcatctgtatgtggttgtgcactggacacagtttccacatctgtcaggtaagaagattgtgttagataatctcgaaggccttttataactttatgataattgtaattgtcactctttcggtcaaaagatttcagtgactaggccaggtgtagtggttcatccctataatcgcagcactttgggaggttgaggcaggaggattgcttgagcccaggagcttgagacaagcctgggcaacatagggagaccctcgtctctacaaaaaatatagaaaaaatcagctggctgcggtggtgcgtgcctgtagtcctagctacccaggagactgaggcagaaggatcgcttgagcttcggagttaaacactgcagtgagctgatggcaccactgcactacagcatggtggcaaagcgagaccctgcctttaagatcatttaaaatttcgacgactgctcttcacccctttcaagagtctcagaaactctaggatgtaaggagtgatgatcccttaggctgtaggaaaaacacattactacttatatttctaaataaggcattgaactttacaaaagtggcacccaccccccaacttgatctgcatttcctttttttgtttttttttttttagacggagtcttgctctgttgccaggctggagtgcaatggtgagatcttggctcaccgcaacctccgcctcccgggttcaagcgattctcgtgcctcatccttcccagtagctgggattacaggcgtccaccaccatgcccagctaatttttgtatttttagtagagacagggtttcaccttgttggccaggatggtctggaactcctgacctcatgatctgctcgccttggccttccaaagtgctgggattacaggcgtgagccaccacacctggcgatttgcatttctttctttcttttttttgtttttttgagacggagtcttgctctctcgcccaggctggagtgcagtggtgcaatcttagctcactgcaacctctgcctcccagattcaagcgattatcttgcctcagcctcccaagtaactgggattacaggcgcctgccaccatgcccagctaatttttgtatttttagtagagatgaggtttcaccatgttggccaggctggtcttgaactcctgacctcgtgatccgcctgcctctgcctcccaaagtgctgggattacaggcgtgagccactgcgcctggcctttgatctgcatttcagtcatgggtgagtcttaatctgttctgaggcaagagagacacttccaattcaggaatttgtatgcatgacacagctgtggaagccttggcatttaatgagcactcagtcagtacattcttgagttctgctaattttaattaaactggtcttcacaaaaacagagactgggcatggtggctcccacctataatcccagtacttttgggaggccgaggtgggaggattgcttgaggtcgggagttcaagaccaatctggtcatctctacaaaaaaaaacaaaaaaaaaaacctcccaaaaccaaaacaagtagtcttcaaagaaactctggatcagagataatgctaatagtgtgtgtggaacaacaaggacatttatggcagaaccaacacttccactttctgtgcaagctcttcattggccatgtatgaagtttaaaaaaatgatctcagcagaactgggaatcaaccctcaaagattatttgaaatctggatttacatccacttttattaatgacaagccatgcctgaagtgtttatcttgccttgagatgttagggaaggaaagtatatagagccttcacattcaccaaaatattttaagcattcataagagaaacatcacctataaattttcagctgtatttaaagtcatgcactacacaatctagtattttataaaattgtattaagctcagagaaactcctttttgagttttcttacttttatttctgtattgcttagggttcagatgcagaagcagctgtagttttcataggcaggcatttaatacggagaattagtagcatatggcatttaaaattatttattatatttgtttattttttgagacagggtgttgtctaggtgctggagtgcagtggcgtgatcatggctcactgcagcctcaaccacccaggctcaagtgattctttcatctcagcctcctgagtaggtgggaccataggcacctctaccaacctggctaattttttttttattttttgtagagacggggtctcactttgttgcccaggctggtctcaaactcctggggtcgagtaattctcctgccttggcctcaccaagtgctgggattacaggtgtgagccaccacccctggccaggagcatgtaactttttgaaaggtctagtggaaaaggctcttgtctgggcttccatgaatgacttccatcacaaaaggacagcattcagctgtggaggtggaggagccagtctgcacctctgccacaagtatctaatattggagacaaaatagccacctactatttgggaaaagtattttcgaacttttttgtactggaaaaagtgctatttttccaatagggggtgggggagtgagcagaatggcagaaataatacataggaaacaatatggcaacaaaagaaatatattattttgtcagcaaatatttttggagtattcatagaatcaattccaggagatttggaagagtaaatggttagaataaatgatggtgtgggggtttgctctgggatgatggaaacacttgtggttttttttgttcttgttttttatttttgagatagggactcactcttgtcgcccaggttggagggcagtggcaccatccgttgctcattgcagcctgaactcctgggctcaagagatcatcctgccccagagtagctgagactacagtcacatgccaccatgcctggttaattaaaaagaaattgcagagccaggggtcttgctgtgttacccaggctggtcttgaactcctggcctcaagttatcctcccaccatggcctcccaaagtactgggggagtataggagtgagccactgcacctggctacgtgggtatttttataggtgttagcctgtttttttttgatagattccagttgagtactcttttgatgagacgcaagcttgtggattctgaaatgatttcattagtaaacaaggttttgtgggaaaactggatatacacaatgatagagtagccttttttttttttttttttttttaaaagatgcagtctccctctgtcgccaggctggagtgcagtggtgcgatttcagtttactacatcctctgcctcccaggttcaagcaattctcctgcttcagcctccggagtagctgggactacaggcgtccaccaccacccggctaatttttgtatttttaatagagacaagttttcaccgtgttggccaggatgttctcgatctctggacttcgtgatctacctgcctcagcctcccagagtgctgggattacaggcgtgagccaccgtgctcagccagagtagccactttgtaataaaaaaaaaaaattcatgtagtccgtcaggtaagaaacaaaggtagaaagagattcttgggtagggcaggattgcagaaagagtaacatgagaaatgggttcaccacatgatgcatagggaactgcttacagcaaccagttgaagccagaagcactaatgggtcagcctgagacctttatagagtagtacatcttcacaatattttgtaatgacgggggagtaactgaaagtacttggcaagacacaggggtttgctggctatcttttggcaaaggtaaaagcattgcctattctgaaggtgaattgaatgtttttcttttacataaaggtaagtggtctaaatttacaaacctttgctgtaataagtggctgtcagtagaaagctatctagcaaatccagtatttttgagaaaaagaaacacgtaatctgtcccctcaaggtaaaggtgacattttaacaatgagtggaaaattgcttttttttttttttgagacggagtctcgctctgtcgcccagactggagtgcagtggcacaatcttggctgactgcaagctctgccttctgggttcacgccattctgctgcctcaacctgacgagtagctgggactacaggcgcccgccacctcgcccggctaattttttgtatttttagtagagatggggtttcaccgtgttagccagcatggtctcgatcttctgacctcgtgatctgcccaccttggcctcccaaagtgctgggattataggcgtgagccaccgcgcctggccaatggaaaattgctttttgatagaaggttgctgtgatgagcgttttgtaaatggacgtttaggccagttgcggtggctcacacctgtaatcccaacgctttgtgaggatgaggcggacggatcacttgaagtcagaagtttgagaccagcctggccaacatggtgaaaccctgtctctactaaaaacaaaaattagctggacgtggtggtgtgcgcctgtagtccccagctactcgggaggctgaggcaggagaatcacttgaacctgggaggcgaggttgcagtgagccaagatcacaccactgcattccagcctgggggacagagtgagactctgtctcaaaaaaagaaaatggatgtttagaattgtctccattgtgtgtgtgtgtatatttgctaagaataatgtaaatagtcattttactgcacacttaaacttggaaatgaaattttgcagcttgtttaaaagcttccttttgtaacaatagtgtcttgaacttattaaaaatacaaaaatgtgataccttctgattactatgtaagaacaaggaactctgatgaagaagatgtaaattgactagctgaatttctttttctttttttttttttttgagacggagtctcgctctgtcgcccaggctggaatgcagtggcacaatctcggctcactgcaagctccgcctcccaggttcacgccattctcctgcctcagcctcccgagtagccgggactacaggcgcccgccaccatgcccggctcatttttttttttttttgtatttttagtagagacggagttgcaccttgttagccaggatggtctcgatctcctgacctcgtgatccacccgcctttgcctcccaaagtgctgggattacaggcgtgagccaccacgcccggcctgagccaccacgcccggcctgactagctgaatttcaacagaaaccttgcataattgattgatgagattgaaaaccagttttcataatttagcaagtgcagccaatgatatacttctacttcgctatatgtatctttgagtgggacctttttcagcaaagactgccagtaaaactgactctctaaataattgaatttagagtactcctaagatctggttttaacacaaagtattcaaccaagatttttaaaataatgaggtacaatcatattgatctccataagtttttttgtcatgatttttggtgacacaacaagttttgtgttgttattaaaaagtatgtgagaagatgattttattttcatctcattgtatgtttttatattttgtgtatttttttaatgaacataaattacattcattaactgctgcagagtgccttctgcgttaccagtaggagttacagggtgatctcaaaagccgtgcaccttgtgccatgcccagatgaacaggcacggttgtgtagactcaggatatgtgtgctcaggccttactggccaggtgtccctgccgatgaagtctgctagtgactgaacagggacttcttgggcacctcaatcatctctccaggtgggtcccttcctcctttcttccattaccctgtgcctctgcaggggtgtggctgttgccctccagcacgtcctgttttcctgttggggtcatggcttctgccttcgcccttcagaagcctgttatctactacttctcgtctccatttcccaccccttcctcctggttctgcctctgagaatccttcagagctggcttgatgccgccttttctattccacttaccttccaaccacagcagcaacttctctagtgatactttacacctttgttttacctatacattgattatattttatgagattggatattttaaaaaatatgatgttagctgtgggcttgtaaaattttttttcaaaaagattggaagtttattgaatgcagaacaattttaaggcctagtacgttgttcatagccagtaagtgtttcttgactgaatcaagtaagatacagaattagggattttaaaaaattgtctaaaaatgttaatgtcagtggctggacatggtggtgcacacctgtagtaccagctgctcaggaggctgaggagggaggatcacctgagcccaggagttgcaggctacagtgagctgtgattgtgtcattgcacttcagcctgggcagcagcaagaccctgtctgtaaaaataaataaataattttaacatcatatttgggtctgtagaagttttctgccatgtgaatttagacagaggccagccaatttcgtctgattttcaaatgtacattctaagccagcattccccacagtgaggtgtgtgttgttaccaggtgtagtgaccaaagtataaagggaaaaaacgagaagcattccagtgaaaaaggaggagtgattatttggagaataataaatcttagtaacgattgcttgaatgtggctttttgtgtacaacacagttgattagaaatttagttacttctgattctagattatagaaggattctgttaagattgttcttttccttttcctttggcatggaacctcagaaggtacaggataaagactttagatcattctggatgtttaacactagtgtggttactcattcagatttcttttgttgttgttgttttgctttttttttttttttttttttgatcttgctctgttgcccaggctggagtgtaatggtatgatctcggctcactgcaacctctgcctcctgggttcaagcgattctcctgcctcagcctcctgagtaactgggactacaggtgtgcatcaccgcacctgggtaatttttttgtatattagtagagatgtggttttgccatgttggccaggctgatctcgaactcgtgagctcaggtaatccaccctggcctcccaaagtgctgggattacaggcatgagccactgcgcccggtccagattcttgtgtagagccagctgatcggaaacccacgtgaggggttgagaaagtgtcatggaaactctgttgctaacagtggtggaatataaccttccaaaaattggattttatttagcagtaatacaaaagcagcccaaaggtagtttatcgaatcctatttattttattgtcatatttaagcacagttgtgcagatgtgagtttggtgctatttgccatttttattattattaaaacaaattctttttgagacagggtcttctccgtcacccggtccggagtgcagtggccgatcatgactcactgcagcctcaatctcccaggctcaagctatcctcctgcctctgcctcccgagtagctgggaccacaggcatgcaccaccacacccggttaatttttaaaactttaaaaaatttttaaaagctggtcttgctgtgttgcccaggctggtcttgaactcctgggctcaagtgatcctcctgcctcggcctcccaaagtgttagaattatgattgtaatccactgcacccagctgctaattccattaaaataaaataagttttcataattggttggactccagtattacctggaatttggtcacaaagttacagatttttagattgttctgggatttatatatttatctctagaattttaggatggcaaattgttgagggggaccataatttgatttcgtctcattcagatgctcttgaagtttgaaccacactgttagggtcagatgctggataagtcaaatacatctggaggttttcacatctaataagttacagaaactgagagtatgacttttcttcacttttgggtatcttctgaaattgtgactgaactgctaaatagcccaaaagtacttcagaatccgggattctggacagtagtgaatgttcgtagtctccacatgccattagttaaactcattgggccggtttgaatctgtacttccttgaacaaatcatggtacccttatgtctccctgcagggttgaattcagtgtgttcagatatcttctgtttgtaagaaagcagtacattctatgagttactgtggatttggtaaccctaactctgaatctaagttcagagagtcattctgtgctaaagaagcaactctaaatcgctgcagtgagctttggtgacatggctcaggagatactgaaataaaccaaatctccttatgtttttttcctccatatatctttaacttttcccaaggttccatgaactgttaccctccttgcagaggtcatgccacatctttcgttataggacacagcagtaaagggccctctagcctgctctcttgactggaataatgggaactcatttctccccatcatagtgacacaggaaataagccttgccatgtctaggtgcaaggctgtgggcagtttaggagacagtgtctctgtagggggaccagttaccccatgggtacaggccttggtgagctcctcctcagatcagggctaggctagttttcaggccccactccccggcctgggagcttttgtgatttaggagaatgcgtatttactgcaagtctcactcacagatgggccttactcaggtggtcatgtatcctgggtagtaagtcaagcactttgagtaccgaacacacagggcctatttctcttctgccgtacacttcctcccctacctctgcctgttgtattcagggttcacacactcagtttcgcttacggagtgggtgggggtgtgggcagctgtctgtgctgtggctctctccctatgggggacttcgcagagcctctttcctgccttgtcaccttacccataggctctgctctttagtgactccctccgcggccccagcccttcctcctggcagcttccaatgatgtattactggcagtgttgctttgtctttagttcacatttcccgtaagtggaccaaattatgtttttatgacaggccttgttgtgggtcctgaagagaacagctgtattgtacaggctgccctgtaccccatggattaattatccattctgagccctggaggagagggcaggttctagagtaccaggcagatgtggcaccaccttgccagcagctcggagactggtacttgttggcacagtgaacttctgtttggttatgtataaaaaatttagatttgtactagggttttggaagtgaatggcttctgaggtagaagtcctattttatttaaagatgtctttgtggaaaagggttttgagaggtatgtgtagagtgaaattctagagcagaacttttttttttttgacacagagtttcgctctgtcctccaggctggagtgcagtggcatgatcttggctcactgcaaactctgcctccttggttcaagcgattctctcacctcagcttcccaagtagcgggattacaggagcgtgccaccaagcccagctaatttttgtatttttagtagagacagagtttcgccatgttggccaggctggtgttgaactcccgacctcaggtgatccaccggcctcagcctcccaaagagctgggattacaggtgtgagccacagcgctctgcctagaccagaactttttgtttactactttctaaatcttggtcaaaggccaggcgctgtggctcacgcctgtaatcccagcacttcgagaggctgaggctggtggatcatgaggtcaggagatcaagaccagcctggccaacatggtgaaaccccatctctactaaagatacaaaaaattagctgggcatggtggcatgtgcctgtaatcccagctacttaggaggctgaggcaggagaatcacttgaacccaggaggcggaggttgcagtgagccgagattacaccactgcagtccagcctgggcgacaaggccagcctctgtgtccaaaaaaaaaaaaaaaaaactgggtgtggttgtgtgtgccagtaatcccagctattggggaggctggggcaggagaatcgcttgaacctggcaggcagaggttgccgtgagccaagatcgcgccactggactgcagcctaggcgacagagtgagacttcatctcaaaaaaaaaaaaaaaagtccaaggtaacatttcaagttttctaataccgtttcccctgaaatgaggttgtgtacggtgcctaaatggaaaccagattgtctgaggttgtggccccacagtgctcgctgcagtggggacttgggcgttctccagtcttcctagggacactgtatgtcctcctgatttgtaaactgagagatggaaatgagattaaaggctgtagggtgagctgaggctgcagataggttggagttgtcagtcccaggtaagaggagccctgtgccacagcctggtgtgggaggcgacatgttgctggtagctggacatagaagaaggggcctagaggaagtgggggagctcacgtgggacctggagggctggggcgaggattttggtctttagattaagtgcagttgggaacagttgaagggctttgagcagaggaggaattttttttttttttttttttaaagacctggctgcagtgagaatagtggtttgctggataacaacggaaggcagatagaaggcttttctgtaatccaggtgagaggcgacagtggcgatgggggtgagagagagagatgggttgaacgtagcaggatcaaagctaattcttaggattctgacttcagaaatgatttcctctgcatagggaatactaaagaagggctagatttgaggaacagcttgtacattttgttatgtttctttattttgggtctcatgctcttgagttcttggttgactcagtgtcagataagcaggaatctcctttcttcttcttcctttttttcccgcctcactcttactcttgtgtctctccctctcctgaatgtgctctactctcagaggtttgtgtatctggacatgtgtgaatctgtgttttaagaagcccatgaggccaggtgcagtggctcacacctgtaatcccagcactttgggaggctgaggctggcagatcacctgaggtcaggagttcgagaccagcctggccaccatggtgaaacccgtctctactaaaaatgcaagaatcagccagtgcgtggtgacgggcacctgtaatcccagctactctggaggctggggcaggagaatcacttgaacccaggaggcggaggttgcagtgagctgagatcgtgccactgcattccagcctcagcgacagagtgaaactctgtcttcaaaaaaaaaaaaaaaaggtccgtgtgtggatgtgtgtttttattgccatgtgtgggacgtgggtccttctctgctttcaccactttgactgtctgctccgtggctgcggtccctcagtgctgctgcgccacccctcacttgtgcgtttgttccaggagtatctgctgggagcctacctgtcgggctctgttctagactccctactgcctggagctgactttccagctggggaggctgatggacaaagcctgtcccgtggcgggaagaggtagggaggggtggtcaggaaaggccttgccagtgtggtgatacttgaacaaggcctgagggagatgaggggtgcacccggctctttgttttatctgggggaagaagtttctagtcaaagggagacaaacagtacaaaggcctcgtctgggagcacccttaggtgtccaggtaacaaggagacctgtgaggctggagcagaatgagtcagagaggctcaggggacaaatatgaaagatttttattcaacaactttggtttttattgtgttatgaggggattgtgggagggtttttgcagaagagtggtattgtgtcagttctgaaagagatcctccagatgtctcgtgggtgtggggtaaaggctggagcaggaagaccagttagagatgtggtgtcagtgtggggtgtctgatgggggcatgtgctgcactctcttgacatgtgctgtggaacgtcgggagtggggcgaggggtctcttctgtggaacatggggagtggagcacaggtagagactgagagggccggcctgtctcacaccaaggctgctgcatttgctcaccttgtgttgtctttgcagtagacagtgcccaggcgtcctgtgctctcgttcactgctgctgcagatgccaccatacataaatttggcttgggacatgttgagttcagagtgcctttgagatatccaaggggatatgtgaattaggcaattgtactgtagacatttgacccctaaatccaacttctgggagtcgtgtgtattgacggtcatggatgtggttggcggaagaagagcatctagtggaaagtgactgagaagggagccctgaggatctctaatgctcagaagcaaaaccgtgctttccaggactgcagcctcttctgtagtatccacgtttatgtctaacctgccttaaataaatgtggagctgggggagggtaaataaatacttacatgcatggcatttttaaatgacatgaattaatcattttaaattaattaaaaagaaacatttaaaaattttatctttttagtgtttcttcaaaaacaacattaagtcattaattctggccttttggcgtattggaagcattgaaaagctgaatgaaatcaagaaaaagttctggagaatagaagcttccagccttttgggttcgtgacccgcctgtgggaaggaggcctgccatccctcccctctgttggctcacactcctctaacttcttcctcttcctctttctcccacacacaaatgcgtgccatgctcctctgcccaggccttgggttaaaggcagcactaggccttccaccaagagacatgagtgaatgatcaggccaggcagcagagtgcacagcaagcttcagggcgaaggtggccgcgacacttgccaagtgagatgtcagaggcctatgccccaagaaagcatagatcaggtcaggtgacgagacggtggaagagaatcccaggtggccgtggcagcatgtgcaaaagtgtggtacaccagggacttggacatggtgatcatggaaggtttgagaacaggaatagtggcgctcagtcagggccaggcttgaaggaggatcaggagcatggacttcatagggaaatcgttttgaagatgcagtttattaagcaaacaataatttgagtttttaaatgtgttgggtatttgttagatactgggatttttttttttttttttttgacgctgagtcttgttctgtcacccaggttggagtgcagtggcgcaatctcggctcgctgcaacctctgcttcccgggttcaagtgattctcctgccttagcctcctgagtagctgggattacaggcgcccaccactacacctagctaatttttgtatttttagtagagacggggattcaccatgttggccaggctggtcttgaactcctgacctcaggggatctgcctgcctcggcctcccaaagtgtgggattacagacgtgagccatcgcgcccggcgagatactgggattgtaacatttggaagaattatgctccctgcccttcacgagtacacaccatcgtccataaagatgggccctctgctcttcactggtggacactatcttccctaaatgttcttgtgtgttgcttgccatggtcaggttacaaggacatgtcacatggagtggtctctgccctcaggaggcttatgtctcaggtgagttagacaacaatgagggatgcaagtagcagcagtccaggaggtcagattccttatagttcttttggcactactgaatgatttaagcagtaataccgggtagctgtgccacatacccagttatttatttatttatttattttttgagatggagtcccacattgtcgcccgggctgcagtgcagtggcacgatctcggctcactgcaacctccacctcccaggttcaagtgattttccttgcctcagcctcccaagtagctgggattacaggtgccccccaccacgcctggctaattcttttgtaattttagtggagacggggtttcactatgttggccaggctggtcttgaactcctgacctcgtgatccgcctgcctcggcctcccagagtgtggggagtacaggtgtgagccactgtgcctggaacacccagttattaacattagagcgggatgcagtggcatgtacctataggtccagcttcagggggctgaggcaggaggatggcttgagcccaggggtttaaggctgtattgcacaatgattgtgcctgtgaatagccactgcaccccagtctgggtgacatagtgatacttgctcttgctctgcctctgtctcccaggctggagaacaatgatgctattgtgacagcctcttgagtagctgggattacaggtgtgcaccaccatgcctggtgagaccttatttcttagaggcaaacaaaatctatatatctaaacactggccaatgcttatcagacactgttctaaacatctatatatgtgtgtgcttctagtcctcaaagtgatttgaagtagtaggtgctgttgttaccccaattttatgctgtggtaataggcacagaaaggcaaaggccttgttcagcactttgggcttaaggggctcatggagatactgtagcagatacagaggcagcaggaatagagatgtacctattctctgaccagtctttgtagtttagagccagtaattgctgtaacatattcacaaagcagttttttgagattttcatttggttgcttggttttctcacaggtgttcgtcttctcaatgttaccttatctaaggttttagttgatatgaggactaaaacacctgaacttttttgagagtattatggggtccgtgtaatatttattccaggtagttattgttattactactttttttcttttttgagacgaagcctcgctctgtcacccaggtgacatatcataccttataagatatttttggtgttaaagcatttaattttcaacaccatgaagtaaaaacacattgttagtgcttgggactattgtgttccttggaagacccactaaactttctagacctggaaatttctttgtcgtcattggtctaggtttaatgtttcttgctaaatcaagtttgacaatctattcactcaattaaagtggttttttttttgttttttttttttttgagacagagtctcagtctgtcactcaagctggagtgcactggcacgatctcagctcactgcaacctctgcctcctgggttcaagcgattctactgcctcagcctcctgagtagctgcaattacaggcgcccgccaccacacccggctaattttttaatttttagtggaggtggagttttgccgtgttggccaggctggtcttgaactcctgacctcaagtgatccacctgcctgagcctcctgaagtgctgggattacaggtgtcagccaccacacctgacctctgattcattaacttctgttttaatatttagtaacaacttgttcccattctgtttagggcctttctgaattgatttctaatctcaagctgttcatttttttcttccctcaaaataatactagcaattagagctatgaactttaagtacaacattggccagacatctaaagttttgttatactgtataatcgttttcagttttgttgtttttctgaatctgttcattcaacaaacatccattagcacgtattatgtactggttactgtggtagctactgggaatataatgactatcccctattcctctcttcagatactaaatattcttaggactgtaattgtagatttattacttcttctgttttttgtttgcttttgagacagggtcttgctctatcacccagtgatgcagtgaagctcactgcagccttgacttcccgggcttaagcaattttcccacctcagcctccttgagtagctgagaccacaggcgcatgccaccctgcccattcctaataaagtactctgttacttataatatttttctgattttaatttgctacccgtgcattttttttgcattgcctgctttattttgcttgtgtttgaaatttcatcattttaataataaatagctgccattttgactaatgattactgtgcactagactctgtatcaagcacttgacataccgtatctcatttgattctgtggcaaccttcttggtaggttttttttttcccccctcaatcttccatttacaaaaaaggcaactgaggcttggaggggttaattcttgcttaagggtaaacagtgagtagttttcagtcattcttgtactgtctaagtacagttgacccttgaacgaaggggttagggatgctgaccccattgtggagtcagaaattcgcttatacctttcaactctccaaaaccttaactactaatagcctactgttgaccagaagtcttaccaatactataaacattcgatgaacaaatattttgcttcttatagatattatctactgtattcctacaataaagtaagctagagaaaataaaatgttatatttactatttattaagtggaagtggatcatgataaaggtcttcatcctcattctctttacattggctaggctgagagaggaggaggaggaggaggaggcggaagaggagaggttggtcttgctgtttcaggggtgtcagaggcagaggaggtagaggaaggcaggcacacagtgtaactttatttttgttgaggcagggtctcgctctgtcacccaggctggaatgcagtggcgtgatcacagtaaaagagatgggggtcttgcttttgttgcccagactggtcttgaactcctggcttcaagcaatcctcccatctcagcctcccaaagtgctgggattacaagtatgaatcaccactacgcctggccagcagtatacgttttaaattaatccagagcgtaccttcaaatgatatcatggctgggcgcggtggctcacgcctgtaatcccagcactttgggaggccgaggagggtggatcacttgaggtcaggagttcaagaccagcctggccaacatggtgaaaccccatctctactgaaaaatacaaaaaaaattagccaggtgtggtggtacgcgcctgtaatcctagcagttacaaagtgcaattaaaaataaggctggctggacgtggtggctcacacctgtaatcccagcactttgggaggctgaggcaggaggatcacttaaacccaggcgttggagaccaacctgggcaacataacaaggtcctttctctacaaaaaataaaaaatattagccagacataatggcactcgcctgtggtcccagttactcgggaggctgaggtggaaggattgcttaagcttggggagttgcagcggcagagaccagtgatcatgccactgtactccagcctaggtgacagagtgaggccctgtctcaaaaacaaaacaaaaaaaaacagtgaaaacattgatttttcagcagtgagaatggctgttattaaaaagttaaaaaataacagatggtggtgaggttgtagagaaaaaggaacgcttatacactgttggtgcgagtgtaaattagtttaaccattgtggaagatgatatggcaattccacaaagacctaaagtcagaaataccattcaacccagtaatcccattactgggtatatactcaaaggaatataaattgttgtgttacaaagacacatgcatgcgtgtgttcattgcagcactgttcacaatagcagagacatggaatcaacccaaatgcccatcaatgatagatagattgcataaagaaaacatggtacatatacaccatggaatactatgcagccataaaaaagaatgggatcctgttcagggacttggatggagctagaggccattatccttagcaaagtaacacagaaacagaaaaccagatactgctggttttctgcagattctcccttataagtgagaataagcagaacagaaaaccagataccgcatattctcgcttatagccgatgagaacacatggacacgtagaggggaacaacatacactgtggcctatcaaagggtggagggtgggaggagggagaggatcaggaaaaataacaagtgatggctactaagcttactacctgggtgaagaaataatcggtacaacaaacgcctgtgacacatgtttacctgtgtaacctgcacgtgctgcacatgtacccccaaatttaataaaaggaaatgtgacccccaccccccattttggagctagggtctgctgggaagtgttggatcatggaggtgggtcttcatgaatgacttcatgaatgtcctccccatggtaatgaatgagttcttgctctgttagttcacttgaaatctggttgttaaaaagagtctggggcctcccccctctatctctggctcctcactctcttgccatgtgatacatttgttccttctttgccttttgccatgagtaaaagcttcctgtggcctcactagaagtggagcagatgctggtgccatgcttgtatagcctacagaactgtaagccaaataaacctctgttctttataagttttttaaaacccactgatttggccgggctcacgcctgtaatcccagcactttgggaggccgaggcgggcagatcacaaggtcaggagatctagaccatcctggctaacacggtgaaaccccgtctctactaaaaatacaaaaaattagccgggtgtggtggcgggcacctgtagtcccagctactcgggaggctgaggcaggagaatggcgtgaacccgggaggcggaggttgcagtgagctgagattgcgccactgcactccaccctgggcgatagagcaagactccgtctcaaaaaacaacaacaaaaaaaaaaccactgatttattttattccatttttgggattgccatttcttttgtagatctaggttttgttctgataccatattctctcttcctgaaatattttctttctttctttttttttttttttggaggtggagtctcactctgtaacccaggctggaatgcaggggcacaatcttggctcactgcaacctccgcctcccaggtccaagtaattctcctgcctcagcctcccgagtagctgggattacaggtgcatgccaccacgcctggctgatttttttgtattttagtacagatggggtttcaccatgttgcccaggctgatctcgactcctgagctcaggcaatccgcctgtctgggcctcccaaagtgctgagattacaggcgtgagccaccatgcccagcttctgaaatacttcaacattttatgtgggttaggtatgctggcaataaatttcctgtttttgtttgagaaagtctttctcctttattttatttatttgtttttatttttttgagacggagtctcgctctgtcttgctccagcccgggctggagtgcagtggcgtgatctaggctcactgcaggctccgtttcctgggttcacaccattctcccgcctcagcctcccaagtagctgggactacaggcccccgccaccatgcacggctaattttttgtatttttagtagagacagggtttcgccatgttagccaggatggtctcagtctcctgacctcgtgatctgcctgcctcggcctcccaaagtgctgggattacaggcgtgagccaccgcacctggctcttctcctttacttttaaaagattctttttctgggtatggaagtcgtagttaaaagctgtttttttctttcaagattttagagaaattactctcttctggtttttatggcttctcacaagaatcctgctgtaattgtttttgttcttccatgtgtaatgtttcttttatcactagctgctttcagtctctcctctcctcctccagccccctttcttttcgagacaaggtcttgctcttttgcccaggctgaagtgcagtgacatgatcacagctcactgcagcttcgacctcccaggctcaagtgttctccacctcagcctcccaagtagctgagaccacaagtgtggtctaattttttaaacttttttgtagagatgaggtcttgctatgttgcccaggctactcctgaactcctgggttcaagcaatcctctcaccccaacaagtgctgggattacaggcacgagccccatcgtacttggtcagtgtttatttccttccttccttctccttccctcctctctctctttctttcttattttcatagtcttagttgcgcatgacttttgtcctaattagttgtgtatccagttgtcttttgttttcagaagtaaagaagtgataggaccaggtgtttttttgttgttgttttttaacgttctctgtgcttcttggatctgcagtttggtgtttgtcattaattttggaaaattctcaaccgttatttcttctgctgtttagagttggcctcagtttattatttgctgtgtgttatgcagcacaggctttgaatgtttgtagaggcggcttggatctaggatgaggagtgttttaccatggcagtgtttgaaattctgtcttaagtcttctttctttgttgtatttcacaggaggtttctttgcatattcttctcccagttgtattctgctgttggctgttgtttgaagctttttgacttggaagtgtgtagcggtagtgagatgctgcctccttttctggttaaggctcagttttttgttgttgttattttttgagacggagttttgctcttgtctcccaggctggagtgcagtggcacgatctcagctcactgcaacctccacctcccgggttcaagcgattctcctgcctcagcctccaaagtagctgcaggcacctgccaccatgcccagccaattattgtattttcagtagagacagaaccctgtctgtctttgaccacattggccaagctggtgccaaactcctgacctcaggtgatttgcctgcctcggccttccaaagtgctgggatcataggcgtgagccactgcgcccggccaagtctcagttttagacatgtctggtaaccctggatttcagaggtgcagctgtctcagttcttctgccttttccctggctataattttggactcagtgtgtaatcctgccccttttgcaggactaggtctctcctgtccctctcttcccttccccctgctgcccccaaattaggacttttgtttctgagtggagattgagaggaaggatttgagtggaatttctttcccctccttcctggcttctggtcccctccctgagttctgcgctactgtctttgcttcttcgggctctttcagatcttttcagtgattgcctcatgagtgccacggagaaagagcctgcaaagtaatgcaggctttcccagtttctgcagttgccagaaattgtcctgacagcctgtactcagcctttcgcaatttgtcttttattcttgctgaactcttcttactagtgtgtctgattgtgtctaccccaggtgagtgtatttgttttctttccctgaaggcacttaagattatgggccagtgtttgttctgtaaccacagctctccagcaggttcagaaacagtcatggatatgaagttagtctggctgttttgcactgtaaggttgagcattatgctgtcccaggtctcttcatcctagggcagaagacagaagcagccatgtcttgaggaacagaagttttttggtgtaagtccagtttaccaatttttttaatgattagtgcttttggggtctcaagagatctttgtctactccaaggttgggaaaaccttcttctttgttttcttctagaggttttataattttagctgttatatataggtctgtgatctatttcaacttaattttgggtatggtgtgaggtgaagttggaggtgtcccccactccatattcatatccagttgtgtaccatttattgagagatctctccctatggaatcaccttgttcatttgtcctttaacaatgttctttaaacaacatttcttaaaaaaattagcggtgcttggtggctcgcacctgtaatcccagctactcaggaggctaagcaggagaatcgcttgaacctgggaggcagaggttgcagtgagtgaagattgtgccactgcactccagcctgggcgacagagtgagattccgtctcaaaaaaaaaaaaaaaacacccatctctaaagaatatttcttactgttaaatactataaaaatgcataaaagtaatgtacaggtttgcaaattaatttgacccctggtataagcaccattcagataaggaaatagaacattaccaggactccaaaagcctgctaaaggctactactcgattacagtttcctttcttttcctttcgttaaacatactaaatggcagggtgcggtggctcaagcctgtaatcccagcactttgggaggccgaggtgggcagatcatgaggtcaagaaatcgagaccatcctggccaacatagtgaaaccccatctttactaaaaatacaaaaattagctgggcgtggtggtgtgtgcctgtagtcccagctactcaggaggctgaggcaggagaattgcttcaacccaggtgacggaggttgcagtgagccgagaccgtgccactgcactccagcctggcgacagagcaagactctgtctcaaaaaaaggaaaaaaaaaacaaaccaaaactaaacatcccaacactatagttttgcctgtttttgtaccttatataaatggaagcatccatactgaatacggtatataacttgtctcacccaacaatatttgaaagatttatttgttttgaacttagctatggtttatccattttaattcctgtatagtatttcaccatatagatgactgttcattcattctacagtttatgggttatttccagtttgggactggcatgaatactcttgtacatgtattttggtgcatacaggacttaatatgaggaaagatagatatccagaaaaggaattactgggtcatagtctacatgtattttcacagtcttcatgtaatgcctatttcccaaagtggttatacctattttcactctaccagcagtgcttgagagttcccattgtttcatgtttttggctgagcgtgggttttgtcctaattttttgtttcagcctctctggtgggtaaatggtggtactatgatttaatttatctgtgatatctgtgacatatgtttatgtctatggaccatttgggtcatctgttgtgaagaacccgttcaagtcttttgcccaattttttcagtcaagttgtatatctttttcctatttttctcatttttcacttttttttgtcatttttttcattttcttaatgtttatcaaatagaagttttaaattttaggctgggcatggtggttcatgcctgtaatcctagccctttggggaggccaaagtgggcggatcacctgaggtcaggcgttcaagacgagcctggccaacatggcaaaaccccgtctttactaaaaaatacagaaattagctgggtgtggtggcgggcacctgtagtcctagctgcttgggaggctgaggcagggataattgcttgaacctgggaggtggaggttgcagtgagccaagattgtgctactgcacaccagcctgggtggcagagtgagactgcatctcaaaaaataaataatttttaaatagttgaatctgggctgggtggggtggctcatgcctgtaatctcagcactttgggaggccgaagctggtggatcacttgaggttgggagttcatgacaagcctgatcaacatagagaaaccccatctctactaaaaagacaaaattagccaggcgtggtggtgcatgccagtaatcctagctactggggaatctgaggcaggagaatcacttgaacccaggagggagaggttgcagtgacctgagatgatgccattgcactccagcctgggcaacaagagcaaaaactccgtctcaaaaaaaaaaatatatatatatatagttgaatctgttgatcttttcctttatgctttagtgcttttggtgtcttgaaaatgtttccctttacccaaggtcatgaggatattatccatcatctttcacatttaggtctataattaaagaattgatttttgtgtatggtgtgagataggggcccagtttttttttccccccggtttgggtatctagttgttctgtattaacttcaatttaaaaggccattctttccatagtattgtagaatgccatcttggttataaatttagtgtatgtgtttcataccttggttataaatttagtgtccgtgtatcataccttgattctatattccttcgtctacttttctatccttgagcggccagtaccacactctctgaattattatagcatttgttgttgttgagaacagggtcttgctctgttgcccaggctggaatgcagtggcaggaggatggctcattgtagcctcaacctcctgggctcaagcaatcttcccacctcagcctcctgagtggctgggactacaggtgcatgccactatgcctggcttatttttaaattttttgtagagacggggtctccctctgttgctcaggcggtcttgaactcctgggctcaagcaaccctttcacccaagcctcccaaagtgctgggattacaggagtcagctgccatgctcagcctagtatagctttttaataagccttaataggcgttctgtattgttcttcatgaatgttttggttattcttggccctttataattttatgtgctttatgtgaaattaaacttctgtatcttagtccgtttgtgttgctataaggaatacctgaggctggataattttgctcctggttctgcaagctgtgtaagaagcatggtgcacagcatttgcatctggtgagagcctcaggttttttccacttacggcacaaggtgaagaggacccagtgtgtccagatgacatgatgagagaaaaagcaagagagatgggaaaggaggtgccaggctgtttttaacagctagctctcagggaactaatggaatgagaactcactcagtgctggaaagacagcaccaagccattcatgagggacctgccctcatgacccatgcacttcccattaggcccacctccagcactgggtgtggtggcacgtgcctgtggtctcagctgctcaggagtctgaggtgaaaggatcgcttgagcccagaagttcgagactagcctggcgacctagcaaaacctcgtctctgctaaaaatacaaaaattagttgggcatggtggtgcatgcctgtagttccagctacttggcagactgaggcaggaggatcacttgatagcccgggtggtggaggttgcagcgagccaagatcgtgctactgcagtccagcctaggcaacagagtgaccctgtctcaaaatatgtaaataaaagaaaaagaaaaaaattttgaaaagaaagagctggggtggacaactctgaaggaattcactgaaaaggaaggaaaagataggcagtgagagaagctggggcagaagtgctactgagaggagatcgttgtgtttcttcagagtgggagacagcatatttgcatcctaatggaagtgatgcaggaaagaaagagaaagtgatgatatgagaagaggacagaatcagtggtcctcaagtggcgacagggtggggtctggttgtgaagagctagttggaggacattggagaggagggcacaggcgcaggtctgcggatgtgtgggagctgtgaaaactactgccaagtgcttttccaaaagattgctggtgctcacaccaccctcagcagtctgtgaatacccatcttcctttatactcctcagcacagagtccatgtccctgttcttccctcctgggcaccctgctccgcattgacggagctcgagatccccacatctactccactgctccccttcctctcaacttccatcattaggctcagggaccttggccctttccctgtgtcctgccgtgaaagttctggtgcctctttaccttaagtcgtctcctcatcttttgacttacatggaccataacatttttagtcatcagcctggtgacttagctttatcaacattgtattatgggaaggagaggattctataaaaaagcaagtattgcctgtgggccccactgttttaggtcactggctagcctctggtttggctgtccttgggtcagatgcctccctgctgccaggggagcacaggtgatggtgatggatgagggtctgatgatggggacctccccatcagcagaggtgtgggtgacttggggcttgtcgggtgtgcaaatggctactttggatttgcttcaggtcacttaattttgagatgctacctacctattccatgtgttgtctctgaataaaagccactttcagcctctgttctatttaagtagttttatttttctctctggtcatttctgggtattgctgtaaagactgttaataccttatgcaaaatgactggttactgtgatttttcaggaccttcagagattgaagggttacaaactgcagtgtgagaagttagtaggcctttgataccaactttttatttgaccttagtagattaactttactttaaagattggcaaagaacggtatgttagaaatacatgtaagtctgctgctattaataaattcaagctgttttgcccttttgctgtatggagcctgaatgtagagacttgaagtattttgtagatatttgtgctgtcccatgacagagcagggatatgaaacttgccctggcatccagacatgttctgaggctggctcagatatttgttttcttctggataagtagcatcaaaacaaatagtaattatattatttaatagacttaaaacacggcaactacatttgtataggaaaaaccacattagtaacattacatggagaaaagcattttatgtaactatagttccagcaaataccactatgccttcattaatgccttaaaaccatcttatttacatctgtagaaccactggccatttaatagggcaattcaggagcaatcattaaaaacagttgcagttttcattaggttttctctgtttattctaatatgtaaactgaaattaaaagtaaatccttcagagttcattctttaaaaaaagtaagtcctaaggaaaactgttatattagctatttaaaaggatgctgtaataatgtagaatcagtcactgttgaattttattgagtttccatggaacagccttgaaattataaattgctagatatttactctgtaagattacagaaattatttatcacagagccttaaatacttaaggtaattttgtgcctaactcatgatatgattgttaccaatctctttgtaaccactgagaaggaggtttaagtattaatgttagtaattgctctccaggcaatgccttttgctcagagaacctgcatatgctttgggaaagctgagttcaggaaagaaagggtgaaaagggcacaggtattttagtgactacacataacagtgttccctggacttgagtgcaggtagctaataaaagatcatgtataggctgggcttggtggcttatacctgtaatcccagcactttgggaggccgaggtaggcagatcacgaggtcaggaatttgagatcagcctgaccgacgtgatgaaaccgcatctctactaaaaatacaaaaactagccgggcatggtggcgcaggcatgtaatcccagctactcaggaggctgaggcaggagaattgcttgaatccaggaggcggaggttgcaatgagctgagatcacgccactgcactccagcctgggcaacagagcgagactctgtctcaaaaaaaaaaaaaaagaaagaaagaaaaggatcatatataaaaatgcagaaaattggctgggcgccatggctcacgcctgtaatcccagcactttgggaggccgaggcgggcagatcacgaggtcaggagatcgagaccatcctggccaacgtggtgaaaccccgtctctactaacaacgcctgtctgggcgtggtggctcctgcctgtagtcccagctacttgggaggctgaggcaggaggatcatttgaactcgggaggcagaggttgcagtgagccaagatggcgccactgcattccagcctggtgacagagcgagactccatctcaaaaaaaaaaaacaaaaaaaaacaaaaaaaaacaaaaaaaaacaaaaaaaaaacaaaacaaaattaaaaaacagaaaattgtgattgaggtaggcaagacaaagtgtgtattattgatttggactagacatttcagttcccttagcatttactgggcgcctactggttgctgggtgcattatggacattcataatgttgagtgtctaatgggaagatggacatgtgaaagataattttgtagtataatgaatatatgatagtctataggaagtgtagaagttggccaggcgcagtggctcacacctgtaatcccagcattgtgagaggccgaggcgggtggatcacgaggtcaggagatcgagaccatcctggctaacatggtgaaaccccgtctctactaaaaatacaaaaaattaaccaggcgtggtggcgcgcgcctgtaatcccagctacttggtaggctgaggcaggagaatcacttgaacctgggaggtggaggttgcactgagccgagatcgtgccactacaccccagcctgggtcacagagcaagactccctctcaaaaaaaaaaaaagagtgtagaagttgtacaggagttgtagtaattagctgcgtgtgacacgtattgattgaggggtagggagcaaaattcacagaataaaaaagttaccatagtggggtttgaagggatgcctcgcagttgtcttgtaaaggaaaggcggggagattggtgttttagggaagcaagcagcaagtatgaaggcaggaagagataaagccacatagttggttggggcgggagtgtggaactgtaaggagtttcaagtgggtgattttgcaagaacacactgaccaagggcctggtgtatcctgcttgatcctttgctaaggacttgatctttttaggcagcaggaacaatcgaagggtttaaggcagagaatgttctggtcataggtacagtgtgagggggttttgacaggagatggagggcatgtggggagcagacagccctgaaggccggtcggcaggaggtggcagcgtcaccagcacggggcctttgttgtgtctcctgcattagccttcatagggcggtctaatctgggttgtgctgctgttacccgagaggatattgcttttactgtgtttttaccctaagatgaccttttttcttcatgtttataagaagtttatctgtaaagtatttttagtaaatctgggttttcatgtttaatttggaatttcattttggaaacaaatttcaaaactagaatataagcctagcaagaaaacaaatgctattatgatttaatgtcttttatgatacacacacacctcccacccccatgcacacaggccacagtcactgggtggtagaaaatcagtttattcagaaaaggtaaaatacatcatagatggtagaactcagctgttagtagtgttcccaaagtgttttcagcaatactgccatcttagccatatgtccgtattctcctatgcaaaaatttctgggttatcttggtcccttacatggatatatatacacattttatatatttacatatttcatctatgtgtttgtaggatttgggggatgatactagtaaaatgttcattctggtacatatatataatttttttttttgagatggagtattgctctgtttgcccaggctggaatgcagtggcgcgatatccgcttgccgcaacctccgcctcatgggttcaagtgattctcctgcctcagcttgagtagctgggattacagatgtacgccaccacacccggctaattttttgtatttttagtagacacggggtttcaccacgttggccaggctggtcttgaactcctgacctcttgatctgcctgcctcggcctcacagagtgttgggattacaggtgtgagccaccgcgcccagcctgctacatttattttttaaaaatatcaatgtaactagatttctgcttccaagcaagaggtagtaactagaagtggatttatcttcctgtctcaaacagtgaaacaaaggaccaaaaaaatgtaccaagtagtagttttccaacattggcccacaggcaggcaggacagtgatccctgagagaagaagaataaccgcggcaagctccagccttgcccaggcttcctgcctggagagagtctgaaggctaggacttggagagctacccagaccgagtctgaggatctccttgattgaggaggctgagttgagactttggggaggccaaagtaaatttgcagggcagagtaccagagaggagagagctgcaaagaggggaaggaagagctctgcatagggttctccccaagcccagctgagggcgcataagcacatgcctgtggggaagctctctgcgcctgggctagcaccctggaagtgaggagcgggacaaaccttgcagctcacacagggccaggagcagtgtgtgttcccaccagccattgtgggaaaatcttacaacctgcaggaccctgggtggcagcttaggaggatattgcctcagttgtgggtaagaggaaaggcgttctgatgctgccttacagagcctacaagccctgaaaggaccagactcttcccaaacaaccctcctatggcccatgacgaagctcagatactgaaggaatgaaaaaatacccagcacctgacgcttcatacttgtccctagctcttctcctcctctcacacctcacagctggctccttcacagccttatccacttcccttcctgcagccctggtccaagctgctgctgtctggctcctgaactgcagatagtcgtttcttcccattgtcccatcccatctctctctgcacgcagcctcagagtcactccttgacttcagtggccctcagctctcccccatctctccttctgctcttgtcagccccatgccagccactgggctccccacaaggtacagccatgtcggcttcgggggtctcctcaaggaggccctcactgtccaccgggttaaagggtacagatcttctttgctgttatgtttttctccttatcactatttaattagttaattttttcatgtatttgtcttatttattgcctttgtctttgacagttttcttcaccattgtgccctcagtgcctggaccagtccctgagcatgtgatgggctcagtaaatcctggatgactggtgaatgtacaggagctgagctgtgcgctctctggtcatttctggctcttaacattatgattttaggcttggggacctttgggcctgtagagcccagcatctcattctgtaattaaaagggcaagccagaaaggtctgatgggtatggctgttctgccagtgatgggagctgttttctaagacctgaggaaaagagatggctttatattggggtaaatcagtgtgcctttttttttttttaattgtcgtcatttaggcttttgggatttgttggtatggaaaaatacatggattctcatggtactcggtggtttgagtagtctggcgttctctaggacactgtggggaggtaggacgcagttgtctgcccctgtgccccaaacattcagctcaggatggctgctgagctgggtttgggaaaactcacaaccctgtggatgtaacaggagtcagcagttttgatcactggttcatggaaacatgtgagaatatatatgaacatcttttgagtcttgctggtattgtcattcattctttcaatcactaattcattcatttatacattcagccccttgtttaaatatgtgcttcctgccggtcagcaggaagtcttaagaatggagcctggggtccaaatgagagccctcagtggctgttcaggggccaatccgttatgtacagtgggtccttttgaataccggtggtgggatggggagacagctcgaggctgtgggaagagctacaggtctagccggccttggagaagcttctgggtggagatggagactgaaaagccagaacagcgtcagctgggtccactctcttcccacctggcatgtcttgcagcaaggacaccctacacggcaggagagactagcgggggttctctcacctccaccccactgtgtgccctttttctggctgcctctggaaggccaggcgaggcttccctttgccctgctccctgggagtgcctccctccagcctctcctcagggttcgaaggggcttcctcctaaggtgcagaggcagccctgtgtgaaggacccgtcttaggattgggttgatacgggttaaaaatcctgtgtctcccccgacacacacacacttgctggtcttgggactttaaccccatttccagttgtgtgagactcagtttctttctttttcttttcttttccttttttttttttttttttttttttttgagacttagtcttgctctattgcccaggctggaatgcagtggcgtgatcttggctcactgcaacctccaccttccaggttcaaacgattctcctgcgtcagcctcctgagtagctgggattacaggtgcacaccaccacgcccagctaattttgtgtttttaatagaaacagggtttcaccatgttggccaggctggatttttctttcttttttttttttgacacggggtcttgccctctcacccaggctagagtgcagtggcacgatcacagctcactacagcctcgacttgctgggttttagcaatcctctcacctcagcctccctagtagctgggactacaggcacgcaccactatgcctggctaatagttggattttttgcagaggcgaagtcttgctatgttactgaggctggtctcaaacctctgagctcaaatgatcatctcacctctgcctccccaggtgctgggatcacaggcgtaagccactgtgcccagccttcagtttctttttctgtatttgtgttttaaaggctaattttattttttttctgatagagtgggtggttatcttttgagaggttttaaggtataacaatcttgccttttcctcctacctctaaggcctcttccccttgccccacattgtaggacctatttgaaaatgcagatgtttatttacatcaggtgataagagatgagctcagcatcattactgctgggcctggaagggcgtctgggccttggatgtgcagctgccatcagctccctgtttatcttgaatctggaatttggacagccgacctcaaagatggtttgcatctgcagacacacttaagccagaattgccatcttgaatctgagccctggtgtgcagatgcctctagaatagtagtttcagacttcgttggtggtaaccagttctggtaaacagtctgaaaattgaggctgacagtttctagcatgtggtggaaaagtaatacagaagtcaaggtgaaggggttaattttgacaattttctaactcgtactaagataagattttctttatggcactatttaaagtattacgagtttctagaacattaggtttagttttattcaatacatttcctattttatgtttctgtatataaacatacacatgcattttagttttagaactatacatatattttaatattcttggctttgtagatgaggttttgaaaatagaattttttttttctattccagactccttttagttttggcatgaatcataggacaccaccctaccctgctggggattattgtcttctgtgcagaagtgaacggaaagactcatcattcttagagagtggaattaagactgcgagcaaattggccctttccatggctcccaagggcaacagcgtgctgcacctgccactgtgggtgtgcccggactgccgcaggaccgtggagaaggaggagaggcatggcggccttgaccagccagtggtgagtggctgccagcacaggcagcgcagggcgttggctccccccgcccaggttatggggtaactggcagtgaaagaaatggatttgcttttgcttcagggggcactccctcctgcaccaccttctagtctgtgtctcctggtacgttcctcctggtcttccctggccacactgcagtaggtggcaggacacctgccctccttgtctgggcacaattcagtcatcaagctatgtgaccctgaagggtgatttttggctttgagcttagtatttctttggtggtacagtttcttgaaaagggagtacaattttcatgtgtttagttctcaacaattcgacatgcaggtaattctttacgcgatgctcttaagcctcaccttcccttttacttatttgtgctgcttcagcctcttcgaggccacagcaggcttggctgggaagaccgcacccttactcttatctttgacctgatggagttttggtgggcccttgttccgggcaggctttcacatgtactgtttgggttctggaaggagttggcttttgcaactatttgagaccccacattctaggcctcttctgtgccctttgatttctgcttgaaagcggctaattattttctgagctcttctcttccttctgataccttgctatgtgcagccaggaaacgtgtgcattccctgctcctctgttttctcctgcagaactgccttgggggagtcctggtgacaatctgaagagcgcatccccactgcctggtgtgggtttccatctttactggccttggaggcaagccccatctccagggccagtttctatccttggggtctcattgtcagaattactttctcactcggcccctcccgcatgtcccgctttcctgctgtaattctcttcctagcacttatttctaacatactatgtattttacttactcatttggtttgctttcttcttcattagaatataaactctacaaagacagctatttttatggttttctttgtgtggtttttttgtttgtttttttaccaataccattttctttgctttttgtggtggttggtttgttttctcattaaactttatcagctcttcttccgactccagccctgctcttgtattttagcctgcctctgcccttgggaacaggcttctgctgtttgccctggtccagaggccagcggaagtgcctatggttccctgcagtgcgtcttgcctgcgttggaggaggatctcatttcccagcccccggcttgtcttggtaatggatagtttgtcagatgagccattctctcctcaccagaaacagtgaccttgggaacagcagaggtgtagtgttggcctgtgtttgtggattcggaccagctgttgctttgtaggtcagcctctttgttggagctggcctttaaaaaaataacatgatttaccttccattaagattcactctttttttacttaaaaaatgttcactaccacagctaagctacagaacatttgcatcaccccataaaatccccttgttccccttggtagtcacttcccttcccccgtcctagcctctggtaaccactcacctgaatttttttttttgagacagagtctcgctctgtcacccaggctggagtgcagtggcacaatcttggctcactgcaacctccgcctcccgggttcaagcaattcttctgcctcagcctccccagtagctgggactacaggcacgcgccaccatgcccagctaatttttgtatttttggtagagatggggtttcaccatgttggccattatggtctcgatcgtgatccgcccgcctctgccttccatagtgctgggattataggcatgagccaccgcgcctggcctgacctgatttttgttcctacagttttgctttttccagagtgtcacatatacttctgtaacttgcataatgcttttgagagttacccaaaatgttgcatgcatccgtagtttctcttttttattgagtaattttacagataaaccaatttatgcattcaccaattaattgatggatgtttgtgttgttcccacgtttgggctattttgaaaaaagctgctatgaacattatttttcttctgtggacatcctttttatgtgttgctggattgatttgctaaagttatgttaatgatttttgcatctgtgctcatgaaggctgtctgtaggcctcttgtcttacagtggccttcggggtctcataaaatgagttagaatgtgttcctgtttcttctcctttctggaagactgtgttagaattggtattatcatctcttccttaaacgttattggttcttgctttctgtttctcttgttctgtttggtcaaatgccagacagtgtgcagagagcatcaggctgaggttgtttcctgtgtcctgttgtgcacctgggaggccaggtcagtgcatttggcctcagctgggctgtctctagcactgtgcgtgctcgtgtgggcctgtagaggggagtctctctctacttcctccttggcaaggtctccgatggtggcatcttctcagttcccccctctagcctgactcttgggcagctctgtgctcacggccttgggggcagctttcccagcgagcccacctctgcccggtggcagccagactctgccttgtatctgcaggggtctgaccggccccgtgtcttgtgctggtcctggcctgtgtgtggcacacgcctttctccaggacaaggagaaaggcatgtttccttcctctctgctagtggattagctggagacttgggtgcaggtctcctgggaatgagtgggaacattcgttttggggctttccaggggttagactcccacacttgacactctcaacctttcagaatttgtttaaagttaaactgttttttttttttctaaccacttttatggcctccttccactttccttcctctgtcaaaggtgaaacagtaagtgtgtccccttctccctggaggggctgctgcactttgttgtgtagttccctccggcagcctggtcacttcggctctctgatggcccagagataggattttatcaattgtcctgctctgtctctggtcagggctctggtcagggctcagagtgcacggctctcctgcagctttctgcatccagaggggaagtggggctgaattgctgtcttctagataagcattctgttatcagcagttgtaggagaatattggtgggaatttatcttaacatcttgcctgacagttgcacgttgcaaatttctctggagacctcttcttccaagattgacccatcctagcatcacgtcctagacatagtcgtgcctggaaacctaagaaatctccatttcaaactttcatcttgatcattgtctgtctttgtagctcacttgcttgtcttctcttgccatagtttttttttttttttgagacagagtcttgctctgttgcccaggctggagtgcagtggtgcaatctcagctcactacaacctcacttcctgggttcaagagactatcgtgcctcagcctcccgagtagctgggactataggcatgcgccatcacacctggctaatttttttttttttttagagacacagtctcgctctgtcaccaggctggaatgcagtggtgcgatgttggctcactgcaacctctgcctcctgggttcaggtgattctcatgcctcagcctcccgagtaccggggactataggcgcgcaacaccacacctggctgatctttgtatttagtagagacagggtttcgtgatgatggccaagctggtctcaaactcctggcctcaaatgatctacctaccttggcctcccaaagtgctgggattacaggcgtgagccactgcgcctgacctgccatagttctttgacctcatccatccctatcagtccatggattccattcctgttaggtttatcacgtctccccgacctcactcctaggagcctgagttcccggacttggcactgtggctcttccgtggctctcaggcaaaggccctgaactttttttggttatgctggtccagccctgtctcttccctccatgtggcagaatattcatggagaaaattgctggcctcagtttactgcttcctcttcataacttcatgactgcaaaccatgcatgggcatctagtgcgtttttctggcttaagtacctccccaaactccttggcaggaacccttccttttccttgcttcttagactacgtgtaccctctttacccaccccttgctcagctcagctattgaccttcgtgcttcagggagaaaatcaaagttaacacctcccctgtatcacccccaaacccccatagctgagggcattttctcctctctttcctctccaaggcccacccccactgggctttcaggtgcccatctgttttcatcttcttcaagactttgtcgctttgattattgttttcttctgccttggcccatgacccatggaatgcaaatactctggggctacccattcatgaatgacccgcctttggcctcacctccccttcacagccatgtatgtctctaggtagattttaaagttgtggttcaatttctttaatggttaaaatcttgtcaggttagttttggtaagttatattcttagaaattgtcaaagttgcccaccagcgtggcacatgcctgtagttgcggctacacaggaggctgaggcaggagggtcgcttgagcccaggagttctgggctgttgtgcggtatgatagtgccactgtactgcagtctgggcagcacagtgagaccccgtctcttttaaaacaagaaaaattggcagagttactggtataaagttctgtgtaatggtctcttttcacttcttacctgatttgtagatttgactttttatttcttcttcttcttttttttttttttttttttcctgagatggagtttctctctgtcgcccaggctggagtgcagtggtgcgatctcagcttactgcaacctctgcctcccgggttcaagcgattctggtgactcagcctcccgagtagctgggactgtaggcgcgtaccaccacacccagctaatttttttgtatttttagtagagatggggtttcgccatgttggccaggctgttctctaactcctgacctcaggtgatccgcccacctcggtctcccaaagtgctgggattacaagcctgagccaccatacccggctacttttttatttctcatatttgtgccttcttttttttcttttaaactagttttgttagaagtctgtcagttttggcccagcacagtggatcacacctgtaaccgtagtctttgggaggccgaagcaggaggattgcttgaggccaggagttcaagaccaacctggctaacatagaaagactctgtctctataaaaaaaaaaaaattataaaccaaaaaaaagtcttgtcagttttgtctttccaaagaagcagcttttaacttttaaaatacttgtactttgtctgtttaattaattgttgctttttattattattatttttaagatagattctcgctctgttgcccaggccggaatgcagtggcgtgatcttggctcactgtaacctccacctcccaggttcaagggattctcctgcctcagtctcctgggtagctgggactacaggcatgtaccaccgtgcccagctaatttttgtatttttagtagagacagagttttgccatgttgcccaggctggtttcgaactcctgacctcaagtgatcctcctgctgcggcctcccaaagtactgggttgacaggcgtgagccactgcacccaggcaattattgctattttatatacatacatgtgctatatattaatatttgattggttgatgctatggtgaatgtgatttaaaaaaaaaaaatttagaggcccgaaagagaacagtgcaaagttagtttcctctggctctctctctttatcctctttgccttcccagaggcctccactattggcagatgcttgaatcttcctctagagatgttctgttcttttttttttttttttttgagacagagtttcgctgttgtctcccaggctggagtgcagttgtgtgatctcggctcactgaaacctccacctcataggttcaaacgataatcctgccttagcctctgagtagctgggattacaggcacgtgccatcaacccagctaatttttgcatttttagtacagatggggtttcaccatgttggccaggctgttcttgaactcctgacctcaggtgatccacccaccttggcctcccaaagtgctaggattagaggcatgaggctggccatgtttttcgttttgatgtttttgtttttgttttgtgacggaatctcgctctgttgcccaggctggagtgcagtggcgcgatctcagctcactgcaagctcagcctcccgggttcacaccattctcctgcctcagcctcccaagtagctgggactacaggcgcccaccaccacgcccggctaattttttgtatttttagtagagattgggtttcaccatgttagccaggattgtctggatctcctgaccttgtgatccgcccgcctcgtcctcccaaagtgctgggattacaagtgtgagccactgcacccggcctttttttttttttttttttttttttttgagacgaagtctcgctctattgcccaggctggagtgcagtggcgccatctcagctcactgcaggctccgccttctgggttcacgccattctcctgcctcagcctcctgagtagctgggattacaggcgcccaccaccatgcctggctaattttgtgtgtatatatatatgtatatatatatattttttagtagagacggggtttcaccgtgttagccaggatggtctcagtctcgtgacctgcccacctcggcctcctgattgctgggattataggtgtgagccaccgcgcctggctttttttgtttttttttttgagatggagtttcacgcttgttgcccaggctggagttcaatggcgtgatttcggctcaacgcaacctccgcctcttgggttcaagccattctccttcctcagccgccctagtagctgggattacaggtatgcactaccacgcccagctaatttttttttttttttttttttttgagacggagtcttgctcagtcacccaggctggagtgcagtggtgcgatctcggctcactgcaagctccgcctcctgggttcacaccattctcctgcctcagcctcccaagtagctgggactacgggtgcatgccaccacgcctgactaatttttttttgtatttttagtagagacggggtttcaccatgttagccaggatggcctcgatctcctgacctcgtgatctgcccaccttggcctcccaaagtacaggtgtgagtcactgcacccggccaattttcattattttctagtttttattatttctgttttcacccgtgaattatttagaagtacgtgtaagtatccaaacacatatctcttgaattattattattattattttgagacggaatttcactctgtcacccaggctggagtgtagtggcacgatcttggctcactgcaacctctgccttctgggttcaagtgattctcatgcctcagccttctgagcagctgggattacaggcgtgtgtcaccatgcccagctaatttttgtatttttagtagagacggggttttaccatgttggccaggctggtctcaaactcctgacctcaggtgatccgcccgcctcaccctcccaacttgctgaaattacaggggtgagccaccacggccagccacttgaattacttttaatcatgttgacttttaatttaatgctgttatagttgaaaatcatggtctgtatgatagtgattccttattaatcactgtatttgctgtatttgctagttctaatacatagttacttttttaaattattctgtttgtgctggaaaataatgttttctctgggtttaggtggaaggctcaggacctcattaattgtgttcttaaatccttctgtgtttccgtggttttattgcttttttggtgcttaatctgtcaatttctgagtgttatttaaaatgtcctactatgaatgtgtctttttcctgtcttccttaaaaagtttgttttgctttacatatttcaagagtgctgggtagaatacaggttgaaattattattaagtctttaagtcttggcgtatcattcctgttactgcacggaccccatctgtggtcgtgcctttctcctgaagggcgttgttttctgtttgtttagctatgggagctccctcccattcttttttttgcacatctgcacatccttttaattttgatttctttgtgttagtctgtttaggtgttcttatgcagtatatatagaggtagactttacgtggttttaattgagagtctgctttttttcttttttctttttcctttttttttttttttttttttttggtggcaaggcctctctctgtcactcaggctggagtgcagtggtgcgaaaacagctcactgcagcctcgacctcctgggctcaagtgattctcccagcttagcctcctgagtagctgggattacagctgcacgccaacagtcctggatgattttttttttttttttaaattttttgtagggatgggtccctactgtgttgcccaggctgatcttgaactccggcgcccaagcaatcctaccaccttggcctctccaagtgctggcattacaggtgtgagccaccatgcccaggcgagagtctgcatcttaatggtgaaatcaatcctcatcacttactgtaatggttaatatatgtggggtaatttctgctaccatgcaggtcaaaaatcaagcgttgctgttaacccagatcccttcttgaaccccttctagtcattaccctcttgcagcaagttcacacttgccggctgctcctagtcctcactcttactgttctttgttagttatatcacctaagcatctacccacaaatactgtagtacagttttcctggtgttttgaattttacagaaatgtaatcgtactgtgtgttattttatgtcttacttattttgctcagcattatgtttgagagtcataaatcttgtttctctattttcattgctagatgccatcctcctttgtgaacatgttgcattttagttgtttccaaatcttgctgattgtggagcacacatgacattctgttgtctataaatagaaggaattgctgagccataggtggtttatatacttgactgattccatgttaagatcagtagcatgtttttaaatgaaaactattttccaaaaacaagaatggtttagtaagtagggccggacacggtggctcacgcctgtaatcccagcactttgggaggccaagatgggcggatcacctgaggtcaggagttcgagaccagcctggccaacatggcgaaacctcgtctctactgaaaatacaaaattagcccgtcatggtggcacatgcctgtaatcccagctactggggaggctgaggcaggagaatcacttgaacctaggaggtggaggttgcagtgagctgagattgcaccactgcactccagcctaggcgacagagtgagactctgtctcaaaaaaaaaaaaaaaaaaaaaaaaaaaatggtttagtaagtagagtggccgtgttttgtatattttgcaaacctctttttttttttttttttttttttgagacagtgtctcactctgtcacccaggctggagtacagtggcataatctcagctcactgcaacctctgctgcctgggttcaagtgattctcctgcctcaacctcccatgttgctgggattacaggcgtttgccactgcgcccggctaatttttgtatttttggtagagatgggggtttcaccatcttggtcaggccggtcttgaaatactgacctcgtgatccacccacctctgtctcccaaagtgttgggattataggcgtgagccaccgcatccggcctaacaaacctctttaatatctgaatgatagaacaaagctggtttcttatatctgcctctgtgtggaacctgttgtgataggttgttctgattgaagtatttgaagaaatattttattggcttttttagagaattgtggatatttttctttgatgctgtaccaaaccatgacaagttagtttctcaagggttaggtgtagtgtagaagctaaaaccaatcagtggcttttccctacactgttatgtgaaagtccattggtctgtcttgtcctctgaatggatatcttgcccatgcgtggcttgtaacatcacatgttggttatttgtaaagtattggtttactaaggtagacagattttcctgatattaatacttttcatcattatttttaaaaaatcatatttgttacaaaaaaatcatatttgttaataccaccactgatctcatcagaaagttctttaaatgttgagttttcaagcccacagtggcaggtgaaagttttccagagttctaatttttgctcagaaaaattatgattatgagaaaagctcagattttattggtcacaaatagtgccaaattgccttgaagtgacggactcattttgttcattttggaaaatatctgacaaatatccaagtccaaataaccatagtttggcccatcagtcactttttgaagtaaaattgacatttcacaggtgaagggccattcatctcacaatgcacagtgagattcctcgaggcggactcttcctggggcgtgccggagaaataaatgctctgtgtatacttcccacttcgtcacgcagaatattcagaagacttgtgctcaggggttgagatttatgcaaaataattatttttattgcatcaaggacattcttaagtggaactggcttttttcccgcctcacagctctgaagtgtgtggcagtgaagaatgcagcagccactagcatgctttgctcctgctgtcttcgtccttgcattggtgtttcactcttttccccaccattgtttttttccctgtcagtgtgaatgtcagcacagtgaaaaaggcagaggacattttggtacaaatttgaaaatagttttgactcgtgggcctgctgaagggtgttagggtgaaaatcctattttgctagccattagtagttaaccacagatttcttgaaacttgctcaactttttaatatctgtctgctgatacatatttaacataggtgtcaaccagatttgtttttagtatttggaaaataatgctttcccttctaattcttcattatagctttaacactgaaatttgtcagagaacttagttaattatcaatgatatgttcaggttggcaactaggcttatagcatggccttaccctcgctgcggctctaggctatgctggaccatctgaatggggtcctcggaccacactttgagaaccacagctctgttgggttgtctttttcttattgacttgtgggatttctttatatacactcagtagcagctctttattggttgtatgtgttgcagatattgcctgtttcttttttgtctgtttttcactatgtgatggtgtcgctttatgaacacagattcttttctttttttaaccttgagatgctaccagggcagccactcaccacagcccctgctggggtgtgaatgtgcaccacgcacttcacgtccgggtgtgcagcataaattgcagagtgtaaggtgaagccggcctgattcactcccagattagtgcttccacgatctactatatctccttgtagattgatcttaacctgaaaataaaaaaataaaaatttaaaataccaagaggacttcatttttcttttctgttttcgagacggtcggtctcgcccagtatggagtgcagtggtgcaatcctgattctctgcagccttcacctcctgtgttcaagcaacccttctgcctcagtctcctgagtagctgggactacaggtgcgcaccaccatgcctggctaatttttttatttttaatatagacggggttttgccatgttgctcaggctggtctcaaactcctgggctcaatcagtctccctctgtcgccctggctggacctcagatgatctgcctgccacggcctcccaaagtgctgggattacaggagtgagccactgcacccagccaaatatgataatgagccaggggtagtgggaagcatatttagatcatgggcgggtcagcaatatgcccatgggctttgccaccagagtcctgtgtcctggtgtgcctcggcacactgtttgccataggctttgaggagagtgttggttggtcttaataacattctatctcgggcccagaggtagcccactgaaggagaaattcagagaagagaggtgggatggctgagacatttttgcatagacctgcaaggggacaggcctgactaaacaaatcttgctccttaatagtcaggaccaagcctgtgttgaacttagcaatttggtttcagctaatcatcgatctctctctttaaaataatgttgttaatttgaatttcaccttttttttttttttttgagacagagtctcactctgtcgcccaggctggagtgcagtggtgccatcttggctcactgcaagctctgcctcccgggttcacgccattctcctgcctcagcctcccgagtagctgggactacaggcatccaccaccacggctggctaattttttttgtatttttcatagaggtggggtttcatcgtgttagccagaacggtcccagtcttgtgaccttgtgatccacccgcctcggccttccaaagtgctgggattacagatctgagccaccgtgcctggctgaatttcaccattttaaaaatatttcactttaaaccaccttgagtttttacattatatgaaggctaaaagacatattatgttgcattttaacatttgcatatgtttaacaaaaatagttttagtctggtgggagatacggtgaggggatggcactttggggtaattgttttttctttaaagggccctgaactcaagcatcctgtcataaagaagactactcggcaagtagtcttaagtttctatctatttttctgttttcaaggctgttttagactccattttgattatgggcattagcagttgtctttattctcatatatcatattattaaaatgtaagttgcattttacactaaggaactgggttctccaatagttattatgcccatagattaatcaaggcatatagtcccaacttaagccatttaagagtttgctggcgtaggccaccgtgcacggcggcctaggccgatcacgcctgtaatcccggcactttgggaggccgaggcgggtggatcatgaggtcaggagatcgagaccatcctggctaacacggtgaaaccccgtctctactaaaaatataaaaaatcagctgggtgtggtgttgtgcatctgtagtcccagctactcaggaggctgaggcaggagaatccctctaacccgggaggctgaggtttcagtgagctgagatggcgctacagcactccagcctaatgacagagcgagactccgtcttaaaaaaaaaaaaagagtttgctggctgggcgcagtggctcactcctgtaatcccagcattttgggaggccgaggcagatgggtcacctgaggtcaggagattgagaccagcctggccaacatgatgaaaccccatctctactaaaaatacaaaaattagttgggcttggttgcgggtgcctgtaatcccagctactcaggaggctgaggcaggagaatcgcttgaaccagagagttggaggttgcagtgagccgagatcacgccactaaactccagcctggcgacagagcgagactctgtctcaaaaacaaaacaaaacaaaaaaaactcgctagtatttgtcattatcttgaattgttacccaatggttactacgcccatagatcaatcaaggcatatagtcccaacttaaaccagccatttaagagtttgctagtattggtccttaccttgaatgcttgccctgttgggttttaggtcatattagaaacgtacagatttctttgcagtgaacttcatgaaagtagttgctaatgtaatttgttggaactactcaaaattgccagattgacttgagttagccttacagaaagataagctgagtggtgatctttggcttttttcctttagcataatgcttttgagagtcatctctgttgttgcatgtagcaatagttaattccttttatttctgggtaataatccattgtatggataaaccacaatttgtttatccattcatcaatagagagacgtttgtattttccagtttgggctgttatgagtagagctactaggaacatttgagtatcagtctttttttttttgagatggagtttcgctcttgtcacccaggctggagtgcaatggcgcgatctcggctcaccgcagcctccgcctcccaagttcaagcgattctcctgcctcagtctcccaagtagctgagattacaggcatgcaccaccacgcccagctagttgtgtatttttagtagagacagggtttctccatgttggtcaggctggtctcaaacttacaacctcaggtgatccactcgcctccgcctcccaaagtgctgggattacaggcatgagccaccgtgcccggccgagtatcagtcttttaagtggatgcaatttacttctctttgataaacacctgggagtggaattgctgagtcctatagggtaagtgcttatactgttctgcagccacgtatgagaggtccagttgatctttatctttgccaagtgctggatattggcagtctttacttacagccattctagtggtttgtagtgttatccttcattatggttttaatctgcattttctatttatttatttatttatttatttgagacagagtctcactgtgtcacccaggctggagtgcagtggctcaatctcggctcactgcagcctccacctcccaggttcaagcagttctcttgtctcagcctcccatgtagctgggactacaggcgccagccaccatgcatagttaattttttttttgtatttttagtggaaacggggtttcaccatgttggtcagtctggtcttgaactcccgacctcaggtgatccacccgcctcagcctaccaaagtgctgggattacaggcgtgagccaccacgcccggcttaatctgcattttcttaacgacttgttgagcatcttttcatgtacctattttccatttgtatctctttggaaaagtggctgttcagatcttctgctcatttttattgagttgtcttaatgagttgtgagatatttttatataatctcaatacaagccctttattagacaggcttcacaaacattttctctcagcgtgtgactggcattttcattatacagcactgtcctctgaagagcaaaagatttatattttgatcaaatccattttttttttttttttgagacagtctctcgctcttttgtccaggccggagtgcagtggcactatctcggctcactgcaagctccgcctcccgggttcacaccattctcctgcctcagcctcccaagtagctgggactacaggcgcccaccaccatgcccggctaattttttgtatttttagtagagacaggatttcaccgtgttagccaggatggtctcgttctcctgacctcgtgttccgtctgtctcggcctcccaaagtgctgggattacaggcgtgagccaccgcgcccggctccaatttgtgtttctaaatgattttgtgcctttgtgttccatgtaagaaatctttgctactcaaggttataaagattttttgccctggccgggccgtggctcacgcctgtaatcctagcactttgggaggctgagacgggtgggtcacgaggtcaggaatttgagaccagcctgaccaacatggagtaaccctgtctttactaaaaatacaaaaattagccgagacggtggcgtgcacctgtaatcctagctactcgggaggctgaggcaggagaatcacttgaacccaggaggtggaggttgcagtgagccgagattgcaccactgtactccagcctgggtgacagagtgagactccatctcaaaacaacaaacaaacaaaaaagttttttttgcttgtttgtttttttctgtcttaatagttttagcatatacatttaggtctatgagccaccttgaatgaagcttttatctgttgtaagggttaagagtcatctttttttgcatactgatatccagttgttcagaactatttattgaaaagacaattttatctcattgaattaccttgggacctttgtcaaaaatcagttggttctgtatgtatggatctattattggatgctgtgtcccactttacatatattcctattcctttgccagtaccatactatcctgattcttgaagctatttatagtaagtcatgaaattacatagatgtctaccaactttcttctttttcaaaagtggtttggatatattagatcctttgcattgctatgtaaactttagagccaacttgtcagtttctacagaaaagcctgttgggattttaactggcattgtgttgactctatagatcagtttgggggagaattgaaaccttaacaatattgagtcttcaagtctatgaatatggtataactcttcatttatttagatcatttaagtttattttcagcattgttttgtagtcagtatattaaaaactttagtagtcagtatattaaaaactttccagacaggcacagtggctcatacctgtaatccagcactttgggagttctacgcaggtggattgcttgaggccaggagtttaagaccagtttgggcaacatagtgagatcctggttttacaaaaaataaatacattttcccaaagtattttatattttcttgctattttaaatatactctaaaaagtttcaatatttgtttattgctagtacatagaaattcagctttttttttttttttttggatattggccatgtgtactgtaaaaactcatttattagttctatgggccttttggtaggtttctttttttttttttgagacagagttttgctctttgcccaggccggagtgcagtggcgcgatgtcggctcaccacaacctctgcctcctgggttcaagcaattatcctgcctcagcctcccgagtagctgggattacagtcatgtgcccccatgcctggctaattttgtatttttagtatagagacgggtttctccatgttggtcaggctggtctcgaactcccgacctcgggtgatccgcatgccttggcctcccaaagtgctgggattacaggcatgagccaccatacctggccttttttttttttttctttttcttttttttttgagacagagtctcgctttgtagcccaggctggagtgtagtggcacaatcttggctcactgcaacctctgtctcctgggtcccggttcaagcaattctcttgcctctcagcttcccgagtagctgggattacaggtgcgtaccaccatgcccagctaatttttgtatttttagtagagacggggtttcaccatgttgaccaggctggtgttgaactcctggcctcgtgatccatgtgcgtcggcctcccaaagtgctgggattacaggcctgagccaccgcacccggccttccttaaaattttctatgtagatgatcatgtcgtctacaaataatgtgtttcttcctttgcaatctgtgtatcttcattttttcttgcccaattccactgactagtttttccaatgtgagattgaataggagtggtgtgagtaagcatcctcttgctcatgatcttaggggaaagcatttggtctttcttcatgtagtatagatcagattgaggaaatttacttatatttttagtttgctaagaattatcattatgaatagatactgaattttgtcatactctctacatctgttaagatgataacagagttttccttttttagttaatgaaataaattttggtgattttcaaaatgttggaaaaccttgcattcctgggataactcacatttggttgtgatgtattatccttttgctaggttgctggattggatttactaatgttttgttaaggatttttgtgtctatgttcatgaaggatattagtctataaatttcttgtctcacatctttgtgtggttttgatgttaggctaatacttcattataaaatgagctaggatgtattttctctttgattttccggaaaggaaaagtttgtgtaaaattggcattatttctaccttaagtgtttggcagaattcaccagtaaagctgtcttggtctgaagttgccttattgggaagattttgaactacaagttcaattcatttgatggaggttatctgtttctttgttagtgaactgtgctagtttttgtctttaaggaaatttgcccattttatattaaatgttgtgacataaagttgttcagaatatttattacctttttaatttccataggatctctagtgattgcttccctcctctttttattcctgataccagttttttgagttttgtctttttttcccctaagactggctagataatttaactgatcttttcaaagaaccacattttgttttaattgcttttccattttcttttttgttaatttttctctttattaatttcattcctctacttattttgtatttatttattttttttaagagcagtcaaacaaagcagtgggagtcaagaaggaacaaagaaatctgtactggttgtgaacagttagttatcaacagcactgcatttgtaccagcctgtttgttatcaacagccttgcatttgtaccagcttgttttggtttcttaaggtggaagtttacatcattttatttgagacctttcttcttttctaatttgtttaattctatacatttcttttaaaatttgcaccaatcacacaggatctataaatctctgtctaagcattcctttagctgcatcccacaaattctggtatgtttttcattctactcaaaatattttataattgcctttattatgatttgttcattgacccatgttttgttcagaagtatgtttttattttattttattttatttttatttttgagacggagcctcactctgtcaccaggctggagtgcagtggtgcgatctcggctcactgcaacctctgcctcccgggttcaagcaattctcctgcctcagtctcccaagtagctgggactacaggcgtgcgccaccacgcccaggtaatttttgtattttttgtagagacagggtttcaccatgttggccaggatggtcttgatctcctgacctcgtgatctgccgtcctcggcctccgaaagtgctgggattacaggcaagagccaccatgcccggcctattttatttttttagacagagtctcagtctgtgcccaggctggaatgtagtggcgcgatctcagctcactgcaacctctgcccgctctggttcaagcgattctcctgcctcagccttctgagtagctgggattacacatgcacgccaccatgcccggctaatgtttgtattttagtagagacagtgttgcccaggctggtctcgaactcctgagcttgcgcaatccgcccgcctcagcctcccaaagtgcttgggttaaggcttgagccaccgcgcccggccgaaacttctaaatgtaactatggattggtatatttatttcaatttctactttaggtattttgagctctgttgttatttaccatttagcactgttatttctaattgttgaattaatgccaccaccatcatcatcagcatcagcatctccctctttgttgttactaatccttgttgtgaagcaaactttgtcttatactgagagccacctagccttttttcattagtgtgtacatggaatatggcttcccaacctttctttttaacctgtctttatcatctcttgtagcttaggagctcttgcctttttaaagtctagtctgaccttctctgctaataattgtagtatttacactctttccatttaatgtaattagtgatctgtttgggtttaaacataccatcttgcattttttctcctgtttttcccatctgttatttgttactcttcttttaaatgaattgaattttttttttttgaaacagggtctcactctgttgcccaggctggagtgcagtggcgagtgatctctgctcactgcaagctccaccttccaggttcacgccattctcccacctcagcctcccaagtagctgggaccacaggcacccaccaccacacccagctaattttgtttttgtatttttagtagagacggggtttcaccatgttattagccaggatggtcttgatctcctgacctcatgatctgcccgccctggcctcccaaagtgctggggttacaggtgtgagccaccacgcctgcccagtgaattgaatattttaagtggctgggcgtggtggctctcgcctgtaaccccagcactttgggaggctgaggcgggcggattacccaagctcaggagttcgagaccagcttgagcaacacgaagaaaccccgtctctactaaaatacaaacattagccgggtgtggtggcacatgcctgtcatcccagctactcaggaggctgaggctggagaattgcttgaactcaggaggcggaggtttcagtgagctgagatcgtgccactgcactcgagcctgggcgacagagcgagactccatctccaaaaaaaaaaaaattaaaaaaaaaaaaaagaatattttttgacccatgtattggtcagaagtatgtttttattatatatatatatatatatatattttttttttttttttttttttgagatggagtctcactctgctcccaggctggagtgcagtggtgccatctcagctcactgcaacctctgcctcccgagttcaagcaattctcctgcctcagcctcccaagtagctgggattacaggtgcccaccaccgcacctggctaatttttgtatttttagtagaggcggggtttcaccatcttggccaggctgatctcgatctcctgacctcgtgatccacctgcctcgccttcccaaagtgctgggattacaggcatgagccaccgcgtctggcctatgaatattttaaactctttcattttgtctcctgttgaccttactacctgtatttctttttctttgttttataattttttagctatagcttccacttttcagcctctactctcaaagaatagtataccacttcacatgtagtgtaagtaccttacagtagtatacttggagcgccaccatttctggtgctaatgtagtcgtgtgtttttcttacatgtattatacacctcagcatacattgtcattttttccctttctttaaatagcgaattatcttttaaaaagaccttataaataagttcttgacccacatctttatcatgtgtggtgctctccattcctttgtgtagatccacattttcatttggtattattttccctgtctcaagaactgcctttaacatttcctgtaggccagggtagcttctgtttgaaatcttttttgcctttgttttaaaaagatatttctgtttggaatttgaggttgttggtcatttctttcgtggcctctccagtttgtgatgagaaacacgttgtcgtccttatctttgctcctgcatatgtaaggtgactcgttttcctctctgtgcttctgagatttgcactttgtcactggttttcagcagtttgactgtgatgggcctcagcgtgctttgctttgtgtttagtgtgctttgggttaattgagcttgcagtgagtgtgggcttacatagtgtgaatttatagtttcctcaaatttagaaatatttcaagtatttcttcacgtagtcccctttttttctgggatgttagacatcttgagtttgtcctacaaatgctttgtccattttttcagtcttctctgtgcttcattttggatttatttatttatttatttatttagagacagtcttgccctgtcgcccaggctggagtgcgatggtgcgatctcggctcactacaacctctgcctcctgggttcaagtgattctcctgcctcagcatcctgagtagcggggattataggtgcccgccaccatgcccggctttttttttttttttttttttgagacgaagttttgctcttgttgcccaggctgaagtgcaatggtgtgatctcgtctcactgcaacctcctcctcctgggttcaagtgattctcctgccccagcctcctgagtagctgggattacaggcgtgtgccatcacacctggctaattttgtatttttagaagggacaaggttgctccatgttggtcaggctggtctcgagctcctgacctcaggtgatctgcccaccctcggcctcccaaagtgttgcgattacaggtgtgagccactgcgcctggccaatttttgtatttttttgtagaggtggggtttcaccatgttggtcagactggtctcgaactcctgacctcaggtgatccacctgccttggcctcccaaaatgctgggattataggcgtgagccatcgcgtctgggctggattatttttattgcctgtgttcaggtttattggtattctgatctgcttaatctgccaagtgtgtttagtgtatttttttcttttatgtcttatttctcagctctggaagtttcatttggtttatttatttattgacatcttcagtttctcttcccatcgtgtttatttttcctctgtttcttgaacatatggagtttctttataattgccaatttcagattcttgacagttgtatcatctctatttttggggagatctgtttctttttttcttttttatttttttgagacggagtcctcagtgtgtcacccaggctggactgcagtggtgtaatctcggctcactgcaacctccgcctcctgggttcaaacgattctcctgcttcagcctcctgagtagctgggattacaggcacgtgccaccatgctaatttttgtatttttgtatttttagtagagctaaaaatactaatttttgtatttttagtagaggtggggtaatttttgtatttttagtagagatggggtttcctcatgttggccaggctgctctcgaattcctgacctcaggtggtcccgcccgcctctgcctcccaaagtgctgggataataggcgtgagccaccgtggctggactggggaatttctttctttctttcttttattgttttgagacaatgtctctctctgtcacccaggctggagtgcagtggcacgatctagtctcactgcaacctcccctccccttcctcggttcaaacaattctcctgcctcaacctctcgagtggctgggattgcaggcttgtgcctccatgcctggctacattttgtatttttagtagagttgggattttgccatcttggtgaggctggtctcgaacacctgacctcaagtgatccactcgcctcatcctctgaaagtgctgggattacaagcgtgagccactgcacctggcctgggggatctgtttctattgattggcttttcctccttcttaggagtcattgtcctgcttttggtttcgttactggatgctggacattgtgaattttacattgttaattgctggattttgttatttttcttttaaattgtgttagacttgggtgaaacatgactgaggttaaatctgtatatgatgagtgctataatgggacacatttaaggatttaatatgtagtcatcatgtaccctattttaagacttactttcatgtcttgtctccaggaaatgttgctttcccaagttcttgattgcttttctgagtgtactgcgttccagccatgatgataggcactgatgtaccatagtgagcaagtagataggttctggctctcatgaaccatgaattccagtgttgaagacacataaaaaaacaagaacacagtagaacaccaggatttcagatagcagtttaatagaggagattaactggggtgtttaggttgatgggtaagctagagctcaggagatgggcaccgcgctcataatcagaacaaacacatttttaacataaagaataattagcaagtggcagggtgtgtggctcatgcctgtaatccagcactctgggaggctgaggcaggcgggatcgcctgaggtcaggagttgggagaccagccttgtcaacgtggtgtaaccccgtctctactaaaaatacaaaaattagccaggggtggtggtgggctcccgtaatcccagctactcaggagaatcgtttgaacccaggaggcggagtttgcagtgagccgatatcacagcattgcactccagcctgggcaagaagactgcaactccgtctcaaaaaaaaaaaaaaaaaaaaaagtaattaacaagtagcgacaggtcagccacccagatccgtgaagtgaatgctaaagaatatggccggggcagatttagggagcagccactaacgggagcttagggaggggactcaagaaaggaacaaacttggaagaggccctgacatggagggggtgtcattatgccccactgggtagcagagaggctccctgaggtcctgcaggctgggactgagtgctggagagtgcgtgcctctcagtcccccacacaccactgatgaggagctgcctcagggtaagagcaagatgagaaaagcacaggaacctggagggagaccccttcttcttcaccgtccctgtagtaccctccacccataggaccacacattgtacctacctgctggcagaggagaaatgtttacagggtgcagctccttcattgtaagtgtggcgaagaagggtggatttggagttgagaggcaaaaaaattaattgactcaaccagcctccctcagtaggtgatctttttgctgaggcctgatgggacagtattctacagtctaccagaagccaatcagaggctcactgactaagggtacgaggcaaagggagcaagggcagtgacttaaaagcagaactttgacctgagcaaccttgaaagctgtggtaagaaatacggtgtttgctcctaagtgaagtggaggagaacagaggttttatgtagggagctctgtgatctcactctgctgctgcttggagaatggatgattagtacatacggaaataggtgtgccactagagagagccagtgcagctgtgcaggcaagaggtaggtgatgatggcttagactgggttggaagcagcggaggaagaatgggtggattgtggaggtgcttaggattgaggtggagtggacaactttgctgttagatgggcgtgggatggaggagagcgtgaacctcgcttgttgaagggaacggactcgcttagggaacagcctcttctaccactgccctctccttgccctaccatgcctcttcagtcagaactccatggccttccagccacttttggtattggaataaccacattttcaggtactcaggtccagtctacataaaaacctaaatgtggcttagtgtggtggctcacgcctgtaatcccagcactttgggaaatgaaggtgggcggatcacttgagctcaggagtttgagaccagcctgagcaacatggcgaagccctgtgtctaccaaaaatacgaaaaattaagccaggtgtggtggcgcatgcctttggtcccagctactcaggaggctgaggtgagacgattgcttgagcctgggaggcggaggttgcagtgagctgagattgcaccactgcactccagcctgggtgatagagcgagaccctgtctccaaaaaaaaaaaaaaaaaaaaaaaaaacctaaatgtctcatctaattaattcaaagcctcttcccctcatgttaagtgatggcaggagtccccaagggcagagggcggtggtgtatgtcctgcttccttatgcctgtcctgttcctccaggatggagaaggggcactggagcggagacttgggggtctttgttctctgctgggttgtctaggttctttttggcccactagcgctaggcctgtggtcctaatgggtggcccagtggttgctggctctttcttgttggtggcgggggtgctgctttagcatgctcaggctgctgcaacaaaatgccatgggctaagctgcttgtaaacagcggacatttatatcttatagtctggagggctggaaggtctaagatcaaggtgctggcagattggtgcctgggaagggccaagctttggttcatagctggtgccctctctctgtcctcgtgcggtggaaggatgtggcagctctctggggccttctttataaaaggacactaattccattcacgaagactccgacctcatgacctaatcaccacctaaaggccctacttcctgatacattaccttaggggttaaaatttcaacttatgaacgggggcgggcgggggcacaaacattcagaacagagcaaaacattcagacctttgggcacttctgagaccttggtagggacttcgtgctggactgtctagtggaaactgtgtgacacaaccagcctgcccccaaccccctaccactgctgtcccgcactctgccccccttccctcatggtgtaattctggggtctgcttccccagcaggacctatttggggtgggattctttcaggatgacacaagctcttaccctcctgtgtgctggcggcagctgagctgggtcccctgctgtcttttttttttgagacggagtcttgctttgtcaccaggctggagtgcggtggcgcgatctcggctcactgcaagctctgccttcgggttcaagcaattctcctgcctcagcctcccgagtagctgggactacaggcgagcgccaccacacccagctaatttttgtgcttttttagtagagacagggtttcaccatgttggccagaagggtctcgatctcttgacctcgtgatctgcccgccttggcctcccaaagtgctgggattacaggcgtgagccaccgcgcctggccggtcccctgctgtcttaatcctctgcccacttagcaacgctcaggcttttctgctgcagggtcttacctgcaaggcctgcaccagtgtctgtgtgacccaactccacagcacctgccacaggcccttgggagtttccttgtgcttggctcagcagcagactggggtagtgcaagcatctgaacagaccttgccaagtccagcccagggtgagccccaggctccttgccacaggccaccacccgtctctctgggggcttgtctcagtggcttcatgcttgactgggggaggggttggtgaggagagcacacttttccttgtggggaccagagtgggaatagtgcaatactcaagacttaggtgaattcctttctggaagtctctcttgtgactgtatttcttttcctcatgctgtgggggtcagggggatgcaatgattatggagctggcagcccctgtcatgagcctggggaaggctctctagcaccctgcatcaccctgtgggcaccctcagctctgagacctgagccctgagcccctgttcccaaggagcagagtccttctcagggcctcttctagaaggagccttggtgccgatggaagggtaactgagcgggaggaggaacctagggttgtgttgtgttctctagttgttgttggtgaaatccttttggcgtgggacataggaaggtctttgcccaatgttctctctctctttttttttttgagacaaagtctcggtctgtttctcaggctggagtgcggtggcgcgatctcggctcactgcaacctcagcctcccgagtagttgagattacaggcgtgccccaccatgcctggctaatttttgtgtatttagaagagacggatttcaccgtgtgggtcaggctggtcttgaactcctgacctcaggtgatccgcctgcctcggcctcccaaagtgctgggattataggcgtgagccactgcccccggccaagtgttctctttcttaagcctccttgttcctcagagcaggcagtgcaggctatgggattccccaggacggagaggcctctgccccggctgcttgatgcaaggctcagagaggccactaggtttctaccatgtgctgtctcaggcaaccgtgggcatatcactttccagaggtgcccactgaggtggtcattgtgtgtgctgattaggacagtgggagtaaaactgttcctttttaaatttaatataaattaatttttaaactttttaaaaaaatttatatagagatgaggtcttgctgtgttacccaggctggtctcaaacgtctgggctcaagtggtcctcccatctcggcttcccaaaatggtgggattacaggcgtgaaccgccatgcccagccgaattgtttcctttttgtatgtatgtgtgtgtctgtgtgacaatgtctctgtcacccagacaggagtgcagtggggcatgatcacggctgactatagcctcaacttcccaggctcaagtgatcctgtcacctcagcctcctgggtagctgggactacaggcgggcaccaacacgcccggcctattttttgtatttcttgtagcagtggtgtttcaccatgttgcccagcgatccacccacctcagactcccaaagtgctgagattacaagtgtgagccactgtatctggccaagatagtttcttttcaatgtttaggttttacagttttttaaaaggcatttttcctgaacagttaataaaaaattgatgccgtgaacattttaacataactggtctattctgttctctttttaaaacagagccaagattttcttcttcactcctcgcttggtggctcccagccagaggccggcagtggtgggaggctcgctctgggtgcacagacgctgccttcagacaccgcatgctcgtgcgaggcctgcagtgagcgcaggtatgtgacgtgtgtgccacgttgctcacacctgtccacaatgacatgcagacctgcatattggagctggacggagaaactgggctaatgtgacagacagcaacaagagtaaggcagttgcttcgctattgagagaaagaaccatatgagtaagacaaaaactgttgctcttgaggaactggcactaggaagcatcctcagaacaagagaaggagtccttaaataatcagaatctaagagcagcctcagtgaatgagaggagcgatgggggagagcctgactggctgcttctcagtggctgaggggagagccctggagctcatctttttttttttttttttttttttttgagacagggtctggctctgtcccccaggccggagggcagtggcgtgatctccgctcaccacaacctccgccttccaggctcaagtgatcctcccacctcagtcccggtatctgggactacaggcgcgcaccaccatgtcgggctaatttttgtatattttatagagatggggcttcgccatgttgcccaggctggtctcaaactcctggactcaaacgattagcccgtcttcacctcccagagtgctgggattacaggcatgagccaccatgcccagcccaggagcacatctaaaaatgctctgtgctctggctcaggaaggaatgcatgtagccaagtgggggccaaagggtgggggcaaagctgcccattaagtaccttggaggtgaaggccaggtcagcagtggggatgtgggtaccctaattgtggacattagccacagatgctcctgtcatctgtgcagtggctaagatcttacgcagagtgcaccctaggagctgtgctggggatgccatcacccccctgcactgacagcagcctgattgccggctcctgggagctgggcaaggtgcaagagcctgggaggtcctctgaggacagtgtgctaggtgaggaagggcagcagattgtggtgactttctaaccttcctgtgttgtctcacagagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggtacatactgccctttcctgttgtggccccatgcaaacccctgccctccctgctgcacttggagccactcctttcaggatgggctttccttacagtgctcagctgggtttgcttagcctttggtgcctgtcaagactgcagcagatgaactggcaaaagtgagccccctaggtcaaacgtcttgaatttttctgattttgatgaaacgctattgcctgtataattacacaagaaatgtttctgtcacttgtttgtgtgaagactgataataataccttcctttttgagtccccctgtgccagggatgatgcagagtacttttacaagcactcttgcctttatcaacccaaggagaaaggccgagttagcccatttatgaagtgaaaaaatgggggctctgtgaggttgggtagcttgtgtatgtgcctgtggttcatgaggccaagacagctgaggcgtgcctggccgtgtggctgtttctcatgatgccgcagccgttcttcagcagataccttatgctcagtaaccacacagaatttgaggtggccataatttttattcttccttatagtttgatgtaactttttttttttttttttttgagatggagtcttgctctgtcagccaggctgtagtccaatggcgtgatcttggctcactgcaacccctgcctcccgcattcaagctgttcttatgtctcagcctccagagtagctgggattacaggtgcccaccactgtgcccggctaatttttgtatttttaatagagatggggtttcaccatgttggtcaggttggtctctaacataatccacctgccttgacctcccaaagtgctgggattacaggcgtgagccactgcgtccggcaacataacatatttttatgttttttgaaatgtttcaaatgaaagcaacttatttgagatggccatttcatgggttgattctcatttgggtttctttctcacattttgaatgcagcacatttgggaggcttttttttttttttttttttcagatggagtctcactctgtcgcccaggctgatgtgcagtggtgtaatctcagctcactgcaacctctgctgcctgagttcaagtgattctcctgcctcagcctcctgagtagctgggattacaggcgcctgccactgtgcccagctaattttttttttttttttgagacgatgtctcgctctgtcgcccaggctggagtgcagtggcgcaatctgggctcactgcaagctctgcctcctgggttcacgccgttctcctgcctcagcctgccgagtagctgggactacaggcacccactaccacgcccagctaattttttgtatttttagtagagatggggtttcaccatgttagccaggatggtcttgatctcctgacgttgtgatctgcccgcctcggcctcccaaagtgctgagattacaggtgtgagccaccacacccggctgcgcccagctaatttttgtatttttagtagagacagggttcatcatcttggccaggctggccttgaactcctgaccttgtgatccacctgcctcagcctcccaaagtgttgggattacaggcgtgagccaccgcgccccgccgggagttttataaactgatgtttgctgtgcagtagattctttcctggaggcagggatagtgattagccatagattaggttaactcattgaattcagccaagtattttcagggtttgacctgtgagccactggtattgcatgaggtccctctctgtggtatgtgcttttattagaagttaggtttccagccaagcgtggtggctcacacctgtaatcccagcacttcgggaggattgcttgggcccaagagttcaagactagcctgggcaacatagtgacttgtctctacacaaaataaaaaaaattagccaggtgtgatgaagcacacttgtggtcccggttgcttgggaggctgaggcaggaggagctcttaagcccaggagttcggtgctgcactgagctaggatcgctccactgcacaccagcctgggcaacagagtaaaatccaaagaaaaacacaaaaaaacaacaaagttaggtttcctagtgagtattaggaaaaaatgtataaccttcacgtcaaacccatgacttcacagcttattaacattgcaacttcagtactttagagtagcagccagtgtgtagttgatgtgcccgcatctgttgaatgtgtgtgtgagttagcgaatgagcttcctagcttcttcagcatattgctgtctctctctttttttttttttttttgagacggagtctcgctctgtcacccagggtggagtgcagtggcgcagtcttggctcactgcaagctccgcctggcgggttcatgccattctcctgcctcagcctcgcgagtagctgggactacaggcgcctgacaccatgcccggctaattttttgtatttttagtagagacagggtttcaccgtgttagccaggatggtctcaatctcgcctcccaaagtgctgggattataggcgtgagccactgcaccctgccccgctgccttctttttatataacttaaaaaaaaatctgtttgcaaaagtatcacatggttatttccttaaatttataaaatacagaaatagacaaaaaaaaaaaagagatctaagtccgacatgctaagagaacagtgacgtgggtgtccagtctgcttctaagtttggttgtctctgtcaaaatttgaccttctgtggctttattttaatagatgaaatgcattctgtttcagaggacagttttttatactagtagttgaaatgacagttgtcatgctcaaaaaattaatgtctgtctgaaatatactaaccataataggaatcccatccatctacactatttttttaatccacattttccataaggcttcacatgttccattgcaagattttacttggcacttgtcttttatagcctaggtaatatggcaatttaaaaatagaacaggtgacaactttcttttcttttgacataatatggtatgtaggtgaaaggatttactatgtaaaatccaggagctgtagtttaatacattttacaactcatttctgttagagtgatgaactcaaactggtttctcctggtgatgggttatggacgaatttttattattacatcagtggttttaggtttccatctagaggctcctggattaaaatacaattaaatttaaccatagcaatgccagtactgtagaatacgttttaaaatgtgcattatcggccgggtgcggtggctcacgcctgtaagtcccagtactttgagaggccaaggcgggcggatcacaaggtcaggagatcgggaccatcctggctaacatggtgaaaccccgtctctactaaaaatacaaaaaattagccgggcgtggtggcgggcacctgtagtcccagctattcgggaggctgaggcaggagaactgtgtgaacccaggaggtggagcttgcagtgagccgagatcacaccattgcactccagcctgggcgacagagtgagactccatctcaaaaaaaaaaaaaaaatgtggattatcatacacatttgtgtcaaaaataatggattatcccaaagtttggcctgaaattcatgaaaatgctcattgcatttgtggcttagtcatgttgcatgtattttttttttcctactcttcagcctacaaattttattttacacacctttattgcttttttggtgggataattgttaaaaaaaaaagataaactgtgtctaaagtttcctcttttgataagcctaatacaaacccatttggattgtacactgaacttctagaaagaaggaaagagcaggctgccgcagatctgcagccaggtggcacctctcctgggatcagtgctttttacttgttaacatataagcctttaaaagagttgtccccagcctcgtgtctgagcatgttgtctggggccagctgctgagaagtggtagcgtgctcttccagctgtgtgagtttacgcaagtcacccaacctgtgtgggccaaaatgtcccctctgtaaagcaggcactgaacccacacacagcgaactgaattagtgcacgtgcacggacagtgctgtacagagaaagctcaataaatgtcacttgctgttccctagtgacactctgtgccccggattccccatccattaggtggggtgattgtgcttctcacaggtggttatgaggaaggtgactgtgtggtcatctagaggtggccacctgtggaagggcttcagaaaagatgctcactgacatcagagcacccatgggccctggtgggcaggccctggtgaccctcttctctgtgcaggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggtaagagagaaaacgtgtttttctttctgtttggatgagctgaagagaagcatgtggcaagaggaagcttctcacgcatgtgtgccgacctcgctgtcacacccccacacactgtgataggcccctcttctctacgggagaggacctgtttcctctcctctttgtctttcctctggactttgccactggataaaagcattgggtggattgataagcaggtgacacctcatggtagtactgtttggaggaccttgaggcccagggaacgaggcatgggggcagtgtgaggggagcactgatgtgtgcctttataaggagacagagaaatctccggtgtcttacttaggttgttcattctttcgttgctgtagacagagctggtattaggtgaaatgcccatgaagagcatgaaggctgtagagaacagcttgtttaccgcccagtggcgttcattcattcatgcaggcatgcatgcactcagcaagccagcactgagttaaggatctgcttgcagtctcaagacaggccctatcaccatccttgccaatggggatctgacagtcctaacaaaagagacacacagatgggtccggttgcctcaaaagaggaatcactacattgggtggaaggagcatggtatagaaatatggttacaagtaggctgcggtcaatcctcaacagcctcagtgcccccacgctttggaaggagaccagagacaagccctcaaagcttccttgactgttactaatagtctatggagtttttcatcacttaaactttattattaaataatacttaactgtatttgggtgctagttttgggtgctttctttcttttaataaagaaaaggaatttatttctcatggttaggaaggctgagaagtctaagtttgaggggccacatctggtgagagctttcttgcaggtggggacttggactctgaacagagtccaaaggtggtacagggcatcacatggcgagagggctgagcatcagttttgggtgctttcttagtggtaaacctacattttgaaacaaatacagtaagcattggccttggtctttatctgattctcaagttgatggaccctcttagaaaaatttacatacagcccgggtgtggtggctcatacctgtaatcctcgcactttgggaagccaaagtgggaggatcacttgagcccaggagcttgagactagcctaggcaacatggggagaccccacctataccaaaaaaatttaaaattaaattaaccaggcgtgatgacgcatgctactcaagaggctgtgaggcaagaggatcatttgagctcagggttgaggctgtggtgagccagtgtactccagcttgggaatagagtgagatcctatctcaaaaagaaaagaaaaaattacatacatgtaattgtaagtcatttcagggggttcacagacttcctcaagcttcactgcgccaagccatggggaggtatctattctgagaagaggtagcgaggtgaatgggtagggtgaggggtgggggtggggcaggggggcagttatcctgtttcaaggtctgagtccactgggtagtgccaccaggcttccttctggtacctcgtccttcctctggcatctctcgcagcacagcctccccgtctctacctgagagtctgcctgcccttcagaggttcaaatccagagcccctcctctgtcttctacaagaacactggctcaggttaagaaggatgctctccagcccacctaaacctggtgcccagagagactctggtagtgaagacagcagctgttgctgctctccagaaaatgctggcgaggtctgcacctcctcagatagttactgtaggatactgttttatgaagctgacaaaaattaatttgaaccatatttattagagcaaattcctagcagttgacatagaaataatttcttgtggcttgaggccgggtgcggtggctcacgcctgtaattccagcactttgggaggccgaggcaggcagatcacctgaggtcaggagttcaagaccagcctggccaatatgatgaaaccccgtctctactaaaaataacaaaaattagccgggcatggtggcgggcgcctgtagtcccagctactcgggaggctgaggcaggagaatcacttgaacccgggaggcagaggttgcattgagccaagattgtgccagtgcactccagtctgggcaacagagcgagactctgtctcacacacaaaacaaaacaaaataaaaaagaaataatttcttgtggcttgaaaaaaatgcatacacccagaagctgtttgattagtgtcttttttcacttcctttacacatagaaatacccacattgatttctaggggtccagcagactagatacccttaactattccttcctccaagggaaacaactgaatttactagataataaaaaaataagccaggcgtggtggcttacggctataatcccagcactttgggaggccgaggtggttggatcacctgaggtcaggagttagagaccagcctggccaacgtgatgaaaccccgtctctactaaaaatgcaaaaaattagcctggcgtggtggcacgcgcctataatcccagctacttgggaggctgaggcaggagaattgcttgaacctgggaggtggaggttgcagtgagccgagatggggccgctgcactccagcctgggcaacaagagcaaaactccgtctcaaaaaaaagatgaaatcttttaaagtgtatggctgagatggcatgaaagggagtaagtcgtagtggtgaaaaaccaattgaaagctggaatcctgagaaatacatgggcttgaaagtcagcatttgctgtgggtatttcttctgatcctgggagacaagagacaacctagcccaggatggggtctgcacataatgctgggactgtaagtgacgacactagtaaggttgaagtggaaactccgagcaccgaaagggacagcagggatctgcagctctcgtggccttggggtggagatgcagggagtacagcttcccagagacttggtagctgtcagccagctgccacatgagctggagtgtgaataaatgttggtgtggtatgaacagcccaagcctggaagttactttacagtggtccaggattgctggtaaagtcaggcagcatgcagatcacctctggaaaccttcaatctgacctcagagaattcgaatagataaaatccccccaaatgagcagctcacagtaaaaaaagtcataaaacacaaggttcatgacagcacagttaaaagccagcagaagcagtagacagaatcacataacaaagatatttaaattttcaaaaaagaatatagagtaactttgttaactgtgcttaaagaagctttgtaaaagtttgaaattgggagttaaggattaatactctaaagaatgataattcagatttgaaaaaatatcaaaactagaaacaaaaactttttttagagatgatagctgagaaattctcagaattactgaaaaatactagtgttcagcaaggaaacgtatcagatttcccaagtaagatgttgaaaaatccttctctggttatagtataatgacagctacagaacatcaaagaaaaagtgatctcaaacacaaaacacaggactttgttgaaaatggtctgtgagatgttataatgtgtaattctggattctgggtagagactacaatgaatctatgtactccttacccagatgcgcagttaatcagcattttgccactctgacttcattatgccttctttttcttccactttctcttccctctttttgatgcagtattttagtatgggtcccagacaatgtgctttttgtcttagaatattccaataagtgtctctaaaaatagtcatccattatcttctgtagccacagttccattgtcacatccatgaagactgacggtaatagtaatttcttaccgactaatgccagccaatctctttttatggttgggttattccaatcaggacccaaaaatcttcacaaattcatagccacattattacactgccatccagtgatctatgcagcaccagcttaagataaactcggtgtctcagggcagtaattctcaacagttttggacttaggcccctttatacttaaaaatttaggaccccgaagtgtgcttttttatgcagacttacatcagtacttgctgtattgaaattcaaactgagaaaattttttaaatgcttattgtcattttaaaaatgtaaactctcattagattacataaattgcatattttaacatatattagagaatgtaacaaataatacacttttacattagataatgtaacataaattacatatgtaaaaataactattttccaaaataaaacattgttgcccaggctggagtgcagtggtgagatcttggctcactgaaacctctgcctccccagttcaagcgattctcctgccccagcctcccaaataactgggattacaggtgcctgccaccacatctggctaatttttttgtatttcttttagtagagatggggtttcaccatgttggccaggctggtctcgaactcctgacctcaggtgatctgcccgcctcggcctcccaaagttttgggattatgggcgtgagccagcgcacccggccaacatatttcttaagaagagtgggtcactcacacctctccagatctctctgtaaaagcagtgggagtctcatctgcattcagtctgttgtcataggttgtctggttgaagttattgaagaaaattcaactttttacagataatgtagttggaaaaaggacgaatttttttttttttgagacggagtcttagttggaaaaaggaataatttgtctttttgtgttttttttgagacagagtctcactctgtctcaaaaaaaaatctcgctctgtctcgctgtgtccctcatgatctcggctcactgcaacctctgcttcctgggttcaagtgattctcctgcctcagcctcccgagtagctggaactacaggtgggtgccaccacgccaggctaattttttgtatttttagtagagtcggggtttcactgtgttagccaggatggtctcgatctcctgacctcgtgattcgcctgccttagcctcccaaagtgctggaattacagccgtgagccaccgtgccctgccaggaagaatattttaatagcctcttcaaatcctgatagatcttctctgagagtacaccaacgcgggagagtttcttaatggttagttgcgatgtagagtctgaaactgtatcactgaacttaccctactctgttccgttaaaatccacaggctccagctcaccccatgaatggattctctacttatacatggtttgctagtgtcattcataggtcattttgcaaatattgattcactgagtatcttctggatgttgacagttttattaatataaaaaatgatatttgtttatatcagcactgatctcatcagaaagctctttaaatgtgtaggatctttcaagccaacagcagcaaatgcaaattttctaaagttttcttttttgcttgaaagcttagattttatgattagccacagattgtgtcacttgttttctttgaagcaacatgttaatttgctgtgcaaactctgccagctagttagctcttctgaacagcacccccattctacttgtttttgctgaactcactggatactcttggacatagaaaggtattctcagaaatgcaactttactggagaatgccctcacgtgaggtttattccacactgcctgggggatcaaacaggataatgagtcatattttttgtatttactttaaatattaaagtaaaattgggggagtgggcatggtggcccacacctgtaatcccagcactttgggaggccaaggtgggtggattacttgagcccaggagttcaagaccagcctgggcaacatggtgagatcccgtctctacagaagatacaaaaattagctgagcgtgatagtgtacacctgtagtcccagccactccggaggctgaggcaagaggattgcttgagcctgggaggcggaggttgcagtgagccaagattacaccactgcactccagcctgggcgacagagtgagaccctgtctcagtcaattgaccaatcactcaatatttttttaaaagaaatctaaaaaataaaataaaattgtcactaggcttaagttatgcttctagtcatctaggaaacacctcaccaggctataatagtgaagtctaaattttcatcgacaaagacagaaagatctcaaatgtcccgttatttcagtctattgtaggaactacattctaaacatcttctcttccttctttcaaacccccaaaccttttttgtagtgggaagtgagaacagtttgcagagcctgcccttaggtcactgacaagcctttctgcctctagctcagcagttcttccataggcctcacctctcgtaggagctgtgaggacacatcctgcagagcccacccctgcatgccccggtccagttatttgagcccctctatgctggttccacgcctgtcgatggggcatgggcagggcactaccaggttcacagggaacttactggaggcattgaattcagcgctaaggacagtgcctggccatgctaggcactcaggtgttaacatgtgttccttaagtaaactccaagttgatttccggttgtgaagtgagtctgatatctgtttgtcttgcatgcctcacctagaggtgtaattttaggttttattaaaaatgccaaatatcttcataaattagccttcacccagtgaccattagcaactggcccagaaagccagacttgtgattccactcatagacaggcaggtggaaatggctatcccagaggtttccaagggaggccaggcaaagcctcagctcttccaggaggcccctccctcagctagttgccaacctggtctgatccaggtgctgcattcactctcatgtactctttgtcttgtagctgaatcgtaagtcaggtcactgcctactcttctgttccccgggaactcctggagagcagcggactattgtagcaggaggtagtcttcgtgtcctcgtacctggcacagggcctgggcagcatgggcttggcatttcacctgcttattattacaagcacatttgtgggttccagcctggggctgggtatcagttacctggccctggtctcctgccacgtgcatttttcctgtaccgagtgtgcttgctctgagataatgcttggtgtgaaacaggagtgatgatgtttcaatctgggaggcactggtgaaaacacgatgaggaaaagtactggaaatgttaacaaaacggaaggttttagattttctgcagatggcatagattcattgctgaatctctcaattcttgtgtttccaggtatgaaaacagagctgtatccagcaaggctggcacacagtggtctagcagtatcactggtgtgctctctccaaatgtgtttataggtgtttactttcaatcattataatcattataatttgttctctcagcccccataccaactagggttattaggtgacataacagtgaaatctttgtgtcgttcatttgctaaggtctccatcaactcagcttggctatattgtaaacaggagcagacctctaaacccagtccctgtgagtgacccgactcaggagacgtggagtagccaagcatgatgaagtgcagcttccagagctggcggttgttgaagtcaggaacattcacccaaagatgtaacgtgatctgaacacaagtagtgtccgtgtagttgacagagggaagcatggattcacacacgcatggttgtagcaagacttattaaatgtgaacattacatttaggaaaggtaataatggcatcaacctcagtgatcttgtgttgggggcttgctgtacatctctgctgacatcactctctatgatgactgggacacttctaggttttcgtggtattatctaaagtaattgacaagtttgcctacatttattaggaagacaaaaaaccttaactctgatagggtcttgcaagtggagaaattgtgtgtattaattagaatggaaggtttctccaaataggtaagaaaattgttatcctttagcatcgagggacttgatgtatctaaactgtttgaactgtaagggctttcattacattttaaaagtataattgtgagaaatgactctcaaacgtgcagttactgctttgtctctgtgcacacctgtcaccctgtctttgcagcccttctaaacttgccattttagaggggagatgtgctgaaatccatgtccgtgtagtcagagttctgatgcactgtgtgccttgagacatacagggagcagcacttctcataagctgaacactctgggcctgtgaagagggatgtgtgcgtggtggggggaaatggggaggggggagggaatccctctgggaattttctagtctttagcaattcactacatcttctgtttatcttttactttttcttaaccaggaaaatgaacacttgaaaaagttccaagtgacgtgggaactgcataataaacacctgtttgaaaatctggtcttttcggagccacttcttcagagcaacttgcccgcactggtgtcacagatcaggtattttgccttaacccgtatgtgtctttgtggtgtgacagcacagtcttttctcctgactggtgtgcgtgtacccgagtaccactgagtatgaaagttcttgcaggaaaaataacagggcttaaagaaaaagatagtttgggccaaaagctcaaaacctgagaagcaatacaattaaacttttaaatgataagtcaatataaatgctactaagatttaacaccacaaattcctcatacagaaaagctacagtaaatatagcacttttccttgacaagacctatccttggccgggcagctgtggtgtggttcatgctatggctcttggacatgtaggggaaatggaggagggaagaggcccaggtctgagggtgcccaaggccctccggatacagcttggtgtttcccacacattccgttgctacccgaggctctgttgctctgtctcctggtgtagcgcatccatgtggcttcttcacgcttgggaagctggctgggttctatgctttcactgagaaaaaggggtgcagagtgcagcagtcactcactgagtatttgctcggggtcagagtgagaagatttaggctgggcatgtgtttgccctgtggtaccatgttcagttagaaggcatgttcctcctgatgtgacgttactcagcagaacgctgttccctgcactgagtcatgcatgagctaccacaggtctgcagtttggtgattttgttctttggtgttttattctatttaccacatgtgagcacattcccataatacagacccatcgtgacagcagccatctacatttgaccacgttaacctatacttaggggtgtggtggctcacgcctgtaattccaacactttgggaggccttaagcaggcggatcacctgaggtcaggagtttgagaccagccttgccaacatggtaaaaccccgtctctactaaaaatataaaaattagccgggcttggtggcacatacctgtgatcctggctacttgggagtctgaggcaagagaattgcttgaaccccagaggcagaggttgcagtgagccaagagtgcaccactgcactctagcctgggtgatagagcgagatgctgtctcgggggaaaaaaagtcgttagcttcacaaagcaagggaataaattgttgttctgttgactacaccagttattgctattttatttattttatttttgagacagtgtcttgctctgtcacccaggctggagtgcagtggcacaatctcagctcactgcaacctccacctcccaggttcaagcgattctcctgcctcagccttctgagtagctgggattgggattacaggcttgcaccaccacgcctggctaatttttgtatttttagtagagacggggtttcaccatgttggccagggtggtcttgaactcctgacgtcaagtgatccacctgcctcagcctcccaaagtgctaggattacaggcatgacccaccatgcccaatctgctttttttctcttaaaatccgtatattaggactggtacggtggctcacacctgtaatcccagcactttgggaggccgaggcgggcagatcacgaggtcagatcaagaccatcctggctaacacggtgaaacctcgtctctactaaaaatacaaaaaattagccgggcgtagtggcgcatgcctgtagtcccagctacttgggaggctgaggcagaagaatggcgtgaacccaggaggcggagtttgcagtgagctgaaatcgtgccactgcactccatcctggaccacagagcgagactccatctgaaaacaaaatacaaaaacaaacaaacaaaaagaatacgtgtattgacccagtctttgtttcctgtattcccaaattttatttgaggggtcctgaccatctccacttcataaccttacctctagagaaagcaattaggtaaaagagaattgaggacaaaaagatcagaagctacacgtgctggctcatgcctctagccccggctacttgggaggctgaggcaggaggattgcttaagcctaggagctggagaccagactgggtaacagcgagaccccatctcttaaaaaagaaaaaaaaagggccaggtgcggtggctcatgcctgtaatgccagcactttgggaggtcgaggcgggccaggtgcagtggctcatgcctgtaatgccagcactttgggaggtcgaggcgggcagatcatgaggtcaggagatcgaaaccatcctggctaacatggtgaaaccccgtctctactaaaaatacaaaaaaaaaaaaaaaaaaaattagctgggcatggtggcgggcacctgaagtcccagctacccgggaggctgaggcaggagaatggcgtgaacctgggagcggaggttgcagtgagccgagatcacgccactacactccagcctgggggacagagcgagactccatctcaaaaaaacacacaaaaaaatcagaacaaggtgttacggggcgtgtggccagctggcaggtgggctgcagacccttccagtgttccctgtgccctggcctgctccttagccattccttcccttctgtggccactgtgtatcaagattggaaagtccttactctgacccttgcagaagaaaaggcatcggaagagaattcacagtggtgaatctggaatgtggagtaggctttgtccctggttatgacgttcagattcatcaaaagcacttttcatgagaagatatgcatcttgggagaggggctctgaaaacaagattccagggaatctaccttaaaaaaaaatattttactggtaagccagtgagttccgtcagcctgtcagactgtgggtgggtgactgaaaccggaagtgcatcataaaactcccatctttttttttttttttttggagacagagtcttgttctgtcgcccaggctggagtgcagtggtgagatcttggctcactgcaagctctgcctctcaggttcatgccattctcctgcctcagcctcccgagtagctgggactacaggcgcccgccaccacacccggctaatttttttttgtatttttagtagagacggggtttcaccgtgaaaactcccatctttttctgtgccctagttctggattttccgtttgctcattgggtatgatggtcagactccaaccatgagccacgtctctagtgtggatgctggatctcaagctgcagtctcacttctcacttttgggacccacaggcagttgagggagaaggataaacacagacagggacagaatgaggccaaccagcacgttccctgagcagcactgacgacgccaggacacgccatgcctttgtgctctgcagctgactcccttgtcagcctgagactaattcaagataattcagatttgcattgctaatgtacagatacgcatttaacaattcataaaaattttgctactgattacatacaaacaccccttaaagcttctgcatcctatgaaatacatatggtacaattcacccacttaaaatgtacaattcaatgacttttgatatatttcattttttaaaaattatggtaaagtatatataacataaagcttaccattttaactagtgtatatttcaataacattaattatattcatagtgtttataaccattaccaccatgtactttaaaattttttcctcacccgaaacagtaactctaccattaaacagtaactctccattgtccccttcttttttccccatagcctttgaaagtctgtaatgggcagtttccttcccttgactccccaccattttttgtcttaaaatgtatctatgaaagaactaggccatctgtcctgggggtgctttggtctggatcctgcgtgggcgtgttcacagagcagtttggccacctccatcctctgtcctgcctgagaattggtggtaggatctgaaggttctggacggctctgctcagatcccctggcaggccaaggcgtaggcggggggtgtttctatcagggggtgcatccctcaggcctgcttctctttgttgtgggtatcagtagcccaatgtgggcttcactttaaatatgtattaattaggctaataaaacttacccaaaccaatgttatttcattctctttatcaataataatgtttcacatacacattggtaacattacagtaagcatattttcatgctgctgtcttgtatttgcaagctcaatatttagatggaaacctgtttgctgagccattgatttaattcaaccctgtggatagtccctgtgactcttttgatcctagcacagctttgcttgcagggaagccctgtgcctgcagattgcttttcaattataccaacaaagatatccacaaaccccctcccccacccactttgctctcccttggctcaaaataatctgaattctataacttggaagagataaattcttacttccaggaggagcgggacaaggaacacatgacagggtataatgccgcatcccaacgttccaggtggagcaagtaggggcaggatggaattgggtagaagctggattctgtgtgaagaatggaaaccagtcacggaagagcaaggctggcagagaagaagtgggagaaaaactacttcacgggctgcagtgtggcagatccctggcgccactggagtccatgtcttaaggagttttgtctcctgaggggcagaaacagccttaggagaacagctttgatgttttgaagtagcctcaatccatgtgcgtcagtattgtttctttcctttgggcttccctaaatgactgcccagttacacctaacctctgctgccttccctggagagactgcaataggtgagtgcacagatggcttcagtagctgcaaggttcccaggtgcgatttacctgagggtggagataggtcagaggagaagagggagtcattcctgcccatttcacccatgaaaagatcctaatttccacatagcttgtttattataaaatcattagattgtcattacaaataaaattatgaaaatatagaaaatcgtaaacaaagttaggttttataaataatttagtatttcttatacattttttccctatgtccactatacgtatttttaaacatgctgtagtcatatctttagttaccatgagcatatttccatttcaaaatatatatgtgtatatatacatgaatgtgtgtgtgtgtgtgtgtgtgtgtgtgaatgggtagacataattataaaattggtaacaagtatctggttaccaagtactgattctcctagatgtgccatgatgcatttggtagcttctagtgtttttatgtaaatagtgctgatccttaaccttgcgcagaatctttgtgctcttgatatattataaacatggtatttgattctaagccatccttgtcaagatgtctttattccacttattttggctcacactgatagacttaggtattaggaacatgaattttttctggtaataatctacatgtgtctccacaccactccccgtcctcctcctgaccccagcccccagccttctgtctcccaatcgccatcttgctcagtcttttcagaaatcgaggtgttttttctcactgtccacctgcatgtgtgtcttttgtttcccatttattttctcattttccatcttgccatctttctttttttttctttctttttttctttttttattgaggcatagtttcaccctgtctcccaggctggagtgcagtggcgcgatctcggctcaccccaacctctgcctcccaggttcaagcgattcttctgtctcagcctcctgagtagctgggattacaggcatgtgccaccacacccagctaatttttgtattttttgtagagacagggtttctccatgttggccaggctggtcttgaactcccgacctcaggtgatcccctcgcctaggcctcccaaagtgctgggattacaggcgtgagccactgcacctgaccgccgtctttcttaatacaatataatatagtagacagaaaactgtaactatatttcttcaagtaaatcagattttgttttgctttatttgaaaaccagatctaaattttatgtctcattaagtgttttgttttctctgagccagttgtattttcaagagtaaaataactttgtattcccatatttatttttttatcatttttatttttatctattttaattttttctttgcaattccatatttggtaaactgaattgttaagtcatagtctttagagacatgttgttcagtgctcatttttttcttagaagctgttgtttctttgagcatctccttttttttttttttttttttttttttttgagacagattctcgctctgttgcccaggctggagtgcaatggtgtgatttcggctcactgcaacctccgcctcccgggttcaagcgattctcctgtctcagcctcctgagtagctggggctatgagtgcctgccaccacacccggctaatttttttgtatttttagtagagatggggtttcaccatattggtcatgctggtctcgatctcccgacctcaggtgatccacccacctcagtctcccaaagtgctaggattacaggtgtgagccactgtgcccagctgagcatctcctttttacaagtctgtcctgggtgccttgcatggggatctgttgatccctcacagctccctgctgtggtgcagagtggcaccctgttttccacgttgggaggcgagatgacaaagcaggatagtatcagcaggaagcacatttctgatctctgcttcagagcctttgggttctttcctttgttacaaggccttctctctcctaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcaggtgagtgccacccgggaccaccgcaccccgcgcacatcctcagacggccctgttgaaggcagcaccaagtcactagctttgtcctgagctgcaagccaggaattcccgactgaggcccagaggcgcatgtgggtagcccctgtgtgttagctgctggttttccggaagggatgggaaacctgttggcatcacagatggcttgggcctcctgggcctgaggtgtggtggcagcagttggtcaagttttccttggcctgggcacacctgctgtcactcacacgggctgtcaccaggctctgcaccccaggtaggaggtttttctttttttttgagatggagttttgctcttgttgcccaggctggagtgcaatggtgagatctgggctcaccccaacctccgcctcccgggttcaagtgattctcctgcctcagcctcccgagtagctgggattacaggcatgcaccaaccatgcctggctagttttgtatttttagtagagacagggtttctccatgttggtcaggctggtctcgaactcccgacctcaggtggtttccctgcctcagcctcccaaagtgttgggattacaggagtgagccaccacgcctggtccaggtaggaggttttttaagtccaggagctgtttactgagcactctgctgttgagagctcattgtccatctgtcctagtctagaagggagtgcagacacatgcacaggtggcaggtggctcaccaggtggaagacagaagagggagggcacctgctggaggtggatctgaagggagggcactcaggcagcccaagcctgtcagacagagcagggctttgagacggcgccccctccccccgcttcccacccctggcctgcctgctctcctaaagcagggttgggccaggaaggaattgagagcggccctggtttaaagatgacactagtgtgagcaagggtaaagaaggaatgactgagtttctcttttgcacttcggagactctctgtaggaaaatggaacctgggctctagcctaagacatgtgctggttccatgtctgccctggcatggtgagtgccatgtggatgccacctgtggctccttgtcagtgttccttgtcagtgctgtgagggactgggaagaaggaagggactagcatgtgcttgctccctccgagaattgtgtcattgatttcacagctacaggccgtgttttctgttgctgttctctactgcagccacagggactagagctacaaatggtctgttgtttggattttcgcgggttttctcttactccattcttctgcattctcagcctcccaaagtactgggattacatttgtgagccactgcgcctggcctgctggctttttttgaacctgcatcagcttcagtggagtaagttccaacttcgtcacatgcggaattctgtgctgttgagcttgtcttagggcaggtggccctgagactctcccatgactctgcgcctcttccttggctgctgtacgcacagcacgtcagggtgaggaggggcctcagagatcactttggtcctgggagactccctctgtgtcctgtgcctcatggtggggcctgagagagcagttgctgttttgtgttttcttcaaagtgggtgtattcctaattcatgtttttgtctgtttttgcaaccagagactttcctgctgtggcttgtcactgaccagcgacttcttagcctggactactgtgagagcagggtctggatgccaggtggggagggcagagtctcctgctgcagcagcacctcagcagccttcatctcgtgaggcctggagcatcccaggggctgcagctgtgccatgtgggggcagcacagcagagagggcgctgaaagctgcattcccctctgccatctgtgggtgcaccagcccattttcacaagtttgctgttctggtagagggagcaggagttgggggaagctaggacagtgggcattaaccttctccaggaagtgggcatcttcggcagaggctcttcagggctgtggccgtgcaggagggccagtagtgtgtccaggtcaccactccctgggatgttcttgacttgggtcccagggagaaccctgcacggcagtcaacaccagaatgtcccggatctgccccatgagtcttttccctccctacctgcaaaatgagataattatgttaggtgatgttttagtgttgtgtgagcttttaattccaaataagttttttctgtgttatttttaaaaagtaaaactggccaggtgcagtggctcacacctataatttcagcactttgggaggctaaggtgggaggatcacttgagcccaggagtttgagaccagcctgggcaacatagtgagaccttgtctctacaaaaaattaaaaaattagccaggctgggtgccgtgtgtttgtggttccggccactccagagagtgagtgggggaggatcacttaagaccaagagttagaggctgcagtgatctatgatggtgccactgcactgcagcctgggtgacagagtgagaccctgtctgaaaaaaaaaaaaaaaaagccaggcttagtggctcacacctgtattcctagcactttgggaggctgaggcaggtggattacttgagcccagaagtttgagatcagcctgggtgacatagatagaccttgtctctacaaaaatacaaaaattagcctgccatggtagtgtgcacttgtggtttcagctactcgggaggctgagatgggaggatcacttgagcctaggaggttgaggctgtggtgagctatgatcatgccaccacactccatcctgggcaacagtgagaccctatctcaaaaaatgaaaaaaatatataggcatagggacagtaaatagtccctgtgttggtattgcactgtgggctgctggttactgggtgccccacagagcaggggtccctaacccttgggtcacagaccagtactagtccatggcctgttaggaaccaggctgcacagcaggaggtgagtggccggtgagccagtgaagcctgtcagtgtttatagccactccctattgcttgcattaccgcctgaacttctcatgtccgatcagcagagacattagatcctcacagaagcatgaaccctattgtgaactgcgtgtgcaagggatctagattgtacgctcctcatgagaatctaatgcctgatgatctgtcactgtctcccatcacccctagatgggaccatctagttgaaggaaaacaagctcagggctcccactaattgtgcattgtggtgagttgtataattatttcattctatatgacagtgtaataataatagaaacaaagtgcacaataaatgtgatgagcttgaatcatcccagaaccatccccttgcctcacctggtctgtggaaaagttgtcttccatgaaatcggtccctggtcctaaaaaggttggggaccactgctctagagcacatcccatggcacccacgcagggtggtttattgagagcacagaaggagggaggagcatgagatctcaggccatcagtagacactgtgaaggaaagaccttgagaaggaaaacagaaggcgaggggccggctttcctgcccggctcactctcgtcaccggggctcaagggaacgaagcgcacctgctctggcctcacgggtgcggtaggggaagccaagaccaccctggctgggggcagagatgggagctcagggctctgaagcccagggagaggctgctgtgcagggcggggtttcaagactcccagagaggctgcttgtgggaagcacgtgaaaggctccttaatccaagagtgtctctgttgacgacatagtgccacctgctaagtctctgtcttgccaacatgagctgcagtcaagttgtattgcattaggtcattgaaacctcccaagtgcataggaccctgcctacctttaccaaggaccgcataaaaaaagaggagccccaagcaccttctgggtaggcatggatagccgcccacggtacactctaatggcagcaacggtatttgcctttggcccagagaacgctgtctcagggccctcctccacagtcttgttagtgtttgtagcagtaacagacgtgcagatggagaagctgagtgttggtgaatccactggagggtggcatcagacctggaggggtgtgtgtatcagtccattttcacactgctataaagaactacctgagaccgggcttgatactcacccctgtaatcccagcacttagggaggccaaggtgggcggatcacctgaggtcgggagttcaagaccagcctggccagcatggagaaaccccgtctctactaaaaatacaaaattagccgagcgtggtggcacatgcctgtaatctcacctactcaggaggctgaggcaggagagtcacttgaacctgggaggcagaggttggggtgagctgagatcatgccattgcactccagcctaggcaacaagagtgaaactctgtctcaaaaaaaaaccaataaaacaaaaaacctacctgattctgggtaatttataaagaacagagatttcattgattcacagttccgcatggctggggaggccttaggaaacttataatcatggcggaaggagaagaagaggcaaggcacgtcttacacagtggcaggagagagagagcaagaggggaaatgccacacttctgagccatcacatcttgtgagaactcgctatcatgagaacagcatgggggaaatccgcccccatgatcccatcacctcccaccaggttcctcccctgacatgtggggattacagtttgacatgagatttgggtggggacaaaggtgaaccatatcaatgtgacaggttgacatgacgtcacggcagacgtggaaggtcctgtaatcagggtgtggtagcagcctcgctgcctgtcctcaggacagctctgaccagactggatccccctggcagggaagcataagaggttgctggcctgagtcgtcaagaagtgaccattgtgaagcagacattcagctcgtcccagacagcccccaggaggagagtccagaccccgtgtagatgtgtgtgatcagaaagagtcccttgcaagggtcgttcgaaggcagagtgggctgtagtgtggagatgagttccccatgatagggaatgtggagaatagttggagaggtatttggactaggtgaccatgaggtctcatctcagatttcatttcagggacacatctgtccctgactggggctggtggcctctgtgcctggtattcattgtttaccagggatttgcagagtacccttcatgggaggcacttgtctgcaagtctaagtgcaaatcagccttgcctgtcaacaaagatgacttgggtgtgtcggtgcttcctgtcctggtgttgaacaggagacgctggcctattgcagagaagctttgagtctggaagcttttctgaatggaactcccacctccctttctcctgcatttggtgtttttcttctgtaggattgatgctgttcacttgatttatccctggtgtattagtccattcttgcattgctataaagaaatacctgagactggataatttataaagaaaagcagtttaattggctcacggttctgtggctgtgtaggaagcatggctgggaggcctcgggaaacttacaatcatggtggaaggtgaaggggaagccagcacatcttacgtggctggagtaggaggaaggggggtggggaggtgctacacacttttaaacaaccagatcttctgagcactcgctatcacgagaacagcaccttcggggaaatctgcccccatgatctgatcacctcccaccaggccccatctccaacaatggggattacagtttgacatgagatttgggcggggacacaaatctaagccatatcacctggctttcccttcatgtatcgatataagtttctgaggttgtgaataacttgtaaccttcaggtgacttcagaaaaatagtatagttagtgataacatagggaaaaagatgaaagagaaggaagatgaaccgttaccgagtgctgtgccaaaccccgtgtggctagagcctcactactgcttcctggtgttaccacatctgcagatgacaggaggctcccgagggtctcagccaggcaggcctgttggggtttaggtcagcggtgtcctacgtagcataacatcctgcccctaagagcctggggtgctgtccttagttccacatgtgatggaaatggcagataaagttctagtttcagagattcatttctccaattgaactgtaactaaacacaaaaatgcccttagggaaattcttttactaagactgaaaaatcctttgggaatagtaatttcttcaggtatctgtttcttgaaggtaaacatttattttgaaatattatatatggtattattgctgttgttctagggaaaatggtatatatgtaaaaataacacatacatgttctctctagggagaaaataacagtgtcacttaaaaagtaaagtgtatttctttaaaattgcatgttacattgcttttacaaagagaaaaccagtctcttcactaaagcaaccagaagatgctttttatttttatttatttttttttagacagagtctctctctgtcaccaggctggagtgcagtggtgtgatcttggctcactgcaacctctgcctcctgggttcaagcaattctcctgcctcagcctcccgagtagtagggactacaggcgcccgccaccacgcccggctaatttttgtatttgtagtagagacaaggtttcaccctgttggccaggatggtctagatctcttgacctcatcatccacccacctcagcctcccaaagtgctgggattacaggcgtgagccaccatgcccagccaggagatgcatttttattttcactgtcttgtgaagaaaccatgagaaacaatctgccactaatacaattgagggaaattgagccactttagtaacatccagagaataatagtcattctggaaccatgtatgcatgggtgggaggttgtggggagctgaaaacaacagaaatttatgctcacagttcttgaggccagaagttcagaatcagtatgtcagcagggctatgttcccctgaaggctttgggggcaactgcagtgacccctggagttcttggtttgtggccactccactctccactggagctgttttaatgcactatttaatttaaaacctttgaatgaacattggttgcttctaatcaataacattttagaaattttatactgattcaaaggctttaaaatgttgaatacgtgtaaaataattgagtctctgttcacaaataagtatgtatgtatgtggcaagagagttggtaggttttgtttgtttgtttgagatggagtcttactctctcaactaggcggtggtgtcatctcagctcactgcaacctctgcctgctgggctcaagcagccctcccacctcagcctccagagtagctgggatcacagcgcacaccaccatgcctggctaatttttttttttttttttttttttgtatttttggtagagacggggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctgtgagtgtttcaccatgaagtttgatgcttgccatacagacttttgatactttctagcaaattaaagaagtttacctttatttctagttgatttaggctatcatttaaaaaataaaacaggaagatgtcaaaattgatggtatgatttttcttatatcaatttctgtatgagttaagagtttaggttacctaattttgagacattcttgcgttcctgggatgaaaccctagtagatcatgatatgtcattctttattccattattaaatttattagctgatatttgatttaggacgtgtgtgtgtgtgcgtgtgcgcctgtgtgtgtgtgtgtgtgtattcggacagctatataaaattatttttagagacagggtttcacactgctggccaggctggagtgcaatgacaagatattagttctctgcagcctcgaactcctgggctcaagctctcctcccacttcagcctcctgagtagctaggaccataggcacatgccagtgtgccagctaagttttggcttggtgcagtggctcacagctgtaatcccagcactttgggaggccaaagcagaaggatcgcttgagcccaggagtttgaggccaacctgggcaacatagggagaaccccatctctacaaggaaaaaaaaattagccaggtgtggtggtgtgtgcctgtggtcctagctacttgggaggctgaggtgggaggatcataggcccaggaggttgaggctacagtaagttgtgatcataccactgtagtccagccttggtgacagagcaagagaccttgtctcaaagataattttatttacaaacaaatgaaattttttgtagcggtgggggtcttgccttgttacctagactgttctcaaattcctggcctcaagtgatcctcctgctttggcctaccaaagtgctgggattacaggtgtgagccactgcatccagccaggacttttatatctatattctgaggtataattgagttgtcttggtctttgaggtcttacttgttttgtataaaggttgtgctagcttcatagaatgaattgagaaactctgtgtttttgcaattttcaggaatagtttaaattttctgtcccatgaagggtttgatagaacctaccgtaaaactttggggcctaattcatttttacagggaagaagaacaagaactatagatcttgtctgcctttttcatttatatgacatttattagtgtatttcaggtttccttctccctcgagtcagttttacaaatagaatttggctcaagaagttatccatatcgtttagtaaagggttgtaaactcacacctgcagggctagggaaagtcacggaaatggatgatacagggtagagcggccccagcgttcctgtggtgctcatggccgtcaccaccctcaccttgaaagtgccctcagttgggataggccctagtggagcctggggcatgggtagcgaaggccacacctgtgtgtgcgtgcgtgtgtcctcctgttctctgttaggggcagtccccacttgggtccaacagtcttcacagggccaccagagctgccaggttgtcaagagaagccagaaatctggattattaggtgaaatctcgaacacttttaaaaagaggtgaagtgcaagtcggacaaaatagcccatgagccccttgtttgtaactcttctttagatgttacaaagtatcaacttataaagagactttgtctcacagtttaaaaacaatcttctggccaggcgggcacagtggctcacgcttataatcccagcactttgggaggccgaggcaggtggatcacttgaggccaggagttccagaccagcctggccaacatggtgaaacaccgtctctagtaaaaatagaaaaatgagctgggcgtggtggcgggcacctataatcccagctaactcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtacccatatcctttctcaatcctgatttttttttaatgttacctttttccccctttttcagccttgacagaagcttacagaaccgactttcggttttattaatcacatatgcttctctgtttcctcagtaatttctctttttgcctttaactcctaacttctttgttagttttgttttgctttgctttttaagtctcatatgcctgttaatagctcttcctttcctgtagtctgagctcttcgtgtggcaggaccgagttgccatcatcttgcttatttctaacacattcagggcacataatgggcattcagtaaatagtgaatgttcatccactgtattgacagatttagtcagaatatcttgatttctctttttactgtttattcatctctgtctttcatgtgagaaaagtacttgtgatgagtttgagtaaaataaagaaatacctgttaacatatttgtagtattgtatctttattctgtttgcagatgatgtttctctcatatatatcattttaagaaagtctcctcttgaaaatgtcttgtataattgtcgcaggtattaaagtttttcttttttttctgttttttacatccccttactagatgacaatgaaaaccaagcagcgcatgttaacagaagactgggagctttttaaacaaagaagattcattgaagaacaggtaagcttgtcaataagagaggcaattaaaggaagtagaaatctgtcctgacagcaaatgacttctctgcatgttgatgtgctttgttagaacagcattggaggaccacattggcatgttttgccagcgttaaaaactgttcaagatggtgtttttaatctcaagataaactaattttcacctatttccttatcttccatatacgcctcaagaaaaacccatgtgtattgagtggcctctctatcccacagcagctctgggtattttgcaaaggatattacctgagtccccacagtcccctatgaggcagatggtgccatctgcagtttacatatgaaggagggtgttagggtgaggttaaggatgttgcctgatgtcccagagctggaatgggggcccagcatccccagacagagcgctcagatctccagacattgccaggtgccatgccttcaacatggcagctggcagatctggactctcccttcctcatcttcctggcggtgcctcctccaggcaggcttgtgctccacctttgctggagctgttgggcagagcttgctagtgatgtcctgtatctggtctgggggcccttggcttcatctggaaacttggcttcccctgatctcccatccacgtgccacatcgactctcttcctgttctctgacacttctctccatctcctttacgaactccaacttcattggtctttctgcaaatattggtggttccctggccttgaccccatgcctgtctccacatttgcatgcccgtggtctcctctgggcaccacaggtatacagatggcaccagtgttgtggcatgcttacctcttccctttccccattctgcatgtgtccctgtgcttttgttgttgttgttgttttgagacaaagtctcactctgtcgtccaggctgaagtgcagtggcgtgaactcggctcactgcaacctctgcctcccgggttcaagcggtactcgtgtctcagcctcctgagtagctgggattacaggtgccagccaccacgcctggctaatttttgtatttttagtagagatggggtttcaccatgttggccaggctggtctcaaactcctgacctcaggtgatccgcctgcctctgcctcccaaggtgctgggattacaggcgtgagccacctttcccggccatcccgtccttttgagtggcccttccagctgccacctgtcccattgccagagtgggtccagagttccttctcctttgaaatgcagatgctcaccttgtctgttagaagttgaggtgccatttcctcaatagctccgaggccgaccccttgccctccacgtgccacttttcattcctacagctctgttctcagtaccttgcaagtaccaagcacatggcagacagggtaaaggccgggtttctgcatcaggtgtgtgctgtgagggcgcactgcagcatgtttgctgaagacaaaagcgattagggtctcctggtacccgagccctttgcagctcagcccccagcttgctgccgactccaggtctgctgcccctgtattcctggtcctgtcccgctgaggaagcagtgcccgtgaacatgatacatgtcagcagaattactgaaaaataatgagccatgtctcggggaagggtcttgcaagattaaagcattttaaaatttcctctagttaaccaataagaaagcagttactggcgagaacaacttcacagacaccatgaggcacatgttatcgtcccggctgagcatgcccgactgccccaactgcaactacaggagaaggtaaggctgggttgtggtgtcagcacgactggcccattggaccttcactgggctgagtggaggcctagaaccgacccttagagagcatggtctagtcttgtgcattggttggcttggtaactgtccttaattcctgatcagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttgtaagttgtgactttgtaataaagtttccgaaatttaagtcgccccagtaatgagaaatacatacagtaatgtccacagaagtatgaacatcattattgtgcttttcatgacaagggaccctgaggtttttaatgcagcttttaaaacatgaaatcagtaaacccaaacttttaacactgtttatctgggaaaaaaaaaacatggtaaattaataaaggccagtaaagaaaaaacatgttggtatgcagagaagaagtgtctctaattccggcctcacatctcctcattctcctaaagggtgaccagtccgccgtctgtcctgtctccctgtcagcccagcactcatgcttgtttcatgtcttgctaagaactcaggtgatcgctttagcaagcagttgaaggtttctgtttttcatgttcccgcatgattagaagtacattgttgtgcagctgtcaccaattcacattgtagttggctgttcccagatttcttcagagttgtgaccctgtcatttggggaggcttcacatgctaatttccaaaagggttgcacttgatcatatgtagttgccaaagtcagcttaggtttagtttacgtgtatcgtagagcacacaggcatcatgttccatgtggaagtgtgcagtgggagagattgttgttcctgaccttggctatgcagcgtttctgggatttctctgaccaactgacttgtgttcattccttctgtctggatttctcatggtgactgacgttttccttcagtctttccattttcaatttgggcttgttctcagacaaaataattctgaaaggactggtttaaactcactgactctcttcatacaaagattgcaggctgctgtttattgccttagagacactgtgtactctccagggcacaagaaagagtgttgacatttttgcagctggctgttatccaacttcttactgaaacataaaaattaaacatatatagcctaatgaaaatttaagatggaaaatttcatccctgttcatttgtcacagctgctgatgtcagttatggtctcttgtgtcacgtgtggtagtggaagaaattggctgtgggagcctttctccttgggccggaactgcccatcaccagttacggggagcctaggttctcgggacatctgggccttcagcagcttgtgatcaatgtcttccaaatgtaaactatgatttgaaaatctccagtgttatcttttcatttgtattgtctctttcttggtgccttttctaagttggttaaaaagaacaatgtgattgtagtcagtgtaccacacagtacttcctggatcttatgggttggatctttacggagctagggctggtgaagcctcctgctgtcacatggagcaaatggctgagttacttcactagaacctcagttttctcatctgtaaattgtgcctatggtcatcctcaggagtgtgtatgagcattggcccaggcagcgtcccaggtgcagtgggcctgcaggaagccctaggactctgcaccttgtgggtgctgtttgtacttacctctggtgagctccagactctagcacgttacttgtaatgtgttgaaaagacaccggaatttggtagtcctggacactcttcactcattctaggaagtgagatcacgacgagttcctagggttttgccttctggaggttgctgtgtgcccaggctgaagatggactcagtgcatgtttttgtggaccttggagcatcttattgcactgagcttaaatgtgccagctcttttaatgcaccagagctgcatcttaagtggtctctgtaggctaaagccttgaaatctgtttaaaattaatttcaggccgggtgcagtggctgatgcctgtaatcccagcactttgggaggccgaggcgggcggatcacgaggtcaggggattgagactatcctggctaacacagtgaaaccccatctctactaaaaatacaaaaaatcagccgggcgtggtggcgggtgcttgtagtcccagctactcgggaggctgaggcaggggaatggcgtgaacctggggggtggagcttgcagtgagccgagattgtgccactgtactccagcctgggagacagagcaagacactgcctcaaaaaaataataaaataaaataaaattaatttcagtaaatttttcatttgcctgttgcttagatgtcttgctaaagctgatatttaattacgatcatgagtgaccaggccatgactggccttaaagcaaaaaaaattagtcttctgttacataagtgcctttaaagttttgttcaactgactatttctgaaaatttcagccctaagttgaaaaagcaaacactaaacagctaaggtttaaaaagcaaacactaaacacctaaggttgccatcggtacccctttaattttaatcacaaattgtgttgtcttgggagtagcagagagactagttttataccagcgctcttcaggtcaaatggaaacgttaatcagtctggttaaatttttgtagtttccttaatatttctacttttggaggtttttctgtttgttttttgttttttactcttccaaatggcacaaatgttaatcttccaagcatttttctcatgttgaggttactaagaaatgttagtggtaggaatgatacttaactaatactctttgtaaatgaaagccgtgatctgtccaggaaatatctgtgcttagtggctggtttactcattgtctttcacaattgaatgacctcacagtgaccatctctgcttgtgtcagttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgaggtatggacatggcttcttcgtagcaacaataaatgacataaaatgatggtctgacattttaatattttatattactctgttttgaaaagtgcaaattacaaaagattgtctttaaagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggtaggactttgcttgctgttttgccaaggatctctttttctgtgtgtattttctctaaacatgagcattactgaatacaaaattattttgtttcccataatttctgaaggttagaactgaagagagtcaaggcatacttacaatctccatttgaatcttgtttttcttgctcgaatatcaatcttgatttcgcaacaccccatagcagctctgtggaggccttttttgtctgtatagaagcaaagagaggagttaaaaaaaaatagtggaatattaaaatttcaggaaaggtttgtttttcctgttcattatctgttcttctgttagccaaaggtgagggtaccttattagctttttttctcagaatttcataaatagatgcttaaacaagtttttggccgggcgcagtggctcacgcctgtaatcccagcactttgggaggccaaggtgggtggatcagttgaggccaggaatccaagaccaggctggccaacatggcaaaaccccgtctctactaaaaatacaaaaattagctgggcatggtggtgggcacctataatcccagctacttgggaggctgaggcacaagaattgcttgaacctgggaggcagaggttgcagtgagccaagattgcgccactgcacttcagcctgggcgacaaagcaagactctgtttaaaaaataataataacaacaataataataagcagtctttaaatgaaagaacaaatgaaggtcaaagtgcttggctgatttattttattaggtaatataaatgtaacactcagatggtaaaggtgatgttgaaaggtctatctgggaagtctgaccacatctccttaccagttttttcttctacgtataatgtttttgatgtcttatccaagaaaactttgcctaacacaaaactgttttcttttagaagatttataattttagttcttagattctgtttgactcagcatttagttattgtgaggtgaggatataaattcaccttttctgcatatatagatatccaattgtttcagtacggtttgtcagaagtaccctattgaattgccttggccatttattgaaaatttattgaaaatcaatggactgtaaatgtaagagtttatatttggacattccattctgttcatttgatctctgtgtctgtccttacacccatagtgcatttgacaattgctttatggtaagtttaggaaaatgggatagggtcttccctccagcttggtacacctttctctctctctattttctttcttttttttttttttttttttttttttgagatggagtctccctctgtcacccaggctggagtgcagtggcgcgatctcgcctcactgcaacctctccctttcgggttcaagcaattctgcctcagcctcccaagtatctgggactacaggtgcacgccaccacgcccggctaattttttgtatttttagtagagacggggtttcactatattggccaggctggtctcgaactcctgaccttgtgatccgcccgtgttggcctcccaaagtcctgggattacaagcgtgagccactgcacccggctggtacacccttttcaaaatcgtttatgctgctcaaagttctttgcattcccatataaattttaggatctacttgtcaactacaaaacgcctccttggatcttgagggattgcatcgaattcttgaatatatatttagaattctccagtgaaatcctctggatgtggttgtggtcttttatttgtgggatgatatagatcaatttagggagaatgcaatcctaacaaaattgagtcttctaatctgtgaatatgctttatctttccatttatttaagtcatctttaatttttctcagtagttctaaaaaaattccagtctttgtgtctggaatatataagtattatgtgttttcattcacagtaaaaggtattttctaattttgatttccaattgatcattggtaatacatagaaatacaattgatttttttatattggtcttgtgttctgcagctttactaaacttgtttattctagtagggttggttctagtaggtccttttgctgttgttttggtagattactttggattttctatatacaagatcatgttgtctgcaaataaagttttagttcttcctttccaatctggatgcaatgcttttaatcttcccttccctttcccttctcttttctttttctttccttcctttcttctttttaagaaacagaatctcactctgtcacccaggctggagtgcactgctgcagtcatggctcactgcagcctcaaacagctgggctcaagcagtcttgctgcctcagcctcccaggtagctaggactacaggtgtattacaactacaggcatgcgccaccacgcccagctttaaaaaaaaactttctgtagagagagggtctcactatgttgcccaggctggtcttgaacttctggcctcaagccatcctcccatttcagcctcccaaagttttaggagtataggtgtgaggcaccatacccagtctggatgcttttaatttcagtttctttttctttttttttgagacggagtctcgctctgttgcccaggctggtgtgcagtggtgctatctcggctcacggcaagctctgcctcccaggttcatgccattctcctgactcagcctcccgagtgcttttaattccttactcttgccttattgagctagctggaaactcagtacagaatagaattgttgcaagcagatatctttgccttgttcccaatcttagggggaaagcatttaatctttgaccactctttaaatgtgatatcaagtataggtttttcatagatgccctttattgggttaaggaaattctattctactcctaatttcttgagttttttcatgatttgaatattgaattgtattgaatattgaattgttcagtttttcaaatgtcttttctgcatgtgttgcgatcttgtggttttcgttttttattttgttaccgtggtgtgtcacatcagttgatttaaggatattaaatcaacctgtgttcctgggataactcccacttggcggtggtatataatccttttcatgtgttcctgagttggtttgctaatattttgttaggatttttgcatctgtgttaatactaataaaatatattggtctgtagtttcctatctttgtgatgtctttgtctgactttggtatcagagtaatactggcttcataggatgagttaggaaatgtttttttcacttatgttttctgaaggagtttgtttaagattgagatttattaaatatttgatagaattcaccagcaaaatcctgtaggcctggtctctttttgtgggaagatctgtaattactaattcaagtttcatttgcttgtaataggtcttttcaaatttcctatttcttactgagtgaatttcaataatttttgtctttgtaggaatttactcatttaaattgtctaatgtgttggcataaagttattctatactgttataatcctttttaattctgcagtgcctgcagtgatgctaattcttgatttgggtaattttatcttccttttaacggcttcagtcacttgggctaaagatttgtcaatttctctgttttcgtttctgtgtcattggtttccattctgaaattgattatttctttctatgttctttgggttttgcttgctcttccttttctagtttgttgaaacaaaagcttagatgactgattttagagcttccaaatttattgagacttgttgatggcctaacatatagtttacctagatcctgttctatgtgtacttgaaaataatttgaactttgttcttgttgtgtggagtgttcaagaaatgaaagtttgatcaaattggttgatggcattcttcaagtcttctgtattgtcttggtctatccaggctaccatgtaaggacagtaaccccattcctgagagtagagccttccaaagtccttatcgcctaataccatcactttggaggttaggctatcaacatatgaattttggaggggcacagatactcagatcatagtatatattcttactgattatctgtctggtggttttatcggttactgagagaggcatattgaagccttcaagtttaactgttggattatttccttctcctttcaattcttccttgttttggttcatgcatttgggggtgatgttattgaattattgttatagctcccctgatatattgccccttttatcattatgaaatgtttgactactggtgtttcttaacgtccgttttatttgttagtatagccactccaccttcttgggttactgtgtacatgtattttttcatccttttactttcagtttctttgtgtctttgaatctaaaatttgtctaacatcttttagttgggccttgcatttttatcctgtatatgtcagtatctgcctttttaaatattaaacaaaaattttagtgtactattttaattcttctgttgattctttttttaattttcttagtggctgctgtagggttacagtatgcatctcttgtgaatgtcgttataaaaaataaaaagaaacaaaaattaaaatacaatatgtatctctttttttcttagagacagggtcttgctctgttacacaagctggagtggggtggcatcatcatgcctcactgcaacctcaagctcctgggctcaagcagtcttcctgcctcagcctccttagtaagctgggactataggcatgtgccgccatgaccggctaagttttttaattttagtagagacaaggtctccctgtgttgcccaagtttgtctcaaactcctggccttcagtgattctcccgccaggaaatcccaaagtgctaagattacacttaaccagtgtacccagccacaatatgcatcttttttttttttttttttgatacagagtctcgctctgtcacccaggctggagtgcagtggcgcaatcttggctcactgcaacctctgcttcccaggttcaagtgattctcctgcctcagcctcccaagtagctgggattacagatgcgcaccaccacgcccatctaatttttgtatttttagtagagacaatgttttgccactttggccaggctggtctctaactggcctcaagtgatccacctacctcagcctcccaaagtgctgagattacaggtgtgagccaccacgcccgcccacaatatgcatcttaatttatcacaatctactccagattactactgacttaattccagtaaaatatacaaactttgctccgcaggagctccatttccttctttctcctttgtactattattgtcctatatataattacatttgtatatgttacaaaccaataatatgttttaattactgctttatacagctttataatttctagagcaaataaaagagaaaaatgtatttatacagtgcctgcctgcctgccttcttttctttcttttccttttcctctctctctctttctctctctctctctttctcttttccttttccttttcttttcctttttcttttcctttttttgagacagagtcacactctgttgtccaggctagagtgcagtggcacaattttggctcacttcaacctccacctcccaggttcaagcagttctcctgcctcagccacctgagtagctgggatcacaggcaagcaccatggcacccggctaatttttgtatttttggtggagatgacatttcgccatgttggccaggctggtctcaaactcctgacttcaggtgacctacccgccttggcctcccaaagtgctgggattacaggcatgagctaccacgcctggcctgtatttatacagtgttttctatttgctagctggctagtcatttctggcattcttcattttaaattctgccgaatttaagttaccgtcttgtttttaccttcctttaatatgtcttacaggaccagtttgctagcagttaattctgtttttgtgtaaatgtctttattttgccttcattttaaaaaatagaccaggcatgggggtgtctcacgcccagcactttgggaggcagaggcgggcagatcacctgaggtcaggagttcgagaccagcctagccaacgtggtgaaaccccatctcttctaaaaatacaaaaattagccaggcgtgctatcatgtgcttgtcatcccagctacttgggaggctgaggcatgagaattgcttgaacccgggaggcagaggttgcagtgagacaagatcgcgccattgcgctccagcctaggcgagaagtgagactccgtctcaacaataaataaataaataataaatagagtggttgtttttaggaatagctttagactcacagcaaagttgagtgagagctacagagacaccctatacccagggtccccacacacagccttcccactatcaaattccacaccagagtgttactcttgttacagtcatcagctgtcagactgttagaacaagcagtcagttctcctggcagcctggctttctcaagaaggtgttttagtagggtctggggtcatcctagggacttggcctttggctgcaggaagccttaggtggtcattgtgtgccagagttctgcagctctcagtatctctttgtttttatccatcttaaggttcactgagcttcttggatctgtagaccaatgtttctcatcacatttgggaagtggagtgtccaggtgttatttggatgctcttccccctttcctctgggacttggttctgcacatgctggagtgctggctgctctcccacaggcctctgagcgtctgcatactttcccctcatctcttctctctcttcctagatcagttccattgctcttcttcaagttcacagatgatttttctgccattttaagtttgcttttgagcccctttagtgaaattttggtttagctattgtactcttcacctatagaatttatattttactgtttttttgtttctctttttttgtagtaattccctatatgttgaatctttattttcatattttcctttaattctctgaacatgttataacagctgctttgacatctttgtgtgctaatttagtatctgaactcactcctgttaaccgtttgactatttatttcctgcatgtgggtcacacttttttttttccagacaaggtcttgctctgccacccaggctgaagtgcagtggcatgattacagctcactggagcctcgagcctggacctcctgggctcaaacaatcctcccacctcagccccccaagtacttgggactacaggcacacaccaccatgcctggatagtttttgtactttttgtagagacagggttttgccatgttgcccagactaggcttgaactcttgggctcaagtgatcttcccacctctgcctcccaaagtgttgggattacaggtgtgagccactgcgcccagcctaggtcatacttctctttaatctttgcttgtctcataattttttgttgaaaattggacattttaaataatgtgataattttgcattatcattttttcccttgagggtcctttgttgtcttttgtttgtttccttgtttttgttatttcctgggcttcagttgcaggacctgtatctcccacattatgtggctgtgggtgtctcagcttacttcttctcttctcctttttagtttggcttctagaggtctgccctttgtccacctggctgattggccagctgatgatttgggcagaggttgcccatgcaccttgaatccacaggggctccattgttggctgtggggtgaatgcgctcagcactcagccagttctcaagtcagctgtgttggccccttcctccagcccgtgaggtgtcctcagtgcatgcactgtgctctcctggtcagccagcgagttgtggacagcttaagaagcccttccgtggcgctctcatttccagggttctctctgttagatttctgtctcctttgccactcaccccagttgggacctcagtctcaagggaacagagctgcaggcttccctattcattcccttctaagttcactgcttttactgcttcaccctctgcctgaccaggctgctgtttttggtagcagggttggtttgcgctgacatccctgcagtcacagaactcctgtgcccactgccgaccgagtcaggggtggagtacaggtgcaggaaatggaaagagtcccagacaagaaagccagacttgctgttcttccttgaagttctagctgatttgcatgaataaatgtgtcgcggtattttccttgggctgatttccagagcctcagaatggttgcctttgacaattgtgttcagttttacatttgccctgagggaaaggagccactgacctcttcactccaccgtaaccggaagtcgcgtctctgctttgttttggagaatccatgtgtgactacttagaagcagtgtgagcccagtggagcacagccatcccctctctactctgtcgtcttcactagttcccttgtccctgctcacatgtgggaagagagattttctgcataggcataggattcagaaccagtggctctacctgagtctgtctgtggaatgaggtacacctttcttctctgtgcgtcttcttcagtctcagtctcttggggtccctcgttttccttgcatggaaggccctggtcaactcagggtgtcaggaaaagcccacttacctttgtatttgctttgtaactacttggcagaatgtgactgactttaattcataccatttattgtttcactaaataggtatgttttttttctttcctcttaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggtaagtcagggcaaaaagggtctgaaagctcactcttcactgagatcctacaggagtacatagtcaaacaaagaaatctgtgaattagcaacttgcataggatagcatctgctctggataggaaggtctccaagtgtttcctttcaccataatctcttaagcactgtaattgtgaacctttacagttgtaacaatcattaaaaacaactgtgaaggtcatagttcttttattcagaattaaatagaacagaaggatttttcaggtgctatttctaacaggttaaacctagggaatatttccacaggagaccagtaatctacttgtgatcttccagggcttgctcttcttcttaatttgataggtaaaataatgtgaatacaacatgagtcctctaacactggctggactctacagggtctaaaatgtctatgctgctttagcatttagaaatacacgagcctaaataaaggaagagccctaagtgtgatgccacagaaaactataacgccctgcaggtgatggagcactggggaggggagggtacagaaaggagaagctgccagaaacccagtgtgaagagcccattcaggaagtggagtgaggatgtagaaataagttgatttttatgcatttcttcccagagaacctcatgtgtatacttagtatcttagactttacagtgaaattcttaggctggtttctttctttggaccttagatagctttgcctctctagttattttgagcttaactttaccagaatgactcaccgtaattctgattgttttcttttttttctttgtaccagttattcttgtccaaaggtagctctaatcagtcaaaaatataatttatttcaaaccctaatttattatttaaaacattgcttttgagctggaacagaaagggaggaggacatgacatggaatgattttttccagaccacagtttttccaaacacatgtgtgttttctcccctctaggggtcactgtgaagtggggtacatgtagcccataagtgaggtttgttgtctctttgctagggagaggcgtaggtggaagattaacagacacaggtttagaatagagtgtaataagtttgccacatctattgtaattacttggcacaaccatccaaattcatgcttaaattttgttagattgaatattgctcagtttgaacttttaatgatgtcttaataatagaatgctttttaataacatttttcaggtatgtagtcagaaccaggctatcttcatggtccgcctggtttgtagcctgattttctctgggtgtaaagtgaggaaggtttccactccctgctgtagcctgaagagagctctattacctagttccaagaaaagataatattctgttagatgtttttgctgctggaagctattcaagaattagttccgaaaaataagtaagatagtaaaattgattattactaaagactgtggggcccctttggttaaaaattgattattttcccgggcttttggccttttcttaggaaattagagatctatatatgggtaaaagaagaaaaacatgttttaggagcatcatttgtatctaatatctgttctcttgatacctgttaaactttaatcatatagaaagatttgaatagaaaagcaaatatggagtcaagccatatacggtagaggtatagaaacttagaaatttataactaaacgttatttctaccacttcagcaaactgaagactattcactgattcatttaaaatatgtggtggccattattatgtggaaacataagatacaattatcaaaatacttcatttgcatctggtatgaaaatgttcgtttctgtaaacaaacttgaattgtcacttaccaggtcttacaagattagtttgtgttatttgacttagtttggcttagttggatgctgttgaccacatctgtgcctaaatgcataatgcgttagcagccctgaaggggtctcctggtccaccagtgagttgtggacagcttaagaagcaaatgagctatatcagaattgcacaaatttcagtgacattggaggaagtttcttagagataatcaacagcaggattgttgggcaagaagttctgaatgtagggagcagaaggtgggtgctgaacgtggagggggccttgtgtactgtgtctgccatcacttttgcattgttggggccttggggagtttctgctgtgctggggtcacagtttttgccttttggcacattatgtcattgtagttgtaattcttataattcatattttaggctttgtgggtaaatatttagtacctaaaaagtttagcatgggtactatgaaaaatttattttctggctggttgtggtagctcacgcctgtaatcccagtgctttgggaggctgacgtgagaggattgattgagcctgggagctcaagaccagagcaacatagtaaaaccctgtctctaccaaaaaaaaaaaaaaaaaaattcttgaaattaaaaagacttgaagactaatttctgttttcaagtgtctccataccagtgacataccgaatttatatatggagtataagttatttgaaagttcaaagtattgctgagaaaaatacagtaatgaaatactacataaaataaaaactgtaagtgccagagaatttaatttccaaatatttggggatctcccaactatctttttgttactgatttctactttaattccattgtgatctaaaagcatgcagtgtataatctctggttttttgagtttattaaggtatgttttatggcccagaatttggtctgtcttggtgaatgttccgtgtgagcttcagaggaatatgtgttctgccgttgttcagtgaagtggtcttcagatgctcattatgtccaattgattgatggtgctcttgagttctgtcagtcagcaactatgttttgactgattctctgcctgctggatctgttcatttctgattgcgtgcccttgaagacttccattgattcatcggtttctccttgcacagttctatcagcttttgccctacaaagtttgatactctgttattagcggcacacacattgagaattgttacgtcgtcttggagaattgaccctttttcattatgtaatgctccttactaccactggtaacttcccttgctctaaagtctgctctgcctgaaattaatatagctcctctagctttcttttggttagtgctagcatggtatatcttccttcattgcttactttttgaaaagatttattatagtaaaatatgcactaacataaaatttacaatcttaaccatttttaagtgtagaattcagtggtattaaatacgttgataatgttgtgcagccatcatccgtctccataactcttttcatcttgtaaagctggaggtttttacctgttaaacaataactccacttctcccagccctgggcatccattattctactttgtctctgtgattgtgactactctaagtacctcatgtacatggaattgtacagtatttctctttttgtgactggcttatttcacttagcataatgtcctcagcgtttattcatgttgtcgcatattgcagaatctccttcctttttaaggctaaataatactcatcatatggctgtaccctattttgtgtctccatcagtgaacacgtgttgtttccatacattagctactatgaacagtgctgctgtaaacatgagtgtacaaatatttcaggaccctgctttcagttgtttggggtgtgtacccggaagtggaattgctagatcatatggtaattgtatttttaatttttggaggaactgccaccgtttcctacagtggctgcaccattttacattcccaccaacagtgcacaagggtttcagtttctccacatcctcattaacacttgttattttctgttttgcttttttaatagtaaccatcctcaaggatgtaaggtggtatcccattgtagggctttttgtcttgtgtaaatgaccacagatacattgtagttttgatttgcatttccttagtgtttagtgatgttgggcatcttttcattgttcattgactattcgtatatcttctttggagaaacatctattcaagtcctttgctcgtttttgaatcaggtttgttgttgttgcattttagttctctttctattctggatattagtcctttatcagatatatgatttgcaagtattttctcccattctgtgggttgcctttttactctgtcgatagtgtctgttgacgcacaacatttaaaaatttttcagccaggcacggtggctcacgcctgtaattccagcactttggaaggccgaggcaggcggatcacgaggtcaggaggtcgagaccatcctggctaacacagtgaaaccccgtctctactaaaaataaaaaaattagccgggtgtggtggcgggcacctgtagtctcagctactcgggaggctgaggcaggaaaatggcgtgaacccggaaggtggagcttgcagtgagccgagatcacgtcactgcactccagcttgggcgacagagcaagattccgtctcaaaaaaaaaaaaattttcatgcagtccaatttgtctattctttgttgcctgtgcctttggcgttacatccaataaatcattgccagatccagtgttgtgaagcttttgctctctgttctctcctaagagttttgttctttccttacatttaggttggtaatccattttttagttcatttttatatatggtgttaggtaagggtccaacttcattcttttgcatgtggatattcagttgtaccagtaccatttgttaaaaagactgcccttttcctgttgaaggatcttgccatccttgtcaaaaatcatttgaccatatatctgaagttccagttttgggctttctgttctgttccattggtctgtatgtcatgctgataccacacagttttgattgctatatctttgcagtaagttttgaaatcaggaagtgtgagtccaccaggtttggtgggtttttttgttgttttgttttgttttgttttgtttttgttttttttgtagagattgtttgggttggccgggcacggtggcttacacttgtaatcccagcactttgggaggctgaggcgggcggatcacgaggtcaggagatcgagaccatccttggctaatacagtgaaaccctgtctctactaaaaatacaaaaaattagccgggcgtggtggcacgtgcctgtagtcccagttactcgggaggctgaggcaggagaatcacttgaacccgggaggcggagattgcagtgagccaagatcgcgccattgcactccagcctgggcaacaagagggaaacactgtctcaaaaaaaaaaaaaaaaagattgtttgggttattcaggatcccgtgagattctatatgaatttagggtggatttttctatttcttcaaaatacatcattggcattttgatggggactgcataactgcattgaatctgtagatcactttgggcagtatgtacattctaacagtattgtcttctaatcaacaaatatggtatgtgttttcatttatttatgtttttttaatttcttagagcagtgttttgtagtgtgtgtttgtttgtttgtttgtttgagacagagtctccctctgttacccaggctggaatgcagtggcatgatcccgctcactgcaacctccacctcctggtttcaaacgattctcctgcctcagcctcccgtacaggcacgtgccaccacgctcagctaattttttgtattttaatagagatggggtttcactgtgttagccaggatggtcccaatctcctgaactcatgatctgcctgccttggcctcccaaagtggtgggattacaggcgtgagccaccgcgcctggcctgttttgtagtttttatgatacaactcttccacttctttggttaattcccgttggtgttttgttttggttttggtggttttttttttttttttttttgagacagaatctcactttgtcgcctacgctggagtgcagtggcatgatcttggctcactgcaccctccaccacccaggttcaagcgatactcctgcctcagcctcctgagtagctgggattacaggcatgcgcctccatgcctggctaattgttgtatttttagtagagacggggtttcaccatgttggccaggctggtctcgaactcctgacctcaagtgatccgcccgcctcggcttcccaaagtgctgggattacaggcatgagccactgtgcccagccctaaattattatttttgatgctgtcgtgaatggaattgttttcataatttccttttccaactgaccattgttagtgtatagacatgcagctgatttttgagtgttgattttgtatcttcctactttgctgaattcatctattctaacagactgtttttgtggaatctttggagttctctacattgtaaaatcatatcatctacaaacagagataattttacttcttcctttccagtttagatgccttttatttctttttcttgcctgtttgctccggctgaaatttctaatactgtgttgaagagaagtgatgaaagcaggcatccttgccttgttcctgttatttaaggaaaagctttcattcgttcaccattgtttgctgtgggtttttcatatatggcttttattatgttttggtagttttccttctattcctagtttgttgggtgtttttgtaatgaatgggtgttgaatttgtcacatgctttttctgcaccagttgtgatgatctttggctttttccagtctgttaatgtggcatattaacattgattactttttatacatagaattatccttgcattctgggaatgagtcccacttggtcatggtgtatgaatcttttaatatgctgctgaattcaggttgctagtattttgttgaggatgtttgcatgaatgttcacaagcgatactcgtttgtagttttctttcttttttttttttttttttttttttgagacagagttttgctcattacccaggctgagtgcagtggtgtgatcttggctcactgcaacctctgcctcccgggttcatgtgattctcctgcctcagcctccagagtagctgggattacaggcatgcaccacgaggcccggctaattttgtatttttagtagagacagggtttctacatgttggtcagctggtctcgaactcccgacctcaggtgatccacccgcctcggtctcccaaagtgttgggattacaggtgtgagccaccgcgcccgaccctgtagtttttcttacagtgtctttggctttggtatggggatatgctcaggacatgagttagaaagtgttccctcctcttcagttttttggaaactttgagaaagattggtattaattctttaaatatttggtagaattgactagtgaagccatcaggtttggggcttttctttattgggtgatttttttttttttctttgagacggagtcttgctctgtcacccaggctggaatgcagtggcacaatctccactcactgcaacctccgcctctcagattctaagcgattccctggcctcagcctccaaagtaactggaactacaggcacatgccaccacacccagctaatttttgtatttttagtagagacggggttttgccatgttggccaggctggtctcaaactcctgacctcaggttatccacccatcttggcctcccagagtgctgggattacaggcgtgagccactgcgcccagcctattgggtggtttttgattaccagttcaatctccttactagttacaggtctgttcagacttttctatttctttatgatttcgtcttgataggttttgtgtttctaaaaattttttcatttcatctgttttatccagtgtgttggtgtacagttgttcgtaatactttcttttttctttgaaacggcatctcactctgtcacccaggcaggagtacaatgacatgatcatagctcattgcagcctcaaactcctgggctcaagcattcctcctcccttggccccccaatagctgggattacaggcatgtgccaccactcccagctaattttttttttattgttttggactcttccagagagaagacagggtctcactatgttacccagtctggactgaaactcctgggctaaagcagtcctactacctcagcctcccaaagtgctgggattataggcatgagttaccaagcccagccaatacttacttacttttttttttgagacggagtcttgctttgtcacctaggctgaagtgcaatggcaccatcttggctcactgcaacctctgcctcccaggttcaagagattctcctgcctcagcctcccatatagttgggattacaggcgcccaccaccatgcccggctaatttttgtatttttggtagagatggggtttcaccatgttggtcaggctggtctcgaacccctgacctcaggtgatccacccacctggacctcccaaagtgctgggattacaggcgtgagctacagcgccgagcccagccagtactttcttataataccttttatgtttttttcttaattttaatttaattttctgctttttagagatatgcttgctctgttgcccaggctggagtgcagtagcacgatcatagctcactggagcctcgaacgcttgagctcaaatgattctcctgtgttagcctcccaagtagctatgattacaggtgtgcgccaccactcccagccccttttatttctgtgtaatcaataataatgtccccactttcatttctgattatagtaatttgagtcttttttttttcttactccatctcactaaagttttgtcagttttgtttctcttttcaaagaactatattttggtttcattgattttttttttcccctattgtttttctattctctatttcattgatcattaatctctgctctaaattacctttcttctgctagctttgggtttagattgttctttttctaattcattaagatgtgaagttagggagggttttttgtttcattttatttgttgttgttattgagacaaagcttactcagttgcccagcctggagtgtagtggtgcgatcttgggtcactgcaacctcgacctcctgggctcaagcaatcctcctgacccatagtctcgtagcttggactacaggtgtgtgccaccatgcccagctatctatctgtctgtctatgtatttatttacgtagggacggaggtctcaccatgttgcccaggttggtctcaaactcctgggctcaagcagtcctcctgcctcagcctcccaaggtgctggaattacaggcatgagccaccacgcctatcctagttaggttgctgatagagatctttcttgttttttgatgtgtttgtagctatacattttgctcttagtgcttgctttcactgcgtcccgtaagtttcagtatgttatgtttttgttttcatttgtctctaagtattttctgcttttctttgtaatttctttattgatccattggttgtttccatccctttacttttaacttctcagggtttttttttttttggtttttttttttttttgagacagagtcttcctcggtcgcccaggctggagtgcagtgatgcgatctcggctcactgcaagctccacctcctgagttcacaccattctcctgcctcagcctcccaagtagctgggactacaggtgcccaccaccatgcccggctaattttttgtatatttagtaaagacagggtttcaccatgttagccaggatggtctcgatctcctgaccttgtgatccgcccacctcagcctcgcaaagtgctgggattacaggcgcgagccaccttctcagggtttcatatgtaaagcaggtttcttgtagacatgtatagttgtgtttgtttgtttttttatttttagagatggactcttgctatgttacccaagctgaacttgaactcctagcctcaagcagtcctcccaccttggcctcctgagtagctgggactataggcacatgccaccatgcttgttgttttttgatgtactctgataatctttgtcttttcattggtgtatttgactattcacatttaaagtgattttttgatgtatttagattaatatcagccatgtttgtaattgtttcctattcattatgagtctttttctgccttctctacttttaattaagcgttttatggttttatctcctctgttagtatatcaattttatttatcttttttaaaatttctgcagttgccctggagtttacaatatacattttgaactaatctgagtcctttttcaactaactaatgtaaaaaaggtaacatttaacagattactcccgacccttccctattccctgtgacattgctgtcattattttcacttatccacatgtttatcacccagtacagtgatgatgattactttcaacagttatcttttagatgaataataataagaagaagatattttactttgtctttattccttctctagtattcttcctttctttatgtagatccacgtttctgaccttctatctgaaggaaatcttttgacatttcttgcagggcaggtctgctggtgatgagctccctcagtttttgtttgtctgaggaagtctttatttctccttcacttttgaaggataatttggctggacacataattctaggttggtggtttttttctttgaacactttagaactgtttaacttccctctgtccttgctggcatggtttctgatttctgacaagatgtcctctggaattcttttcgaattcttttccctgttcttctgtaggtccacttgcccccacccagctgctttcaagattttctcttttttttttttttgttttttgttttttgagacagagtcttgctcagccgcccaggctggagtgcagtggcgccatctcggctctctgtaaccactgtctcccaggttcaagtgatgctcctgtctcagcctcccaggtagctgggattacaggctcccgccatcatgcccggctaatttttgtattttaatagagatgaggtttcaccatgttggccaggctggtcttgaacccctgacctcaggtgatcgcctgccttggcctcccatagtgctgagattacaggcatgagccatggcacctggccaagattttctctttttctttggtattctgcaggttgaatagaatatgtcttcatgtagctttgggggtatttattccacttgatgttctctgaattctttggatctgtgctgtcagttgttaatttggagactttttagctattactacttcaactgtttctctagtctctccttccagcattccacttaccaggtgttatatctttcgaaactgtcccacaggttttggatgttttgttctattggggatattgtttctgtttttgtttttaattcttgtttctctttgccttgcagtatgggaagtttctgctgacatatcttgcagctccctgactctttccttggccgtgtcgtctcctgatgagtccatcactgatagtcttcgtttctcttagattgtttttattgccagcatttcttcccatctctctgctcacacggcccccttgttcttgcatgctgtctactttttccattagagcctttggcctaccaatcattttcaatttcctgtatgataattgccatccatgttatctccatgttcctgcaaccattcagttgtctctctcagcctctggtgagattgttgttagaccttcttctgttctgcattcctaacactctcttgcatgtttctcatctccttttctcccagttccatgttctgagaacttttttgggatcagtcctccagttaagtgattctgtagtggtgcctagcctgccacttaagtcctgattctgactatatttattatttataagttttaatttactttttttttccaaagatacttagtagctctttatattctcttgttccttgttttttttttctttctttaagcatttcacacatagttactctgtgtttgaatgaaaccttgagcatccagattcgttttctgctgatatcacctgtgatgtattatttccttttgcggatggagtatattaggaggttatgttttgctcagcttactctgtgagaaccacagccctccatagtggatgcttccctgtgagggttggcgtctgctgatgcgagagctgcctgagacctgggctcctcttgagggcctccagactgctgcccccacacgtcactgtggcgatggtgtacggctgttccttcccctcacctccacctcgcttctctcatgacctcctgatacttcttttcatcctttgcctttgtcgatagcagttggttaccaaagtgttcagtgtcatttctctcagatctagagctaagtagcccctcttacctagcaaggcccagaccaggggggaagaacggccttcaagagaagagcaaagccgagcaggtgcggctgcattttgctgctccttccacgtggcctaggagtaggaagttaacgactacagggcctgaatctataccggaacccaaggcatgtgactttgaatcctgggtctttttcatccaacacggaggatgtactgtgaaacagttggtgtactaagaaacggcctagaagtgaagacagggatgtctctaagtctccactgagaactttgcagtggagcatttgcagtggccactgggttctggccctcaggagttcagtgtatcaagtggagcctggtgacgtggtgtaaggggaggaccgggtgccaagtagccttggtcccttgttagcttcgagggccagggtgtatctttacactccctctctgggttactttgagacttaagtaaaaccactggaaacgcatttaatacagttaaaatatgattcagttaaatatagtttaaagtataagtgcagatttagattgggcaggtaaagctatgtggataatagggtcataaataggttgcaatatggggatcacattgtgatcttcgacctgcatgttcttttagagctgagattcagctcttccagcctgaaaactggcacagccaaagcaaagatggtccttcgcctctttaccaatctctgggagaaataccaaaaaacctgttaagcagaaatacagagagtctgtcatcttaaccttttcgttactggggatacaactggaactcatttttgctcggatgcttagtgttgggaacctctcacgtgtgggcctcatgactcagtctgcggctcttgctcctcatgtcttgcacccatgttccatgtccgagtgggtgtgggtggtagaggacaggcgagtcacctagctcctggataaactcagtgtgtgcgcagtggaaagcagtttgttgtgtttgcatatttgtgtcagagctttcatttaaagcaacagttttccttttctatggattacttcttttgtctcaaagtggataaaaatgcaaaacttctgctagttgaagctttgtgggtttgtataacgagtgaaattggtgttctgattcaatagcgtagtccacgttctgagagagttactttacagttatatcattggtggacttataaagtcatggtccaaaaatggtctaggtgacagacacctattttttcctgaaagaaatccataagctattgaggtcagtaggcatcttctgcaaaagcattaaagaaaatacaactttttttgttactgatccctgttacttttgtccctacaactgggcttccgtttttgagtgtgtggggttctgaatagtgtgtaaatcaaatgcgtagaatcattgccgtatgtttccaatattacagttatatagatgcattcccttattcctctaagctagacactgttcagcaaacacttattgaacacccaatatgtgccaggccctgtgctagactctaggaagacaaaaatcggttagtcttggcccctcttttcaaagagttcacagtctaaagagaagacaaaaacataatcaaaatatcaaaatgttgtgacttacagatgctaggcagaaaagtaacaccgaagagagaaaattttaaatgagcccacgggtggttttgcagaggaggtgatgctgatgaaatagggttttgaagcataagcaagagctctctgaacacacatgggtggtggagcccaggctctcagccaggcttttcaaacctgaaaccaaacaactcatggtcgtgtcttgaggagtccaggaggcacttaacgtagcttcagagccctgagagtgcttctagtcatggtttaccagctgggccggcacaatgggactgctgctcaaagctagcagtttggcatctgtcacgggcttctgccttttacaagaaggtcctcaagaccaagaagtcttctacttgttactttttgtcaattacttctcagcaaagcagctcttagcttatcgctgctttgtagaaatgggtatctattgaaatacgtttttttattttcctggctcttgtcccatggggctcccttaccaaaacaatgacttcaggccctttactgtatcctgggtggcccgtctggacctgtttattcctgctgttgagtcctgagtgtctgctctaccctcctctccccctttgccttcctgggcctgttccaggtcagtggactcgctgagctgtccagcagcccagaggggagtgcttcctctctgctccgaagcactgtggaagaagggcaaggtggaaaggtttggtcggttggtcaggtgttttgtgtccagggactctatgtctatataagtagtctctatatagtagtctctaagactattgtcctagaaaatcaaagcagtgcaccatcacactcactgaatacttactatgggccaggcagtgtgctcaactcttaccatacccctggaggtaggtatttccagattacagatgagaaaactaaagcacaaaaagattgagtgatttgcctgaggtcacacagctagcaaaagggagagctggcatccgagctcgccagactccagagcccaaaggccaagacgtgggactagagttcagatctagctgtcacctgaccgtgcctcctcatagtggagccagcagtggtagctcctggactagatgtgcagtcccagctttcatcttgatagctccagaattcctcctttccttgccaccttcactgccattgcttcatcctttctcatcccctgactaacctactcgtcctccttccgccttctggttcatccacagcattgccacaaattgatctttccacaaagctgaccaaatcatctcactctgctgtttaaatccctctgtgactccccagccccttcagaacaaagtggtacaaagttgtctttggcctggctgctgcccacactcaacctggagcctgtcagggtgtagcactgtcatccctgtacgtgcgccatccctttgctcctaacctcttcctgtcctccctctgccccagccaggccagcaggattctgccgaaccatcgcccattcttaagaaccctccagggaaccctcccacttgagtttaaagaattcactactcatttctgcatcccagaggatgtgatgaccaggttgcccataactgggcacttctcctctccagcagacagaagtcctgctgagggagaaccgtatgtctgcccagcattagcaaggactgggggagaagggccaggacccagatgtcccacctcatcctagagcgcatataatttggggaaaggcagacatcaaaccaacaggctacaagtaggtctcgaattataactgtggtaagtgctaagagggaaaatgacggattttagtgtgttcagtgggaaggctcgccttggtcttgggtgttggttcctgggaggtgacagcaaaggcaacgccggcttctctgaggaagcgatctttaggccgaggcctgcaggatgagtgcgagtgtggtagcgagctgaggcttgcacattctagagcatggacacagcacaagcagaacttagggccaagaaggtgaataggcgtgtgccggccaaggggaggcctgtgtgtccagggctttggtgagcaggaagggtggaggtggtgggcccagctcccttggaactttgcaggccagagccttgggaagccattgctgcatcctgagcaggggagtgacatgctcgaatttacattcaacaaagatcactctggctgtagtggggagaaggactgggaagagttcgtggtgcaaatgtgcaggctgttgcactgcgccactgtgagaacatggtgctcaggatctcctaaggaggtcagcagccagggcctgttgcctggatagtggctgaggcagagggaggacccaagggggccccagcctgtgcaggagcagccagatggctagtggctcaataaatgcatggatgttggctagccagctggccagaccctgctcaccttcccttggtgccttcaacaatggtctgccccacagggcccagggcggggcttgccaatgaggcagctcctttgagaacgccctggtctttagagcacagtatacaaatttctctaggtcattagatttgtgctgtaccttgcctgggtataagaggtcagtgtaagggttttatccattttcatcagtgattccaaagttgacttattagtgatgatcattaaaatgcttgctgagattaagccgtagaaacagatcttacgacgcacatggcacactcacatgtgacccagtaggaatgtgagaagttactgagttgtctaaagtttgttcagatatactcctcaaggcatcggttgcttttcatatctacatctggttgaaatttgacctgtcgtgtacagtctcataaatcaagtccatgttttgtgagatgtgctccccctgggctgagctcagctcatggcgagcacatcccatgaggctcataatgaattgtctgtctgtagtttaactacttacctaggtaaacagaatattaattttgatatgtgattagaaaatttttttttgtaggctttaccgccagca

SEQ ID NO: 369 - DNA, 17914 bp, Homo sapiens
aaaaaactaatttaaatatgttaaaatgccaaaataaaatataaaatttacaaaaaggcataatctacaaaaaggcattgagtcccaccaagaacatacaaaaattaaaaataaattaatgggcaagatataagaagaaaatgcacattaagaaaaagcctcagagtcagatacatttaatatcatttataatacaaattttaatccacccagaagatacaggagtcaaaatcttacacaccaaaaaacactgcattaaaaatatgtaaagcaaggtattcatgaaatacccacagctaacatcatactcaatgaacaatccaaaaagaaaattgagaaaattccctttaagagcatcaaaaagaataaaatacccaggaagaaatttgtatatagaaaactaaaaacaaacacacaaatgaacaaaaacactgctgaaacacattttaaaagatctaaataaatgaaaatatatccttgttcatggattggaagacttaatattagttttggttttttttgagacaaggtctgcctctgtcagccaggctggagcactgggacaacaggcgtgcaccaccacacctggctgattttttattttttgtagagacaggcttcgccatgttgctcgggggggtctcaaactcctgtgctcaagtgatctgcctaccttggcttcccaaaatgctgagattacaggcttgagccactggcgcctggctggaagatttaatattgttaagatggcaatactacacaaagtaatctacagattcaaagaaattgctatcaaaattctaaaggtcttgtttgcagaaatagaaaagccaatcctcaaattcacatagaattgcaaagaaccctgaatacgtaaaacatactgaagaacaacaaacttggagggttcaaacttcctgatttcaaaacttgctacaaagctacagtgaacaaaacaaaacagtgtggtacatgctggcataaggacaaacacacagaccaatggaatagggttgagaatccagaatatcatagatgcatgatatctatagtcaattgattttcttttttttttttggagacagggtctcactgtgttcgcccatgctggagtgcaatggtgcaatcttggctcactgcaaccgctgcctcccaggctcaagtgatcctccggcctcagtcccccaagtagctgggactacaggcacgtgccatcatgcctggctaatttgtgtatttttagtagagacatggttttgccacgttgcccaggctggactcaaactcctgagcttaagcgatctgcccagcgcagcctcccaaagtgctgggattacaggtgtgagctactgcacctggctgccaatcgattttcaacaaagatgccaagaccatttacacaggaaagaatagtctcttcaaacaaatgttgctgggacaactggatattagatgctcaatatcattagtcattagggacaatgaaaatcaaaacaaacagcaatgggacaaccaccacatacccactagagtaactaactgaaaaaaaggaaaataccaagtgttggcagggatatggagaaactggaatcctgtacattgctgacaggaatgtaaaatggtgcagccattgcagaaaacagtttggaaattcctccaaagttacacatagaattacaagatgactcagaaattccactcctaaatatacacccctaaagaattaaaaacaggtactccaacaaatacttgtacacaaatgttgaaggagtgctatttacaatagccaaaaggtggaatcaatccacagtaatattctgttatatgtatatcatcaacagatgaatggctaagcaaaatgtggtaaatacatataacagaatattactcagccacaaatgaatgaactactgacacatgctacaatatagatgaacctgtaaaacattatgctaagtgaaaaaagcctgacacaaaaggtcacacattctatgatgccatttatacgaaatatccagaacgggtaaattcagagacagaaaggaaattggtggttgccaggagatagtggagcggagaatagggaggggcagcttaatggatcctattttgtagtttcaaaatgaaatgttttggaaccacatagaggaggtatttgtgaacattttgaatgtagtaaatgctgttgaattgtatatttttaaatggttagctttttgttacaagaatttcaccttaattaaaaaatatagacagcaaaagctgttagaaatacaagggaggctgccaggcatggtggctcacgcctgtaatcccagcactttgggaggctgaggcaggcagatcacgaggtcaagagatcaagacatcctggccaacatggtgaaaccctgtctctactaaaaatacaaaaattagctgggcatggtggcgcatgcctgtagtcccagctacttgggaggctgaggcaggagaaccacttgaacctgggaggcagaggttgcaatgagccgagatcatgccactgcactgtagcctgggtgacagagtgaggctccgtctcaaaaaaaaaaaaagaaaagaaatacatgggaggctatgagaaaaaacccacaatgatagtgaaaacttttaaaacacattttaaaatttgacagaacaaagggacaaagaataaatgcaatcttagaaaactgatggattacattagaaaacggatcaacttttcacccaaaaagatgtttcatacaaaaatcgacaattttcaaatgcccatgtaacagtgaaatgcaaaaatcatttataaactaagccagaaaaaaaatcattaaaagtagaaatcccaaagtagaaatcttttaatagttcctgatcacaataagaaattattaattacaaaaaaaattgtttcctacctctgtccattaaaatcacctacaaacattgaccaacccaacagtagtgagcacccatagaattcaggttatagaccccgaatgtcatatgctacaaaaggaaccggagttcctaggcaaatgggtgatttcaggtctgggacaaaaaataattctggaaaatctatgcatatcaaaaagcaaggatgtgatctaaaactactagggtagtgtctaaacttaaagaattcctactaaacttcatgtgagcatcattaagaataatgcaaagggctaacatatattaaatatattaaaattcatgagttcacaaatatattttaaaaattcactaatcatctttggaggatgcctgggaaataactcactgttccaaaaactgacaaagaattaagtatttaacctgactttcttttataagctgtacctcaaagtaactactatataattgatgaggaaatgttcatctctagagtagtattccaattaacaaatgaaggaagatggataaaaatagatgatcaccactgcaaattcctaaagaaacaaaggacctaggcaatgatcatcaatggctactaacaccacaaaaagatacagccagactttatgttttttcattcgtttgtttgttgttgtttttgagacagggtcttgttctgttgcccaggctgaagtacagtggcacgatttcagctcactgcaacctccatctcctgggctcaagcaatcctccacctgagcctcctaagtagctaggactacaggtgcatgccaccatacctcgctaattttttattttttgtagagatgaggtttcgtcatgttgttcaggctggcctcaaactcctgggctcaagagatccacccacctcagcctcccaaagtgttggttttacaggtgtgagccactgcacccagcccagattttatgtttatgtgtctcctggtacctaaatactacttacaagtattcttgacaaagtcctaccgaagtagatcacatctctagatctaacgtctagtttaaagtactacggcggacagagcaacatgctaaatgataccagcagatgaaatcagtaaaattctgaacaggagccactcacaggacgaaaaaaacatggtttctttaaccgaaaacaacagcaaaaagagattacaaagaacacaaaagggaggaggaaaatacagattaaaataaacttaagggacgtattaatgaaatgcaatgtccaaactttggatccaaattcaagcaaaataaatgcaataagaacaaattatgagactactagaggaacttaagcactaattagatattttataatattatataactgtcacctattttctacctttgataatggcattgtagttatgtttgtctttttaaaaaagagtccctatctttaagataatgaaatatttacaaattaggatgtatttacaaaaggacaatgtggtgcctgatatgagcttcaaaataattcagtgtcagaggattgggaaggggaggtggaggtacaaaatgaaacacgactggctaccaaatgaaggtttttgaagcttaatgagtacacaagaggtcactatagtacaggttaggcatccttaattggaaaatccaaaaatccaaaatgctccaaattctgaaactttttgagcactgacatgacattcaaggatttcagatttgggatactcaactggtaagtatacataatgcaaatattctcacaaaccacccaaaatccaaaatctgaagcacttctggttccaagcaaacaattaaaaaaaacagaaaaagacttttaaaaatggttaatttaaaaaaattgatttttgcctttcaatctgaagaatcagagataaacttactagatgaaagcttatcaattcagttaaaatttcaatcctccataacattttgatcactttcattaagcctctatagcctgaacttttggaaactttccctataatcaattgcagccttactgttgcactagtccaggtactggcaaacatcagggctgcagcctgtttctgtacagatgtcaagctaagaatggtttttatactttaaaaggttataaaaagtaaaaaataaaaaagactatgcaacagagatcatatatggaggacattcaattaatgaataacaatcaagactctgccagaagcccaccatcccaaactaaatttatacttgagagacctgaaagttcttaaagaccagaaaagactaatataagcattgtgatttttttaaaaacccacaatgcacttttatatgtatgttgaaactcacataagttgtgtgcattattttagtgtatgtgagcttttattcacgtttaagttccaaattaaactctgaaaaagaataaactaacaataaatcatgctataaattttccttaacttttactgatatctaaaaaatagattcagttaaaaaccactgttgatagtacatggatgatctctgcctctgaagcaaggagcttaaagctcagtcaaacacagatcacaaacttataagaattttagaattggaaggatttatagaggtaacctattcttatctccttggtttacagataaagaagggagatgaagagactttcaaacagctaataagctgtataaaaaggcctaggaaaacaatttaaggaagtctgtgactttcctattacatataaagtggttactttcttagttataatcagatctattttaagcctggtccctgagaaatatgattgcacaacactcctcagctaagaaccaacaggagattgtattttctgtttccttagtcacaaaaactgaccctgacctctctccactgaattatagctaatcatcaagccccaagggacctgaaactatgttcccatctctaactaaggttaaaaagaactcctccctccaattttttcctgagacatctggcaacttctatgcatatttgttttgattaggtagtatggatgctgctgctaacaggaatagaaaatagaaaaatatgtgagtaggtaaagccaggaatctttttgaaaacaaactgaattttattactatttaaaaactgttcatttattcacttagttatactcaatcttctgcctcttagattcacaaagactgtcaatatctccagttcaaacattcccaagtatctaacttttaatgtgtaatgggattttatttctgcaactgactttctattactaccaacgatgcatgaggaattcctaggttttaatagtgataatcctctttgcctggattagtctcactttgagtaaaacctttatgaattaggcaagtttttaaatgaagtttttggttaatttgtctgtaaaactgaaaaatatccacattacataccctgcaggagtacctgtgagggtgaagaaattacaatgtgatacaaatgtgggcattattctaaaagagaaagaatgctggcctggtgtggtgtctcacacccataatgccagcactttgggaggtcgaggtgggcggatcgcttgagctcaggagtttgagaccagcctgggcaaaatggtgaaaccccgtctctacaaaaaatgcaaaaattagctgggcatggtggcatgcacctgtagtcccagctactcaggaggttgaggtgggagaattgcttgacctcaggagttcaaggctgcagtgagctgtgatcatgccgctgcactccagcctgtgcaacagagcaagttcctatctcaaaaaaacgtaaacaataaaaaagaatgcaaccatttctggtttcaccaaagtcattttctttatgagggtaatatgatcataaatatattaacttagacttaaaaatggtcaagatggtaaattttatgttatatatttttaacaattaaaaataaaaattataaaatattccttccattgatagatgagtggatgaacaaaatgtggtatacacataccatggaatattactgagccctaaaaaggaaggaaaatctgacacacacaacatggataaaccttgaagacattgtgctaagtgaaaaaagccagacgcaaaaggacaaacactgtatgattccacttatatgatgatggttgcatacattgtgaactgcatttaatcccactgaactgtatatataaaaatggttaaaatgttataataaatttcatgttacgtatattttaccacaataagaaaaaatattaccttgaaggtctccaatcatctcagaatcatgacctctgtctcttcgttcagcttctaatatagcttgcagctggtaataatctttgtctgtttgtgacttagaattctctaaaattcgatttctctcttgcaactctctgttcagggactctaactgactaattgacttgctcatctctgtgtgactcttcctcaatcttacagctgtgtccgattctgtcctaagtaagtcattggcttcttctagctatttaaaaagaaagcaaaaaaataggtttctgaccaaagtacgatataatttaattatctacaatttttttaaaaaggaacctcatttgaaacacttacctgcttttgtaactgggacagcttctcattagcaagctgtgaattctgactgactttctttaagtcttccaactgatcctttaatgtagaaactagaaaatgaaagaataatatatagaaattacaacattttcataggggaaacatataaatccttttttaaaaaaagacatttagtcttaggccataatagtcagctacattaggtccactcccaaagccaaattccaatttggaagtacctgcattttaaattcattaaaaagtagaacattatcttctaatacagagtgcaaaaagatttcttcttactgttgtaaatctcaaactcctttattccctttataagatcactgatagtatacttataaagctagttttaatattatttatttttcaagagttcaattgcttgataattcaatatcttaataaaaatacaaaatttaaaaggtaccaaatggtagatagtatagaataagtcctcctttctccatttagtcatttttgccccttctgagtctcccttaactggctctcctccctaatatatatttaatttaagcatatatagacaagtactcttgttttaaacacaagcaatccgtttctgtcacttaaagatctgtcttagagactgttttataaccgtatttaaggagatgatttattattttttataagccacatagtattctaccatatagatgtactaaaatttattacagcattcattacctttatgtttcatatatgtattacattatgtttcatatacagcattgactgcattttttttgtcattttaaacaatgctacaatgaatagccttgtgtatatatcagtttgcagtaggagtatgtacgtgaaataacttatggaagtgaaattactgcatcaatgggagtagaaaggtattttaaatatatttgtaacacaagcattaaaacacaagaaattctggtttagaagttcttagacgcagctgcttgttagaagtacctagggggcttgtaaagaataatgatactcaggccacatatctagaccaattaaattagaatcgctgggatttaggcatcagtactctttaaagcttcccaggagattccagtatgcacaccatgatgacaatcactactctagttaaatgctacttactatttactttaatatgtaatttaatatttaatttaattactatttaatatgttataaatttaacctgagacctgggttatttagcttataaagtgtcttaggattgtagcttcatgtatgtatcatggacactaaattaaagacaacctcatgacagtgttagaaattctatcatttttcaaaagtagtgacaatttaccttcattttctacatttcttctcttctcattttcctgttcagcttttctttggtactcattaattctatgctgtagcaacattttctccttctcaatctgagacactgtagattctagatttcttctttgatttccctggaattataatgataaaagttaccactgtgattaatactctggtcattcattcaagtgagtattttgttcttaaaaacaaaaaacaagaaaaaaaaaaagacaaacacttaagatgaatgttctgtttcaaacgcaaatagtatctcctaatacaactttctaagtagcttgccttttaagaagacagtgggaatctgtcttctgtagctgggactacagggacgcaccactgcgtccagctaatttttctatttttggtagagacggcttttgccatgttggccaggctggttttgaactcttgacctcaggtgatccgcctgcctcagcctcccaaagtactgggataacaggcatgagctactgtgcccagcctaaaatacccaaattttcacaacttaaaaatgtacctttctgagttaccactatcagtaaatcttgtttttgatgcttcactttttaagactccacattaggaaacctgttttacagtgtttctgggctttctcatctttaagcagaaattggacataaatcattcaaggtctttctgattctaagagtttatcattctaacttttagttaatttttagataattatacattcaaagaaagttgcaaagatagtacagagaggtcccaagtgcccttccactcagcttcccccagtagagacattatatataacaatagtacaataacaaaatcagaaaattctcactggtataaggagtgtatgattctctcattttatcacatatgtaggttcatgtaagcaccaccacaacgaagatacagaactggtcatcacaacaatttctttccagtcactagttatagccacacccatccccgtcctcccaccacccatactcctggcaactaatggttctccatttctataattttgtctttttgagaatgttatataaatggaaccatgcaatatatgactttttgagacaggcttttttttttttttttttttgtatttttaatagagatggggtttcaccatgttggccaggatggtctcgatttcctgacctcgtgatccgcccgcctcagcctcccaaagtgctgggattacaggcgtgagtcaccgcgcctggccaagacaggttttttttttttttaactcaacataaagaccttaaaatccatctctgtattgtatgtatctacagtttattccttcttgtggctgagtattccatggtacaaatgtaccgaagtttgttcaaccattcacctactgtaggacattttgattgttttcagtttttggctattacaaatagagctgttataaacattagtatacaggtttttgtgagaatatacattttcatttttctggaatacatgcccaagaatacaattgctaggtcacatagtaggcacatgtttagtttttcaggaacacagccaattggttttccagaatgtctgtaccattttatatccccatctgcaatgtccaagtgatctagtttctccatatccttgccagtttgctattgacataattttaaaacttactttttttcatggttatggagtaatatttcatgatagttttaatttgcacttcccaaatgactaattatgtgaacctcttttcataggtttattttcatccatatatctaaaaagtttaaaaagtatggattcgctttccttaacacttatatagggctactgaaattacctatttcacactgtatgagttgtgatagtttgatttttgagaagttagtccctttcatctacatgtcttaattgtgtttagaactgttcataggatttccttatgattcttttgatacctatatggtctatagtatatgccctatttcattcctcatactggtaatttgtgtcctctctttttcctttatcagtcttgctagaggtttgttaattttgttgatcttttcacacagctttttgtttcactgattttctctattgtttttctgcttttaactgccttgttctctgctcttatcgttacttgtccttccttttgcttgttttgggtttatttcactcttcttattctagtttccagaagtaggagtttaaattattgattttagacttttcctcttttctaaggtaagcatttagtgctataaattaaccttcatcaccatgttaacagcatctcacaaattttgatgatgtattttcacttcattgttcaaatattttgtaaagataaagagccataacagttttatgagacataattaacattccaatgtatttttttcactgagacttcttctttgacctctgggttatttagaagtttattgtttgctttccatgtgtttgcagatttttctgttattctcatctgtacattttggtcaggaaactgtatgatttcagtgctttcaaatgtgtttgttttatagcttgggatgtggtctaccttggtgtgtgttccttaagcacttgaaaagaaggcatattgtgctgttaagcagagggttctgtaaatgttgaacaaattctgacagctgacagtgtagttgagttctcctatgtttggtgattcttacgggtgctgaagtctccaacaataattatggattggtctatttaaccttccagtcttatcaacttttgcttcacatactttgtagctctgttgtttggtgtacagttaggatttttatttatttttggtggattgactcttatcattatgtaatattcctctatgttcatggtaattttctttgctctgaagtctactttaattggtattaacattgccaatatgctgctttctttttaatatttgttatgttatctcttcacatcttccgatgttcaacttgcctatattgttatatttgaagagtttctgacagatatataaatgggggatttaaaaaaatctacccctaccacctcttttgattggtattccatttaatttccatttaatgtcattattggtagtatgttagggttaagtctgccgtttttgtttttttgtttgatctctgttatttctacattttctttcctgtctttctgtgggttacctgaacattattttagcattccttttgatttaactatggtgtttttgaatgtatctccttgtaaggccttttcagtggctgccctagatattacattgtatatgcatagcttaatatatagtacactccactggtattggcatcttaccagtttgagtaaagtataaacatcttccctttcttcttttaatttttatcttatttatttttgagaaagggtctcactctgtcacccaggctggagtacagtggtatgcttatggctcactgcagcctcaacttcctggactcaagcgatcctcccacctctgcctccctagtagctgggactacaggcgtgcactaccacacctggctaatttttgtattttttgtagagacagggtttcaccctgttgctcaggctggtcttgaactcctgggctcaagcaatccgctggccttggcctcccaaagtgctgggattacagacatgagccaccacacttgacctaaaaactttacctttctttatgacccattactctctgtttataatgtctaaaatattttttctcatacacagagaatcatattagacaatataatttctgcttcaactgcctactataaaaaataaagaggagaaaaaaatgtatttacccatcttttactgtttctttattcctggtaattcaaaattcctcctttttcttttggagacagagtcttgctgtgtcacccaggctggagtgcagtggtgcgcttggctcactccaacctccacctcccaggttcaagcagttctctagcctcagcctcagcctcctgagtagctaggattacaagtacacgctaccacacttggctaattttttttgtatttttagtaaagatggggttttgccatgttggccaggctggtcttaaacttctggcatcaagtgatctgctcgcctcagcctcccaaagtgttgggattacaggtgtgaaccaccctacctggccaagattccttcttttatcatttcctttctgtttagagaattttcttttgcaattcctttagggaaggtgtgctggtgacacattatcttagtttttcctcatctgagaatgttgtcattttctttttcatttgagaaggatgttttaattgaacacagaattctaggttgataggtttgtttttttgtttttttagcacctgaaaaagtcatgccacttcctcctggcctccatggtttctgataagaaatcagctgtcacttacactgttgtttcctttctaggtaaggtgtgtcctgtatttaagatttcttttttgtcattaattttcagaaatctgactattgtgtcttggtgtggatatctttgggtttacactttttgtggtttgctaagcttcttggtagttcatgtcttttgtcagttcaggtcttttgtcaaatttgttgaattttctgtcgtcatttcttcccacgccctttctcctctcctttagtaattcgagtgacacaaatgttagaattttattgttatagttctacaggtcccagaggctctgtcactttttttctgatcattttctctctgttgttcagactgcataatttctatttttctttgttgaaggtctctgattcgctcctctgcattgttcactctgctgctgacaccatctattgagacttttatttcagttattgtaatttttggttggctctattttatattgtctatgtctttctgagactatttttttgcttgtttgtatgtttacagttgctcactgaaacatatttatggtgattcctttaaatacttgtcagataactctaacatctgtgtcatctcagcattggtattagtttattattgtttctaattccagttaaaattttcctagttctgattatgatgagcagtttgctattcaaacctggacatcatcttacaacattctggatcttatttaaaatctcttttagaaggtctcctctgacactgttctggtgaaactaagggggtgctgcctcttttctgccaggtggagtttgcagaagtccaggttttccactcagcctctactgacacctcaggtagggaggggagcagatcctcatcactgctgggtggaagcaggagttctggcactctaccaggcctccattgagtgcaccatggctgctccttatgtggcccccacagatgacactgcattgtggaggggagcttgttattttcagtggaaagttctgactccctaccatgtctctttgataccaacccagaaggcagtgggaggggcacccccttactgccagctggaagtgtaagtgtagattccccacatggtcactgctacgctgtctggggagagaaagaaggtttgttactgcccacaggagatgaaaattcctttactggaccttctctgacactattctaattggaagttggggtgtgctacagcatagtggagatggaagtctagacttcccactcagcctttgctgttaagaatggggctacagttggctgggcgcggtggctcaggcctgtaatcccagcactttgggaggccaaggcgggtggatcaaggtcaggagattgagacaatcctggctaatacagtgaaaccccatctctactaaaaaaaatatataaaaaattagccaggcatggtggcgggcgcctgtggtcccagctactcgggaggctgaggcaggagaatagcgtgaacccgggaggcggagcttgcagtgagcagagatcgcgccactgcactccagcctgggaaaaagagcaagactctgtctcaaaaaaaaaaaaaaaaaaaaagaatgaggctaccgtttttctgtggtgtttggctgaaaagagcagtgatagtgtaagttttctgacttgctagcctgctccttttttggtctttaggctaaggaaattagctttttttggagctttgtctgcaactgttgatatttcgaggttgctggcttctccggcaccccgtctaggatacatgcagcaaaaagaaaaccctgaagactcattcatgtgttgtttctcaggacgcaagtaacccaggttggtctgccttctttccacctttcaaaatcttttcatgtttgttttatgtttaatgtttagggtttttagctgtacttactgggaggaatacagaaaaggtactcttactccatctttctagaagtgagactattttaatttcatacctcaaatttccctctctacttctaatttggaaaaatgaataacttaaatctagcacatctgaattttatctgtgttttaaaagttaaatataagtggaagatatgcaaaaaaggactccttaaacactcagagtcaaatatatactgctaaggttaagtacaaaggcaagttagtaaatgctctctaaatcttcatagatatccaaagctacccatgaaagcaagcaagccattgacagataccattctataagggaagaaaaaattaacacagcataaaaactatcagagattaaacctaaaaaaggacaaagtaagtaatgtattaggagaagactacagagagtgtatttcttttcatgggactcatagacacagtagaaatatacttagaagttgactaagaggaatggaaatgtattacatatttgcaaacaaacatctgaattatgaatgcttgttattgtttctctgataataaaaaattttgacaggtaaccatggaaaagatgaacattctaaaatcaatatattttccatttgattacatgagattatgtcagtgttaatcttttaaaaatattttaaactgtatttctctcttttccttatttgtctgtctctttctgacatagtttgagattcaatttctgatcgcttgcttctctggctcctttctcacatttcaaccatcgagaaccactgaactgaaatttacgtactaaaattaatacggctgtagaaaacaattgtacaaaggaaactaaattataatctaatctgtaccacttgaaactgcagttccaaggtgaggctttcatcacaattctctgctctgttttgtgtttcaaactacagaattcaaatacaattttctcaggaaacgaaacaatttgaaagagggaaaaatctcaaaaaggaaacttgattagaaaacaaaaagtacctcttcatccaattctttcattatcttgtctagttttatgtttgaggttctgtaaaaacaaaagcaatacagattagaaatatacgtatttcttattgcccagtgttaaacactaacattccttacttttccacttaactagagttttgtatcctttcttggtgccatggatctctttggcagtcaagtgaagcctatggccttttttcaaaatattttttgaagcacaaaaattatatatgattaaaagagacaattaggctgggtacagtggctcacacctgtaatcccagcactttgggaggctgaggcgggtggatcatctgaggtcaggagttcgagaccagcttggccaacatggtgaaaccccgtctctactaaaaattaaaaaaaaaaaaaattagcaaggcatggtggcgggcgcctgtaatcccagctatttgggaggccaaggcaggagaatcacttgaacctgggaggtggaggttgcagtgagccgagatcatgctactgtactccagcctgggtgatacagtgagactccatctcaaaaaaaaaaaagaagccaattatattgaaacacagtaataaactttaaaaaaatatgtgtaattcagtagtatatatgcttccttattaatatattaaatcacaacatctagtggcagtgatttcaaagtattgatgagcataaatgatatttagagatagctgtaacaactgtaataagaaaacatctataatttctattggtaataaaaattaacaactactgctaataactgaattgctgcctatgctcagaattgaaacaagtgctaaaattaagttataagttagagaaaacgttcaccttttgtcatccacgtttaaggacttcaaatttcatccatggactctttgggggaggtctatggatttcaggttaaggatccctaaactccgtcatgcaatacttgccactactcaaaaattagccatttatcctttaatacaggataaagtaaacaaagagaaaggtagtatatatcaaatcagtaaaggcaccatttggcaacactcaaagtgtattatcttcattaccatttgctttctttggttcaaaatgtaattctgagcttcaaaacctatatatgcaacattttcacgtggatgtctcattaaatacctcattcagcatctccaaaatagaacttactgcctctgttccacactcccaccccaataccaatttgcttctcttctagagtccctaagtaaatgacaacacctaggaatcatccttgactcatcctccctcactcccatttagctgaataaagtgccaagtgctgctaattaagcaggaacttcttttgaaaacagcaaatttaatatatattttttacttattagtttaatgacttttgatgtttttccattacacttaaattccaaatttcttagcccccccgcaaaaaaaaagagaaaaaaaaattctccccaatctagaccttgccatcctccccattctcatctcaggcttttccttccctcacatcttactggccagtcaaggtctcttacctcacggccttcacagatactcacctcctggaccctaacacttccttccactcttctcctaataatttccattgactcttctggtttagctttctctgatctctgacaaaacagtacag

SEQ ID NO: 370 - DNA, 4321 bp, Homo sapiens
acattctgaaaactgcagttttctatttaaatagaaaaacatccagactcctaagatggcttcatgctctgcccttgtgctctggtcctagctggttcatctttgcttacagcctcatctttccttactcacactttgtggtccagtctgctgttcatctttaagagccgtcccaaggctgtgatctttaagttcagatgcatgtgcatttgggtgctatacaagttgatccaattggggtatgctagtgctgtgttctctttcctccaggcctttgcccaagttgtctctttcatctgcttgaaaccccttctcacttttgtttggctaaatcctgctagtcttaagctctcacttgaatcctcacttcttccaagaaacctcttctgatccccccaggtctgagattactatacttctcctgaaaacctgtactcaccattttgcatcctgattgcctctttactgacatgttcctgcaaagcttcagtacctagcccgtacctgcctcagaattgtgctccataaatgcctacagaatattaaaagaggaaacatttaatcattttttaatgtttaagttataaacttcattaagccaggttcttagttggttacacaggggtttttatctacacaaaaatctcctgagaagttttgtcttgaggcagaacaaaataattgattctaaaacgtaatttgaattataatagcatcgtaacactgtaacatgaataataaaatctattgggactgtgagcagactcatccaaaaaaatagaaaaaagtgtttgggcacatatttttaaatcctctctgggccatgttttgtacagtagtagcataaaattatgcaacaatttatacttttaacaggtcaatactaataaggagaattatccaaagccaccctctttcattttgctttcagcttagctcatgtccttttctggtattcaatatgtcaccccatgcatccttcagcctgcaacttcttaactaccttacctcaagtttgtgccagataaatagcaatgttaaaagttactatgaatttagtttttttttttaattgctttttgtagtgatgtttttctttccccaaactgcgtggctttctcccattcctacctcagtcttcatagcatgcttttctactccaagtgcgcatgttttgctttctgagaatgtgagattcacccaaataaaaaagaaagggtttggtgttgtttgtcatttggagtttttagtgcctccctgtactacattaggatggacaaaagagattgtaatgccatgaatataaagagttattgttcactacttacgaaaaatactctagctactcattatttcaaagtagtttattttaatcatttaaaaattagttgtgtccacactttgtgctttaatcttttattgtaatttttaatgctaaacatatctagtactccataacacatgctaaatgttgcgttttgatgtatcctcccttctctcctaatctagcttcgtagtcctttgaatacattaattttgtaaattaccgcagtagcagccagatttcataaggatgttttacattgttgtaactggtttcattttcttacttgttcctatgattctcattatataggaactacttactttatgttcttaacacagaagggtcagaggaaacagttattttttgtaacaatttttaaactattaggcattatacattacaaaatcttttgttcttttaaaatagtaaaatgtgcccagagtttagtgctgaagtattctgcagtgatgttgaaaaatgtgaaacaccttttatttggcatgttgtctaaatgctgcctgaccccgcagttcttgcagttggtgcatcatctgaatgctgtctaaccctgcagtttccagaaacatgagatgataatttgcttctttggtgagcctgtggcttaggtccatttcttttcacaaaaaagaatgatcagagaagacttaaatgccctataagtcatttcagaaacattacgtagtgattattttggtattgcctaaagcaggtatcaaggtgattaacattcattatgttatcttaaaaattacacacaatcctttattgcggtcatgaaataagtaatactgtatacaaaaaaaaaaatgaaagaaaataaccagtgacgtttttttccttccatctgctcttccatcatgcaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaagtaagcattttcaccagagctgtgggttagatgtcacatggcagaagcagccagattagatccacttgtcgtgggcattaagggggcatctttcctttatggagctgaaggtgagcatatattggccatcattctgaaagcatatggtttggggaggctgatgataagagagtgctcttaaggaattaattacagttttgtctttgactttaaccatgttgaaaattaatctagtaaccttataggaaggctgatctttagagtaataatagttactactaccaaatactaaataaatactaaggctttttctttattattatggacttgatttttttttcagtggtcccaatgtaagtctcctcttgttctgtctataataggtaaaaatagtataaatggtactcattcatttattcagcaaatacagaatgctgtatatgctaggcagtgtgctaaatttgggggctatagagcaaatgtgatacagtccctgcttcaaaaaaagtcgaagatgggagagacatgtgttctaaaaatgacagtccaatatgattagaaaaaaacacaaagctgtgtacatatagtgtgctttgaggacacttgaaggagggttaggctctaggatgtcaggaatggcttcacagaggaggtgcagttctccagacagataaacctggtgagcatttcagagcaagggatgagtaagtgcacggcccccgaggctaaggccaggcttcttgtaatcaagtgcttctagagctggtggagagtcgggagaggcagctgatcgggcagataagagcagatcatgttgagtcttgtgcagtttgcgcagaagtttggatgtaactctgtaagcattagagaaatgtcatctggcagcattcatagaagctatcacaagaggaccagacagaagtctggtttgaaaccaaggcaacaactgtgacagcagagcattgattcacagccctgattgtatattagaatcacccgagaacttccatgacacaccagtgccccaggcccaccccagaacaattgtcttccaaatttttgagcctcaccaggtgactaatccacagtagagaatctttgcagtaaatgaagcagaaaaccagtgaggctgtggcagtagttttcatccttgtcattacagcaaaatggcaggatgaagtggtttcaaaggctgtttggagtcatctccatttaaggtaagtttctggtcatgttccctttcttgagagcagcagttacattattcattttgtagctttgaggggaccatggtttagcaggtagtttcctctgctgttgcagttataagctacagtattgtaggttagtcaaagcttcttcatgagtcgttgttctttgaaactgcttggctctcatagttaatttatttactgtttttatgcaggccattctctatcaggtataactgttagaaaaaaatcctatttttctcttctataaaaagcattatttttgaggttacaaaaattgtataactaaagtactgccctacagtggtgttgaaggctaactgaacattaatagaatacttttatttcatgctatatatccttagattatttttaagttattttcattgcaattgtatgttattgtataagatcaggaaattactagttttagaaggactcgtaattccataaattaggatattcaatttttttctaatatatgtttggacttagatacatagaaactgagactatactaatttttaaaattgcagtaattaaaacatgtacaaaattgaattagagtgggaataactgagtaacttttaaatgtgttgtttttatgaaatgggtaaaggagttataatttaagtcacaattat

SEQ ID NO: 371 - DNA, 68853 bp, Homo sapiens
ccatgcctgattttactctgttgttaattaagtttgtaattctgagtctacagtgtcaccattcttggcttagtttgcatcttgtaaaagaagaacgctgaggcatagggtgtccttggcaaagatgcggatgtccactgaggtctgcgtgccccttcccctctgtggactagctgctgcccagccagagactacacttcccagacccccctgtgatttgttctcagcaatggaatgatgagcaggagtaattggagcacttccagaccaaaagggacaaaaaacagatgcatcttttccaaactctcttctatatcctggcaggatgttggaatccacagcaaccttggaaaccacatgcccagagcccccatccttcagcctgtgtccccaaacacccatacagagtgagcgcagaccaggacttgatatgaatgagaaatagcccctcattatgttcaactagtgacattctaaggtctctccatcaaagcagcctttaagcttcaagtttatgactaacaatttacaaatactttcttgttaatatttttaacttaacttgacctagagaatgacaaccatgggaaataagtcagatatttttctcattttacaaataaaaacctgaagctaaaatgctgaaattgttccccaaagtcattgacaagcagcagagccaggaggcaggagcagggtcttggattaggtttgagtgcaagaaatagggtggtgccggcattcataccacagggctctgggtgtcatcgtgggcctacctgggactgcctccgtgattttaaggaattgtttaatttccctcaggaccgtttcttggataataaacagggaacaataggccatgtcaatcatgtaaagttgttgtaaagataagggaaggccgggcatgatggtgcatgcctataatcccaacactttgggagaccaaggcgagaggatcactagagcccaggagtagaaggttgcagtgagctatgactgtaccactgcactccagcctgggtgacagagcgaggctcacacttactgaacatctaccacagaccaagcactgttccaccatcttgaatctattgactcattgactcatccaaccaccctacaagttatatcaagttatatcctccctattttcaagatgatgaaattaggaaaagttaagtaatttctccaacaatgcatatccttagcctggattctccagagagccaagagggaggaagggagggtgggatccgccccaagctggttatcactaaatgcatcttcttgacctggtcagactgtccgcctagaagcttcttaaggtgtgactaatgactgtgagtctggggcaggaggatgcctgggtatgagcgctgagtagggtccccaggaagccccagggcagaagataagaggagcccaagtgagcctgaggcggggcacggccaggctgactgctggagtcagtgggagtctgtgcagagctggtcgccacctctgaggctggcacaagagacaggcgaactcgaaaaagcatgcagtcgggcaaagtcgggtatgttacaagcctacgatgtcatggggctagtctttctctccttgtgtgaaagacgtggttcccattcctgaccaaccacagggaggcatgcattgtgagctagttagctcctggtgggaacaggcttacacaaatccacacatatgttctgttccagtctacggccaatgcctgtcttggaggaagaaacgacccaagtacagggaagctgcagctttctgctcaggactgccagcatgtggagcttccaggtctagggtggatgagacacatccccagggaactccctctggctagatgattgaagatgttaacgatgcatatagttgcacccagccatgctcaccaggggagaaaaatgctgctgcccccaccaagcaagggtctttcaaggagctcctagtcaggcttgtgttttcaaatctgacacacacaaacacacacacacacacacacacacacacacacaaaggccaggcacaatggcttctgcctgtaatcccagcactttggggaggctgaggtaggtggatcacttgaggtcaggagttcaagaccaacctggccaacatggtgaaaccgcatctctactgaaaatacaaaaattagccaggcatggtggcaggcgcccataatcccagctacttaggaggctgaggcaggagaattacttgaacctgggaggcagaggttgaactgagccaagattgccctactgcactccagcctgggggacagggcaagactccttctcaaaaaaaaaaaaagaaaagaaaaagtttagttctttgattatacaagtaaatacttctccattaaaagtaatttatactgttgtagaaaaattggaggtataaatacacttagaagtttgaagagctcatcttccctggtctatgtcctctgctcctggagacccagcctctgtggccctgtgacctgcaggtattgggagatccccagctagacgtcatgtcccctgagatgcctagaaatggtctcttcccagggtgagagaggaatgaaaacttaaaggaaagaaactctgggcttccaagatggccaaataggaacagctccagtctgcagctcccagcgtgatcgatgcagaagatgggtgatttctgcatttccaactgacgtacctggttcatctcactgggactgtttggacagtgggtgcagcccacggagggcaagctgaagcagggcggggaatcacctcacctgggaagcacaaggggtcaggggatttccctttcatagccgatggaagccatgacagactacctggaaaaacggggcactcctgcccaaatactgtgcttttcccaaggtcttagcaatgggcagacaaggcaattctctcccgtgcctggctcggcaggtcccatgctcatggagccttgctcactgctagcgtagcagtctgagatccatctcctatgcctggctgggggaggggcatctgtcattgctgaggcttgagtaggtaaacaaagtggctctgaagctcaaactaggcagagcccactgcagctcaacaaggcccactgcctctagacttcacctctgtgggcagggcatagctgaacaaaaggcagcagacaacttcttcagacttaaacgtccctgtctgacagctctgaagagagcagtggttcccccagcacagcgcttgagctctgagaacagacagactgcctcctcaagtgggtccctgacctccgtgtagcctaactgggagacacctcccagtaggggccaacagacacctcatatagggggctgccccttagggacgaagcttccagaggaaggatcaggcagcaatatttactgttctgcaatatttgctgttctgcagcctccacttgtgatacccaggaaaacagtgtctggagtggacctccagcaaattccaacagatctgcagctgagggacctgatagttagaaggaaaactaacaaacagaaaggaatagcatcaacatcaacaaaaaggtcatctacacaaaaaccccatctgtaggtcaccaatctcaaagaccaaaggtagataaaaccacaaagatggggagaaaccagagcagaaaagctgaaaattctaaaaatcagagtgcctcttctccaaaggattgcagctccttgccagcaacggaacaaagctggacagagaatgactttgacgagttgacagaagtaggcttcagaaggtcggtaataacaaacttctccgagctaaaggaggatgttcgaacccattgcaaggaagctaaaaaccttgaaaaaagattagatgaatggctaactagaataaacagtgtagagaagtccttaaatgacctgatggagctgaaaaccatcacaagcttcaatagccaattcaatcaagtggaagaaacggtaccagtgattgaagatcaaattaatgaaataaagtgagaagacaaggttagagataaaagagtaaaaagaaatgaacaaagcctccaagaaatacgggactatgtgaaaagaccaaatctgtttgattggtgtacctgaaagtgatggggagaatggaaccaagttggaaaacactcttcaggatattatccaggagaacttctccaacctagaaaggcaggctaatattcaaattcaagaaatacagagaacatcacaaagatactcctcgagaagagcaaccctaagacacataattgtcagattcaccaaggttgaaatgaaggaaaaagtcttaaaggcagccggagagaaaggtcgagttacccacaaagggaagcccatcagactaacagcagatctctcggcagaaacctgacaagtcagaagagagtgggggccaatattcaatattcttaaagaaaagaattttcaacccagaatttcatatccagccaaactaagcttcataagtgaaggagaaataaaatcatttacagacaaaaaaatgctgagagattttgtaaccaccaggcctgccttacaagagctcctgaaggaagcactaaacatgaaaggaaacaaccagtaccagccactgcaaaaacataacaaattgtaaagaccatcgatgctaggaagaaactgcatcaattaacgggcaaaataaccagtgaacatcataatgacaggatcaaattcacacataacaatattaaccttaaatgtaaatgggctaaatgccccaattaaaagacacagattggcaaattggataaagagtcaagacccatcagtgcactgtattcaggagacccatctcaggagcaaagatgcacataggctcaaaataaagggatggaggaagatctaccaagcaaatggaaaacaaaaaaaaaagcaggggttgcaatcctagtctctgataaaacagactttaaaccaacaaagatcaacagagacaaagaaggccattacataatgttaaagggatcaattcaacaagaagagctaactatcataaatatatatgcacccaatacaggagtatccagattcataaagcaagtccttaaagacctacaaagagacttaggctcccacacaataataatgggagactttaacaccccactgtcagtattagacagatcaatgagacagaaggctaaaaaggatatccaggacttgaactcagctctgcaacaagcagacctaatagacatctacagaactctccaccccaaatcaacagaatatacattcttctcagcaccacattgcacttattctaaaattgacaacataattggaagtaaagcactcctcagcaaatgtaaaagaacagaaatcacaacaaactgtctctcagatcacagtgcaatcaaactagaactcaggattaagaaactcgctcaaaaccacacaactacatggaaactgaacaacttgctcctgagtgactactggttaaataatgaaatgaaggcagaaacaaagatgttctttgagaccaatgagaacaaagacacaatgtaccagaatctctggggcacatttaaagcagtgtgtagagggaaatttatagcactaagtcccacaagagaaagcaggatagatctaaaattgacaccctaacatcacagttaaaagaactagagaagcaagagcaaacacattcaaaagctagcagaaggcaagaaataactaagatcagagcagaactgaaagagatagagacacacaaaaaaaaacccttcaaaaaaccaatgaatccaggagatggttttttgaaaagatcaacaaaattgatagaccactagcaaaactaataaagaagaaaagagagaagaatcaaatacactcaataaaaaatgatcccacagaaatacaaactaccatcagagaatactataaacacctctatgtaaataaactagaaaatctagaagaaatggataaattcctggacacatacaccctcccaagactaaaccaggaagaagctgaatctctgaatagaccaatagcaggttctgaaattgaggcaataattaatagtctaccaaccaaaaacagtccaggaccaggtggattcacagcagaattctaccagaggtacagaggggagctggcaccattccttctgaaactattccaatcagtagaaaaagagggaatcctccctaactcattttatgaggccaacatcatcctgataccaaagcctggcagagacacaacaaaaaaagagaattttagaccaatattcctgatgaacattgctgagaaaatcctcagtaaaatactggcaaactgaattcagcagcacataaaagagcttatccaccacgatcaagtcagcttcatccctgggatgcaaggctggttcaacatatgcaaatcaataaacataatccatcacataaacagaaccaatgacaaaaaccacatgattatctcaatagatacagaaaaggcctttgacaaaattcaacagccctacatgctaaaaactctcaataaactaggtattgatggaacgtatctcaaaataataagagctatttatgacaaacccacagcgaatattataatgaaagggcaaaaactggaagccttccatttgaaaacaggcacaagacaaggatgccctctctcaccactcctattcaacatagtgttggaagttctggccagggcaatcaggcaagagaaagaaataaagggtattcaattaggaaatgaggaagtcaaattgtctctgtttgcagatgacaggattgtatatttacaaaactccatcatctcagcccaaaatctccttaagctgataagcaacttcagcaaagtctcaggatacaaaatcaatgtgcaaaaatcacaagcattcctatacaccaataacagacaaacagagagccaaatcatgagtgaactcacattcacaatagctgcaaagagaataaaatacctaggaatccaacttacaagggatgtgaaggacctcttcaaggagagctacaaaccactgctcaatgaaataaaacaggacacaaacaaagggaagaacattccatgctcatggataggaagaatcaatatgaaaatggccatactgcccaaaataatttatagattcaatgccatccccatcaagctaccaatgactttcttcacagaactggaaaaaactactttaaagttcatatggaaccaaaaaagagcccgtattgccaagacaattctaagaaaaaagaaaaaagctggaggcatcatgctacctgacttcaaactatactacaaggctacagtaaccaaaacagcatggtactggtaccaaaacagatatatagaccaatggaacagaacagagccctcagaaataacaccacacatttacaaccatccgatctttgacaaacctgacaaaaacaagaaatggggaaaggattccctatttaatcaatggtgctgggaaaactggctagccatatgtagaaagctgaaactggatcccttccttacaccttattcaaaaattaattcaagatagattaaagacttaaatgttagacctaaaaccataaaaaccctagaagaaaacctaggcaataccattctggacataggcatgggcaaggacttcatgtctaaaacaccaaaagcaatggctacaaagccaaaattgacaaatgggatctaattaaactaaagagcttctgcacagcaaaagaaactaccatcagagtgaacaggcaacccacagaatgggaaaaaaattttgcaatctacccatctgacaaagggctaatatccagaatctacaaagaactcaaacaaatttacaagaaaaaaacaaacaaccccatcaaaaagtgggcaaagcatatgaacagacacttctcaaaagaagacatctatgcagccaacagacaaatgacaaaatgctcatcattaatggtcatcagagaaatgcaaatcaaaaccacaatgagataccatctcacaccagttggaatggcaatcactaaaaagtcaggaaacaacagatgctggagaggatgtggagaaatgggaacacttttacactgttggtgggagtgtaaactagttcaatcattgtggaagacagtgtagcaattcctcaaggatctagaactagaattactatttgcccctccaatcccattaccgcatatatacccaaaggattataaatcatgctactataaagacagatgcacacatatgtctattgcggcactattcataatagcaaagacttggaaccaacccaaatgtccatcagtgatagaatggattaagaaaatgtggcacatatacaccacagaatactatgcagccataaaaaaggatgagttcctgtcctttgcagggacatggatgaagctggaaaccatcattctcagcaaactatcacaaggacagaaaaccaaacaccgcatgttctcactcataggtgggaattgaacaatgagatcacttggacacagggcagagaacatcacacaccagggcctgtcggggggtggggggctgggggagggataacattaggagaaatacctaatggaaatgatgagttgatgggtgcagcaaaccaacatggcacatgtatatctatgtatcaaacctgcacgttgtgcacatgtaccctagaacttgaagtataaaaaaagaaattagaaaaaaaagataatatgacaggctaggaagaaaggcaggtggaaaattattgtctaatgagcacaaagcttttgtttagaatcatgaaaagtttctggaaacagataatggcatggttatacaacactgtgaatgtatttactgccaccgaattgtacaattaaaatggttaaaatagtttttaaaaaaaagtttgaagaagagaactattatcacctaaaatctctcttctccccaagataaccacactaacattttggtgtattcctttccaggcctttctttgtagacatataaatataaactgcatttttaaataaaatggagttgatgatacaagtgttttattactctgctttgttctcttaacattttatgataaatattttattgccattaagaatgcttccaaaacacattatttatagctgaacaatattttttggatattcgggctgtttataatttttcactctgatatatggtgctgggatgaagagccttaaacagaagtctttgatcacatttctgattacttcctttagaagacacttaaaagtagaattactgggacaaatgatataaatattttaatgaaaatttttattgccaaatagtttccagaaattgaccaatttacagttctatctgcatctgtcagtgcagacacattgcaaaaacaagtcagtattttaaatgcttttcagagtagcaggaggaaatggtatttcattttttttgactcctatttctttgattaatggttctattgaccaattcttaatttgttgaccgtttggatttcttcttttaagaactgcttgttcattttctttgataatttttaagttggtatgttagtattttttattgactggatataattaggagctgcttatttgtcatgctcattgcaaatatttttgcctgttttcattttactttttacaattttttacaattttttatttttaaaggccagtcaaatttagcagtgggtgtcattttgcttttaacttgtattatacagggattttgtaaatatagctggtttggggacttttctttgttttacatggttaaatctaacaagagttacctttgtgattcctcccatgatctcatgcttataaagttctctccatcccaagatcagttacacatgctcttattttcttctagataattaagaaaagatatgaaatcacaacacattagtattggaagagttggcgaagtccttcatttcacagatgaagaaacttaggcttaaggggtaaagtaactcaaaaaccagatcacgcagccattaagtggaaaagccaagattttcctttcgattgaggtataattagcacacaataagatgcacaccgtctcaagtcatcagttcgatgggttttgataattgctgacgctcttgtaatcaccacccaaatcaagatacagaatatttccaccaccatcagcaaccactatctgagatctttcactatagggtattttgtctagatttggattttataaaaacggaatcataaagtactttttagtgaatgtcttcattcacttagcataatatgtttgagattcaaccatgctgttgtgtctatcagcagctaattcgttttttattcctgcgtaggatttgtatgaatctactatactatgaatgtactatatatacaaatataatataatatgtttatccatccccctgtttaggaacacttggttgtttccaatttggggctattatgaaaaaggcttatatgaataagtattttttggacatgttatttcatttcactcgggagtgaaattgctggggcactgaatggatgcatgtttaactttataacaaagtagggctaaggtttactatctgaccctagagaccatgccctaagccactggacacactgtccctcacagacccaagcactgagagatcaagtttaaatcccagctattctctgtccttgctgtgaacactttggcaagttccttaacctctcagtgcctggtttcctcatcggcaccaccgtcccactccacctcccaggggttgttgtgaaaactaaaagagttaatacaaataaagccctcagaatgagatcttgcaagtggttggtttattattatgaagaatgtctctacatttagtttgtcagatactggactgagagaatggttctcttgaaagtaaccaggaaaggcctccctgtgatggaggggccaccctttaagactgcttgcagcagaatgctatcccttcccacaaagtcagctgggcctgccataactgtcccagtgctccagtgtgctgcctcaagtgcccctgctgcctctgcagtgctcattctccaggtcttgttcttgtccttgtggggttcagcatacacagctctcttgatcagaaggtggccccagccagtccctgaggactcactgcttttaaatactccttaacacctgagcaggatcccacacgctgctctacctctcctccttaggggctaaccaaattgcacaagactccattggctgtggttaatccctgatgtcccagcttgcagtccgtctgcaggcaggtcttcggagggaacgcatttgcaccctggtgtagtactgctaggactggatggcagagcacctttccaaacctgagtgcagttgtccctcagaatccatgggggattggttcaagaaccccaagattacccaaatccatggatgctcaagcctcaagttttggatatcaaatggcctgcaacctaggcacatcctcctgtaaactgtaaaaatacctaatacaaagcctacacatcatttagtgtgcatgaaatccacatacttctcagcatgcaacaaaaattcaagttttgccttttgcaactgtgaaatgttctttcccaaatatttcagtcctcggttggtggaatccatggatgcaaaagccatgaatatggagggttgacagtacttcctaattccttctagaatatcacctacttctgcccttcctccatgccaatctttcccactggatgagaagctccataagggcagagtctaagaaaacttcatgcatggggcccaggcacatcattagtcaggccttcagtaagcattgtcgatggataaggcaaaaatacatttatgtataagcattcaatgcctatcttctcctctcaccctcagaggagatttctgccttctctcatagttcagtttctgggcttttattgaaaagatcagaaaagggttgaaaagaagaacagagctcagagatgctttttagatttctttggaaaatagaagcaaactattaatccaccaacaggagtacttatcatttataattatggctatgcatataatagagtatatagtgaaaatgcaaaatctaacacacacttatccatggactctatccgtgcacttatcaacatgcataaatcatgcaaagttcagttcttaaaatctggagagtgattcatgcatacatatatgtgataccatttaaataaaatttgaaaaatgcaaaatgttgctattattactatgatacctagttatgaatacatactatgtagaaatagtacaaaaacgtatataaaatagcgtgagagtgataaacaccaaattcaggaggaaggttatctaagttgggaccaaattatgtagataaattatttgtgaagaataactgaaagttttggagccacaactgacttgatcagagttgcagtttaggaaggtaaatcttacaagagaaatggaggaaaagttgattcattcaatatttatcaagagtccattatcagccagttgcagtgactcacacctgtaatcccaatgctttgggaggctaaggcaggaggatcaattgagccaggagattgagaccagcctggacaaatggtgagactccatctctataaaaacattaaaaaattagccaggcatgctagcatgtacctgtggtcctagccactcaggaagctgaaagaggattgcttgagccgaagagttcaaggctgcagtgaacgatgatcacgccactgcatactgcactccagcctgggcgacagagtgagacaccatctcaaaaaaaaaagaaagaaacagaaaaatccatgatgtgtcaaacacttgttacaggcacttgtgaatggatagaaacccctgccctcggttgcattctttctgctttctagccctaaggcaataaagcctgtttcacagctgcatctagtgagggcctagaacctcaggattggaaatgaggaggatagactacccaggtagaaggcacagcctgctcaaatatgcaaggcactgcatcaggtatgaaaatgaggtttggcatctcggtggcctgaaaaaatgggtgtccctgggtgaaaccaggaacatggaagtgagacagaatgagcacttgttatgtgcccagccctgcagcagggcccaagcactgcggaggtggatgtcatgttccctgccccgaagcagctcaaattatttctgacaaccattcattcagcagttcattcagcaaatactttctgaataagtgtgcggaaatctgtactgggtaactgtcatcctagcaacctagcaagaatgtgatctatggccccacagcagaatgtggctgtggtttgggggggtctggtgcaaaggtgagaggtaccctgactccaggcaggaaggagagtgagagagttacgatgtgcacttgtctctcacccagttcaagaacctgctcctctcctccttaaacactgttcattcccaggtcctggtccctcactggctcagcctccagacccgcagaccacagccataactctccaaactcaaaacatccactcaggggagataaatctccgcttatggaaggactttctctgggaaggagggtcagaaaggccgcctgaggcagctgaccgctcctgtgggctgaatgtcagtctggcgaagcagaaaacatctgtcagtgagtcagagacctgggtttcagtctcagctctgcactaaaagctgggggaccttgtgcaaccgcttcccctctctgggcctccgcttcttcattggtatgaaggcacacttagatctcttggggccactcctgctataacgattgtgtttcgtttttgagggctgctgtaacaaagtaccatgagccgggttgcttagagcaagaaatacgttttgtgtaatcgctctggaagtgaatagcctaagagaaagatgacagcaaagctaattccttctcaggattgtgcgggagaatctgtttcttgtttctgtcctggcttctcctggtttgctggcatactttggtgtttcctggcttagggacacatcacccggatttctgtcttgatgtccacatcatgttctccctgtatgtatgtgtgttgtatgtgcgtggaaggcgggggtggtgtctctaacttttttgggtttttttgagacagtcttgctctgtcacccaggctggagtgcatgcagtagcttgatctcggctcactgcaacctccacctcccaggtccaagcgattctcccatctcagcctcctgagtagctgggaccacaggtgtgcaccaccatgcccagctaatttttgtggtttttttactagagatggggtttcaacatgttgcccaggccagtccccaactactggccttaagtgattcacttgccttaacctccgaaattgctgggattacaggagtgagccaccacacccagcccggcgttcttcttataggatatcagccatattggatcggggcccaccctacctactccagtatgacctaatcctaactcattatacctacacctatttccaaataaggtcatattctgaggtactgtgggttaggagatcaacacacatattttgtaggggggcacaatttaacccataatgaccatcctgaccttttaattcctcctcccaggaatctgtagggtgactgtaacatttatcattcaaacaggggattttgagaatgaaaaggggaactactaacaattgtggcaaatgacaggtgtcactggggactggcccaggtgagcaggtatgctggtcccctcaggggcctgggggatctaccggggccaaacacgagggtggttgcagggcccagggctgcttccaccacccacggggtcatggtgtgacccagaggaaaactacatcatctctcaaaatgagaacggacggagtgaggggagagacagtgcctggggaagcgccaagggacacgaagaggctggtgctggcatgtggcacctggagtttagttggagaaaagtcaccattttcaagcagtagtgcttcctgatgtgtgagtatggccgcaagcccgggtgggacatgcacagtgtatgtgggactataggatgcatggagaagccctgcatctatctacacagagcgtttaatccatcctgggggacactgattcacgtgaatgattagagggcatccttatgctcagtggagaggaactgggctccttagtgcaatcaaagttcggaaaagaaggtattcagctgggcgcggtggctcatgcctgtaatctcagcacttggggaggccaaggtgggtggatcacgcggtcaggagttcaagaccagcctggccaacatggtgaaaccccatctctactaaaaatataaaaattagctgggtgtggttgcatgcccctgtaatctcatctactcaggaggctaaggcaggagaattacttgaacctgggaggcagaggtggcagtgagccgagatcacaccactgcactctagcctgggcagcagagcgagactctgtcctcacaaaaacaaagaaaaaaaaaagaaaaagaagcatttgagtgctgtaaagtaattgggagatttgtgctcacaaaggtcacttgagagcagaggaacgaaagtccagtcgtgtaagggacagtgaccagagtagcctgagtaaatacggccttgaaagatgaactgagaaactctcctcccatctctatttcctatattctcatgggatcagcataatttcttccttaaacatctggtaatactctttagtgaagccacctgggcctgcagtactctttgtgggaaggttttagattattaattcaatctctttcattgatgcgagtcaattccatattttcacttcttcctgagtcagttttgataaatgggtcattttagtggacttgttcttttcatctagggtatcaaatttattggcatataattttttcaaaatagtattttattaatgcctttaggatccttatgatgtcctagatacagtaaagatatggcacagccatgtaccacataaagtttcagtcaacaatggactgcatatgcaatgataatcccataagagtaaaatggagctgaagaattctgatcacctagtgaagttgtagccatcataacattgtaatgcaattactttattttttaataaatttagtgtagcctaggtttacagtatttataaaatctatggaagtgtacagtaatgtcctcagccttctgaatagtccattctcacactgctgtaaagaaatacctgagacttcataatttataaataaaagaggttgaattggctcacagttccacagcctgcagaggaagcatagcagcttttgcttctggggagacctcaggaaacttacaatcatggcagaaggggaaacacccacctcacatggcagaggcaggaggaaaacagaggtgggggcaggtgccacacacttttaaacaaccagacctcttaagaatactatgatgagaacagcaccggcggatggtgctaaaccattagaaacctcccccatgttccaatcacctcccaccaggccccacttccagtactgggaattggacataagatttgtgtggagacacaaatccaaaccatgtcaccttcacattcactcaccacttactcgctgattcaccagagcaactttccgtctcacaaactccgttcacagtaagtgtcctgtacaggtctaccacttttgatcttttgcactgtagttttactttatcctttctatgtatagacatacaaaaactactgtgttataataggatctaccatatagcctaagtgtgtagtaggctgtaccatctaggtttgcgtacgtgcactccatgatgtttgcacactgataaaatcacctaatgacacatttctcagaatgtaacctgttgttcagtgaagcatgaccactgtcatacatgtgatctgtcactgactgaaatgttatttggtctgtgatgatattgtaaatctcacaaagtattattataaaagagtcaacaatcttttaaagaaattcaaaaatgaaggaaagtatctcttatatttaatcaaatattttctgtttctggcacttttcattcctttgtgtatctaatgtctctctatctggtatcaccttaattctgtgttaagaacatcttttagcatttctagtaaggtaggcctcttggataaaaattctctcagcttttgtttgtctaaaaagtcttcacatcacttttcttagttttggaagacacttttgcttggaatagaatttttggtcaacaagcttcttttcttccctccctgctcttcaaagacatcacttcattgtgtctgacttgcatagtttccaacaagaaaacagcctcaaattttatatttgctccccaatacataatgtgtctctttttttttgctggctgggttgcttttttaaattttcattagttcacgtttgcagcaatttggttatgatgtgccctcgggtgcttttctttgtattttcctacttgaaattctcagagctttttgaattggtgtctttccagtttttataaatttgagcagtctttagccatcatttcttcaaatatttattctgcccccttttctgggactcgaattacttgtatattgaccaactgatattgtccaatgtgtcacaaaactctgttcattttttcctagcaattcaccattttttttttttttgagacgaagtcttgctctgttgcccaggctggagtgcagtagtgcagtctcagctcactgcaacctccacctcccaggttcaagcgattctcctgcttcagcctccctagtagctagtattacaggcacctgccaccatgcctagctaatttttgtatatttagtagagaaggggtttcaccatgctggccaggctggtctcgaactcctgacctcaggtgatctgcccacctcagcctccaaaagtgctgggattacaaacatgagccaccacacctggtaaattttttatcttaattgagcatttctatgattctatcttctttcctttcttggcgtatcagttatacttctcctaccttttttcagtcattgacctagaatttgcaatatacatttagaactaacccaagcccactttcaaataacaatatacagcctcatgggtagtgtgagtacattataataacaaaataaccgaaaatcctctttttattccttgtgtcattgctgtcattcatttcatttatatgtaagcatatgtaagtgtgaatatataagtatatttgtcacaagcatatatttatatatgtattcagttataaatcttatgtatatatcttatgtacataattgaaggtgcagttgctattattattttgaacaaactgttatgtgttagatcaactaagaataagaaaaataggccaggtatggtggctcacatctgtaatcctaatactttgggaggctgaggcaggagaattgcttgagcccaggagtttgagaccagcctggtcaacataatgagaacccacctctatatttagaataataataatctaaaaaagaaaaaaattaatgataagaagaataaacatttttatattgatgttcttcctttctttatgcagatctaaatttctgacctgtactattttccctctctctaaagaacttcttttaacatttcttacaaggcagatctactggcaaagaaattccctcagtttttgtttgattgagaatgtctttttttttttcttcacttttgaaggataatttcacagggtacagcattctaggctggcggggggttttctcccaaacctttaactatttcactacattcccatcttgcttgcatggtttctgaggagaagttggatgcaattcttagctttgcatctctctagcttagctggtttttccttctgtcttctttcaggatatttttctttatctttggttttccgtaatttgaaaatgacatgtctaggtgtagttgttttggcatttatcctgcttgatattctctgagcttcctggatctgtggtttggtgtttgacattaattttggaaaattattggtcattattatttcaaacatttcttctgtttcctttctctttttattctccttctggtattccgttacatgtatgttacaccttttgtaagtgtctcacagttctgtttcttttttcagtctctgttctctttgcttttcagttttagaggtttctattgatctacccacaagctcagagattctttcctcagccatgtccagtccactaagaattctatcaaaggacttgtccattcttcctttctctcacagtattattgatctctagcatttccttttggttttccccttaggatttccatctctctgcttatattacctatctgttctggcatgctgtctactctatccattatggcccttagcatattaataggagttgttttaaatctcctgtcctaattctaatatccctgccatgtctggttctaatgcttgctctgtctcttcaaactgtgtcttttgttctttagtatgccttgtaattttttcttcacagctagacatgatgtagtgggttaaaggaaatgcagtaaatagacccttagtaatgtggtggtaaagtgtatggggggaataagcattccatatttctatgatgaggtttctgtctcttagtgactctgtgcctctggactgtgaacttctcaatttttctccaccttaggttgggcaggatggctagagtagctgaacttgggttatttcccctctcctacatagaaggatagagctggctggatttgggcatttcctccttccctcccaggtcattaggctctgataaaattccagcaggttagactctagttaactaatttctcccgacagcagaccttgttaagacagagtgttctggcatatttcaaaatggctcctttctctctcccatcctgctgaaagcatgaggagatttttctccagtatttactgtgagaacctggttgatatcctgaagacaaaactcacataagtgttgggggcctcctaagactgggtctccctagagcttttaagtctcagatttgtccacgcctagactccatcagcttgtcagttacagttccggttctcccaggcagcagtggttcctgcagaggttgctgctctaatgtactatgattctctgtatttgcttgtctgtctgtttaatttagggggcagtagtttgccctatgacatcatttctcttatgcatctaagaagagtggttgatttttcagtttgttcagctcttattgttaggacacagtggcaacttctaagttccttatatggaggacagaaagccaggagttgcatttttcatttcagatattatatttttccactctagaatttctgtttggtttttttatatcttccatttctctctccattatcttcatattttccactagatttttgagcatatttataatggatgttttttaaataaatttttattttagaataattttagatttgtaggaaagttgcaaaggcagtataaagttactgtacacccttccttagattcccttaatgttaatatcttgcataactctggtacatctgttaaaagtatgtgttgtggctgagcacagtggctcacgcctgtaatcccagcactttgggaggccgaggcgggcagatcacttgaggtcaggagttcgagatcagcctggccaacattgtgaaaccccatctctattaaaaatacaaaaattagctggacgtggtggcacacatctgtagtcccagctacttgggaggctgaggcgggagaatcgcttgaacccaggaggtagaggttgcagtgactcaccactgcactctagcctgggcgatagagtgagaccctgtctagaaaaaaaaagaaaaagaaaaaaaagtatgtgttgtgagttaaactgaactccccaaaaaaggtattgaagtcctaacccctggtacctgtgaatgtgaccttacttgcaaatagggtttttgcagatgtagttaggttaagatgaggtcatactagagtacagtggaccctaactccagtatgacaggaatccttataagaagagacacacaaggagaaggccgtgttatgaaggaggtggagactggagtgatgcatctacaagccaaggaatcccagggtttgccagtgaccaccagaaggcagagagaggcgggaatggtttctccctaaagcccttcagaaaaagcacctccctgccaacatcttcctatcagactcaaggctccagaactgtgagaaatgaaattctattattttaaggcaccctgtttgtgatactttgttacacggtcctagaaaactaatacaaggaaaatactaacattggtacattactatacaccaaactccaaactttgttcagctttcaccacttttccccctaatgtcctttttctgttctggaatccaatccaggagacagtgttgcatttagacactgcatttctcctgtctcctctggactgggacactttccaaactttgttttccatgatcttaaaagtactggtcagcattttgtacgtgtttcccagttagagtttctttgatatttttcctcatattaggctagagatatatggggttgttctttttttttttttttttaaataccagacaggtgaagtgccctctcataacatcatataggggataaatgatattagccagatatatcagcagggatataaaccttgatcaattggtgaagatcgtatctgtcagatctctggctgtgaagttaccatttttccccttccatcctctattctttgcaagtgagtcactaagtccagtcacactcaagcagatggaaatagggaaaattaaattacttttctgctaattccacatgtctgtcatttctgggcttatttcttttgagtaattttttctctcctggctatgggttacattttcctgcttctttgcaaatctagtaattttgtgaatgttacattcttgagtgttagattttgttgcatttctttcaagagtgttgcactttattctggctttcaggtgagttattcagacatcagttgaatagtttgggctttaaaaaaaaagaaaacctttttatcaggcaggagatctagagaagtgttattctagattagttaagtaccactgccaagatgtgtactttctgcggctgttcaagtattaaactaggtttctccaagctacctagtggaattgaatgtgtcccagtcctgtgtaagctctggagatctcttggccagcagcctctcggcaattgttctttccccagtggttgttctttgcccaatcccaaggatgccatcctgctcagccccagactcaagagaacccctctgcacatttctggagtcattttctgagtagtttattcatctctattctctgccttaaaagtcccagctccctcagcctccggaactccaatctctgcctcaacaggaccactgggttctgttggggttcactcttcctgcaccctggttcagaaatcccccgcaagcagggagccagggaaattgtagggctttcttgcttcattttccttctcccagcaatcacagtctcagtctacccactacccagtgtctgacaattgtcattgcacatgtctttcttatccagtttttcagctgtgcgtgacagggagacaactgccgatgctcttaccactcaaggcaggagtgcttctaagttttctttctctctttctttctttctttctccttccttccttccttctccttccttccttctccttccttcctttctcttttttcttttctctttctttctttctttctttctttctttctttctttctttctttctttctttcttctttcgacagagtttcgctcttgttgcccaggctggagtgtgcaatggtgcaatcttggctcactgcaacctctgcctcctgggttcaagcaattcccctacctcagcctcccgagtagctgaagtttccatagttcttctcggccctctattccctgaaaggagtaactgcttgctatagtccctgccttgtaataccttagcagtcggttgagccttttcagttctccaatacaaccagagagctgtgttgctaacagggatttacactgcgctctctccatgggagtaatatgtgtttccatctcccatcaggaccgcccaccttccttcagagtaaaagcgagagatggagcggagggctggtggcatggtgacaggtgatacggatggtcacctttttctgcctaaagaaaagggggcctataactagaggggaggcccaggaagagttcccaggggagcccacacggtgttccctggagtcaagaggccccaggtcaggtgtccgacctttacaggagagccagatggccagagcatgggttgctatgtggaagggccagcaatgagagggttgtcctggagtgcctctcggggactggcagggccacggagccaggtgcttcctctggctaggccatgctagccaggcacggtggctcatgcctgcaatcccagcactttgggaggccaagtcaggaggatcagttgaggccaggagtttgagaccagcctggaccatatagcaagactccgtctctacaaaatataaaaataaattagctgggcctaacggtgcccacctctggtcccagctactcaggaggctgaggcagaaggatcacttgaaccaaggagatcaaggctgcagtgaacaattatctcaccactgcactctagcctgggtgacagagtgagaccatgtctcaaaaataaaataaaataaaataaaatgaaaaataaaggccatgttcacaagcgcaccctccaggaccagatagccccagcagacaggtgcaagctgggcctccaggagcaggaactgagggaactgtgtcacatggaagatgggaggtccccaaggggaagggagagggtgtccaataattcctaaaagtccccagagagaaagcctcaccttgggcaccaaccggcccagttagaaggtacctactcagttcctatcgccagccagggatgactgcttcacccctttatggctccccacctccctctcacccacctcccaacaagcaggagagccagcaggggccgttgaactaagtctgatctgaagctgcctctttgactattttaagtttggcctaaagttctttccatgcatagtgagctgtaagctacctggagactgaacagactgcagcctactcttgtgccaatcaccgagtttctggcaatcgaaagcggccaactgttcaaactctgttcacataaggcaagtgcccagctgcaatcaccctgctgcttctgcacctcacttctgtgttctgttcctcactttcccttttttgtccataaaccttcttccaccatgtggctatgttggagcttctcggagcctattctgctcccggctctgcccaatgtacaaatcattctttgttcaattaagcctgttaaatttaatgtttttttaaaaaaatttaatgttgtttaaggtttttcttttatcacagaggaggaagacacacagagagggaaaagatacaccccttcctctactgcaggtttaggaggctgtggggcagggagagtggaaagtttaacttcaataagaacgttaaggccgggcgcggtggctcacacctggaatcccagcactttgggaggctgaggcacgtagatcactttaggccaggagttcaagaccagccatgaccaacatggtgaaactctgtctctactaaaaatacaaaaataaaccaggcatggtggtgcatgcctgtggtcccagctgctcaggaggctgaggcaggagaatcacttgaacccaggaggagaaggttgcagtgagccgagatggtgcctctgtactccagcctgggcaacagagtgagactctgtctcaaacaaaaactagaataaaataagataaaaacctttaaaaactcctttagattagtctggactatttggtacaggaagatgagacagtgtcttagtacctgcaaaggaccagaaagcaatggaatctaaatgacgcccccaggacagggatccaatggagcaggcgggaaaggcagtcaggtggaaaatagaaaatgatttcattatttcagccccagcctagctccttcagtaaaccagttacaaatattagatgcatgaaaatcttcataggaaaagagatgggagcccagagtcccagacaaagagcaggcagctgctctatcttccctcggtgccctgccaccccacggcttcccctgcaggccacgctgagtcccccaaccctgcggcttcccctgcaggccaccctgggtacccccctaccccaccccatggcttctcctgcaggctgttctgtctttcctgagtcccccaccccacggcctcgcctgtaggctggtggcagtcctcagctccagaccttccccacgacccaaggttactctcagggtggagccagaaacaccggccctagctcccacacacacctgaagacctgtgtccctgcctaaccatgtgggaccccagcacaggtatgtagatgtgacaggccacctgcactccagctggagagaggaaatagatcaggcatcagtcagcagccctcagcaaaccatatgaggctagagcacgcgtcaccctaggaaaacggagcctcttccgggaagaatatcttctcaaaccagccatggtttgagaaaggctgtcaggaaagaccagttgttgttttttctgtccaatctgtcacagatctatattttgtaaaatgcagtacaaatgagttattaggaaaaattgaataaaaacaaagcactcaaaatacaagctgaaaatttgtattattagattggacggacataaaattactccatcaaattacaatttctgtacttatttcttcatgggccagccacagccagtccacggaccatgctgtgagcagccccagcccggccaggaactgttcatggcagccagccctggccactgcactgcccaggaagctggtcattaaaacttgcaggccatttggcagacctaggccatacctttcgtgtctccctgctggcctctccagcctccttaaagccacttctgattaggtcagttcccctggcatcagccttcagcagatcccccagcgtggatccacgtcctccttctctgactgctgtgccctcttcctgacctcgcgtatccagtcctgaccgctctcaggctccacttcactgccccaccttgtgagtcctcccaataccatcactctgaggattttcaggggagttcgtccacacttctcttatttctcatttcacttcctactcagcactggggttcttataccgacctcttaccttccctgcgagatcgtaaaatccttgggggcaggattcatttctgacttatctttgcatccttcataagagctggtacagtggctacccccaaaccactgacttttattaatgattgaaaacattaaggccagtcgcagtggctcacgcctgtaatctcaatactttgggaggccaaggcgggaggatcacttgaggtcaggcatttgagaccagcctggccaacacagtgaaaccccatctctaccaaaaaatacaacaattagccggatgtggtggtgtgtgcctgtacttccagctactcgggaggctgaggcaggagaatcacttgaacccaggaggcagaggctgcagtgagctgagatcacaccactgcactccagcctgggtgacagagtgagaccctgtctcaaattaaaaaaaaaaaaaatagaactctctccctgagtctggatggagtcatttgggcagagataagcagctgtttgtctgttcttcctaccttgagtgccagtaagtcccaggccctgaaggcccccagtctgggaagttccctcagcactggggaaaaaggtcggtcgctaagtggacagtttgatgcgctctgtgcctctctgagcccttcagaaaacgaggacaccagctgtcccctgtctcaattgagcaggacgtctcctttcatttctcctgggcctcttactccctagcagggtgtcagagcccgctgccagttgtcccaagatggggaagcggccccgacagatggaagatagctcagtgctgtgtgaagggaaacggcttttgtttcagcccccggtgtgtgtggcaggcacgaggcttgatgacagggtgatgagctgtggaaggaatgcaccacagggctggaacacaatcgtgctttgtttttgttcttgcatctgagaatgcccctggactgatggcagcgacgaggcccaatgtgccacatttcatcctacaggcgccaatccacatccccccaccgcagagaggtggctcttcctgcaatccggccgcgatgcgcctgctgtaaatcagcgtggctccccccaagtcaaaggccgtctgaacaaggtgacagagaaatgcaaggaggatggacagcctcgtctggctctgccttggagggggaggctgcctggcctcccacagccgggacaggttccctatgtgcagcgctgcctgcgagagggtccccaggatgaactcctgctgtgtcactcctcagaacccgagtcctgtgccaaggacggtaactttagctatgaaggggagtcaagaaagagagaaaaatgaggagaaagcaagaaaaacagaaagattgaggacagggggatagaaggaggcagaaggggagaaatgaaggaagaggattttaaaaaataaaaaaaaaaagaatggacgcagcaaaccaccatcgcacacgtatacctatgtaacaaacctgcacgttctgcacatgtatcccagaacttaaagtaaaattaaaaaaacaaaaacaaaaaagagagtgtgtgcagggtacctcccctttacaaaaccgtcagaaaaaagaaagggaatggacaagaaagaaaagacgggaaaaaaagggaaaaagtaaggacatttttaaaggggggagaagagatggcaaataagaaatgatgttggcagtaatggcttttgagagccttactgattgatagaaaatatttcttagataggtttcccctccaggagaggactcttggttcaagctccctcctctcatgctggccaggagcagggctgcagaggaagctctgagtttctcagagaagcctagcactcccttctcttccttctaggcagccaaagtcctgggaggcacaagaaagtgagttacaagttccactctgtcccacagggaggctgcaaagtggtgtcatctctcagaggaagtcggctgagctggctggaaagtgtgtaagtgtgtgtgtatgtgtgtgtgtgtgtatgcgcgcgcgcttgcagcttctctgccagagttgggaaatcagaggtctgatcacttttgactctggtgtagctgttttcctcttgtaatcctcagtgtggtgagcagaaggcagtggaaaacacactccgtgaagtttttttccattagaaggtcactaaactgtgtaactcagaaataaggttctgctgcacacatagctttcaacttacatattcctggactttggacaacatcttttgtcccagaaatgagagaaggaacaacacttttaaattatttttaatttttaattgtggtaaaatacacataacataaaatttaccatcttaaccacttcaagtgtacggttctgtggcattaagtacattcatgttattgtgcaaccattaccaccgtccctccacagaattcttgcaaaactgacactctctacccattaaacaataactcctcatttctccttaccccagcccctggcaaccttcaacctattttctatctctttgactttgactactgaagatacctcacataagtggaattatgtagtatttgtctttttgagactggcttatttcacttaacatcatgtcctcaaggtgcatccacattgtagcatgtcagaatttccttcattcttagaaaaagcaaatgctattgtgtagtacgtatacagcacatttcgtttttccactcgcctaccttttggctattatgattaatcctgctatgaacatagatgtacaaatatctctttgagtccctgatttcagttattttaggtatacactcagaagtggaattgctagatcttatggtaaatctattttgaagcttttgagaaactgctataccgttttccacagtagctgcagcattttacattcccaccaacattgcacaagggttccaatcactttctccacatccttgccaacacctgttattttctgttgtttatttaagagattgggtctcgctatgttgcccagactggcctcgaatttctgggctcaagtgatcctcctccctcaccctccttaatagctgggattataggcacatgacaccacatccagataatttctgtttttgatagtagccattcgaatgggcaggaagtaatatcccattgtggttttgatttgcatttctctactgattagtaatgttgaacatcttttacttgtttatctgccatttgtataccttctttagaaaactgtctattcaggtcctttgtgaattttttaattaggccatttggtttttgttgttgttgtagaattgtaggagttctttaaatagtctggttattaatcccttatgaaatgtatgattttcaaatattttctcccatgctgtgggttgccttttcactctgttgattgtgtcctttgatgcaaagaagcagaattttaagtcaactgcaatactatggcacttctcgagatgtcactaaatgtgagagagaggccaggtgtggtagctaatgcctgtaatcccagcattttgggaggccaaggcaggtggatcacaaggtcaagagatcaagatcatcctggccaacatggtgaaaccccgtctctactaaaaatacaaaaattagctggatgtggtggtgtgtgcctgtagtcccagctactggggaggctgaggcaggagaatcacttgaacccaggagactgaggttgcagtgagctgagatcgtgccactgcactccagcctgacgacagagcgagactcagtctcaaacaaacaaacaaaaaaagtgagaaagaacaagataaaaccctaccctgatgactgcaaagtgtgtgcacccccatccaccagtatttcagcctagcctcaccagaacttgttgaccaagttaggacataacccacctcttccattaccttccctatcagagtctgtatgtgaggttcccagaaatcctttctttgcagacctatgctaaatagaaggttttgtgtttgggcttttttgttgtttcattgtctggttgggttttgttttgatgttggtggtgttttggtttgtatctctgccttctgactatggtttttcaagtcctgcagcaaggaatcttgcagaattaacttcacataaaggattcaaatgaaccacttattcggaagaaaacatcccaggtttgctggccagttcagctctccacactttgcaccaggagggatcattctaaaaagtgatcccaaggggagtgagccagatgcagacatttaactgttctgcaagataaggacttgaaagcatcttataagtgagcactcagcattcaaggtcctggctctaagttttatgagccctaattctgatccagtgtcagctgctggattctctgccaaagaaatactggaaaaccagcttttcttcaatttcattggtatgtcagccactgatggacatcgtctgtgaagccagaccaacctttaaaacatccaaatatattggaatgagtgcatcattttcttttcgcaatggaaaagcaaagctagtttaatggacgacgacgtcaacccaatagtgccaatagtgggtgggggagagtttcgcaggcagggacaggaaaggtcctggagtgctgcccaactctccccactttagagtcacttgcctttccccagggagccccaccaggccatgctctgccacactctgaagtccaattggttcaattcattcctcttctttcttaaccaccccttacaagtttcttgaatttaaggcatgtgcaaggcactgtactgagggcaatggcagtggggagggagacacagagctcatattatacacggcagctgtcctcatggtgctgacagacaagtggaagtgatgaaggaacaatcaagaaaaagagtgatcaatacaggccgggcggggtggttcacacctgtaatcccagcactttgggaggccgaggtaggcagatcacctgaggtcaggagttcgagaccagcctggccaacatggtgaaaccccatctctactaaaaatacaaaaaaattagacaggtgtggtggctggcacctgcagtaccagctactactctcaggaggctgaggcaggagaatcacttgaacctgggaggcagaggttgcatgagccgagatcacgcgactgcactccagcctgggcaacagagtgagactccatcccccaaaaaaaaaaaaaaaaaggtaatcaatacaaagcagacttggtaccacaatttaacattccactcgaccccaagtatgtaggggcttccagcagaggggccagtgaggaggggaagtcccagtgacctggcattggaggtacattgtacacacagacaccaacacaaacacaagcacacatctcaatgccagcacccacacacgctgacactgatatgcacccacacacattcacagatacccatacatatacacacacaccctaaaaaagggatgtgctcttcccacatcagtgccgggatacatttttttttaaacattcctctcctaaaagaaatgataaataggttgggcatggtggctcataactgaaattccagtgctttgggaggccaaggcaggaagattgcttgagttggagaccagcctgggcaacctagcaagatgccatctctacaaaaaatacaaaaattagccaggcatgctgatgcactcctgtagccccagctgctcaggaggctgagctgggaggactgcttgagcccaggagtttgagcctgcagtgagctatgatcacgacactgcactccagcctggggcaacagagcaagaccctgtctctaaaataagtaaataaataaataagaaatgataaatggacaaaaacccagggcttcctaaagcagtttggaggcccaagaagacagcccggctgaatttataacatatcaccatcctttgccccattctagataggtttcatatgcaccttataaaaagtacaccccaacttcctggaaggggtggggtttttaaaggagtagattaatgttcatgggtggtagttgctagagttccaggtgaagaagagaagcaccaagctctgagtgttttttgcagaattccaagtcctctctgcagatgtacatttattcctgtaagtggatgctgggctttcgttttatgtaccctggctcaatttcagcgcaggtcaagttcaaatgcttcatgcggcatggacagtgatgagccttgaggaagtccaggtggttctgattaggtctggaagcacataactcatccaatagagaacccaatcaattgcaaaggtctgggtccctgttcctgcctgctgggtccaagtttcattcctgttggaatgtaacttcccgatcaaagacaaaatctttgattccttcttcccacctaccctcccaacaaaaagtcaccgaaaaaaaaaaaggctggcttggaattgaggctccagaggtttatttggacaccacccaccctttgtaaatcaacattttaacgagttaagtgcacatgaatcagaaacacagggtcacatttcctctgaaatacttgggggtggggatgcaaaatgcactccgaatttggcccagtccagaatcaggaggcaggccaggcccttgtcaagattctctcatcccagtgttcggcccagcagccgggaccatttcccccagccgtcctcagctgcgtcaggactgagcggaatggtgctcacatgccctgccggccgccactaggataatccatgccaaccccacagaatgggaggcgagcgatactgagaacaatgaaggggtctgacatggaaatttcagtaggaaacaagcaattacatgagaacaaacattcccagtgccacttacaacaattggaacacaacagtgattataaaaatgaaagcaacaaattgagagccagggcagcatgcaccttaaaacaaattgtcctcctggtgcagagctgcgaccctctccctgggcaactgtgtgactgtgtgtgtgtgtgtgtgtgtgtgtctgtgtgtctgtgtgtgtgtaacacatgaattttatttgacttgtcttagaggctggatctcttatccctgcggtagaaaccacttctcctgagcaaactggtttccatccaccaggcagggaggaaacagtgagaaaactggagaggattttctctggccctgctataggttcagtctcaggactgtgggaaaatgtgcacggcaggggaaaaggcctgtcttctccaactcagggcagaggcaggtttctaatgaagagggcctaggaaagaaatattttgcagggagccaaacgtaccaggacataccagctttccttgttttcttcatcaagatccacagaacagtgaagctcattctagggttcgaaaggtaaattatttccttccatcggttgagtgaaaatcagtcctctgggtctcatgcacatctactcagtctccattatgggatgccttccttatccagctccagcctgtgtttctcattcatagctgtcaattctggcactgcagggaggaggcatctgaaaataaggcggcagcctggggaagtctggagaggatgcagggagtttctgcgtggcagtggttggcaagtggggagcagagctagcaaggcttcacgctgatatacattgcaatttacaggctggtacttatttttttctctaggcaattactggctgcctcctgctcctcctcttctgtaggggccttggggcctccctcaagcctggcccagctcggggcctgatttgtgcggctaagagtcattgagcaacctgccaagactagcagccaagtttggattcctatggccacagctgctggccttgggagggagcactgaccccagaggaatccagctaaatctgtggaacccaccctggttgtccttgggccacattgtgaaatatgcacttagattgtgggttgggttgtggcatgtgatctctttattccttcagatgatgggcctactcatctagttgatggggcaagattacccagatctgcataagccccccagagaactatgcagcaaaaatggaaactgaggcccctaaaccacccttccaccctcaatccattcccaagtacaaacaataacagcagatgctagtgtaaatcattaaaaagtgcaatagatggctgagcacggtggctcatgcctgtaatcccagcagtttgggaggtggaggcaggaggattgcttgaacccaggagttcaagaccggcctgagcaacatagtgagacttgtctctacaaaaaaatttaaaaattagcatggcttggtggcttatgcctgtagtaccagttaatcagaaggctgaggtggaaggattgtctgagcctggaaggttaaggctgcagtaagccaagatcacaccactgaactccagcatgggcagcagagcaaaaccctgtctcaaaataaataaataaaactaaaataaaataaaaagtgcagtagagatggggatcttgtgcaaagcattttagcagaatctcctgttttctttctaattcccttccttggaaggaaatttattgtgcagttctgggttttttttttttccatttcaatagatttagggggtacagattgtttttggttacatggatgaattatatagtgaagtctgggcttttagtgtaaccatcacccaaacagtgtacactgtacccaataggtaatttctcattcctcaccccactcccaccctctgatcttctgagtctccagtgtccattataccactctggtggacctgtgtacccacagcatagcttccacttataagtgagaatatgccagtatttggttttccagtcctgagttacttcacttaggatagtggcctctagctccacgcaagttgctgcaaaatacattatttcattttttatggctgagtagtattccatggtgtatgtataccacatttcctatattcactcattggatgatgggtacttaggttgattccacatctttgcaactgtgaattgtgctgtaataaacatacaggtgtaggtgttttttgatataatgacttttttcctttaggtagatacccagcagtacgactgatagatcgaatggtagctctattcttagttatttgagaaatctccatattgttttccgtagaggttatactaactttcattcccatcaacagtgtataagcattcccttttcactgcatccatgccaacaaactgtgggttctgattgctttatttatatttaagccctgacacccggggatctcagagaagctggatccctggatcctacctggccagccaatgggcaggcttcctgagggtacacagctttaggactgtggactcaggcactccagggaagcgggaaataagaacttctccttagtgcttgcaactgccacatcagaacttagctgaaatccgagggatcggatcccaaatccttcctcaccagcccccatccaccagtccttttgctcaggtgataggaaggtcatcctaatgataaccacgtggtgggtttcagctgtggaaaattcctggcccctttctccttcttcccaccccctccttctccccttaagcacacacacatgcagctttcccttcctttatttaagcaaacaactctccatgattgggtacagccccttcttatctaaatagtctgcagatgcatgaagatgcaggcgctttctgctcctattcggagcttgttctggtgcccatcttctccaaacctacaacaagtggcctcccttagaccttgctgacagcaatccctactgcctgctcccctagtaagtcagctcaggggacaggctgtcctcaatgtatcaggggtgggattttccctccaaagacttcaatttcccctctctttcttggctcctcccataacctgaggttgaaactgcccagacatgagcaaatggaacagggaaagtcccaattttgttgtcagattcctatgtaactttagttgtccaggtacataccaccagttggttaacaccatcaacccctggtgggtctggggatgggggctgaggactgggaagtttggtaaagggcacagtccataatgttaatagatgggaaaaataggaaggaacctgtgagtttccataatgagcagggtctgagggaaaagaattaaccctaaggtctaggacaagaatgaaatctaatgagtgggttgagaagatcagccccagctttgggtttataagcatgactctctggtttgattttcttcccattccaaagcgtggtcaatattttgagtccttaggagatgggctgtgctgatcatagagatggtgatactgtaacagggggtgaggacgcacctgaaaccatcagcctgttagagcttccctacccaaagtacattctgcacactgacagcttcacagcttcagcctcacccgggtacccaaggaaacgtggtacacatacactatggaatactacgcagccataaaaaataacaaaatcctgtgctttgcagtcacatccaaatgccacatgttcttactaataagtgggagctaaacaatgggtccacatggacatcaagatagacagaatcaattctggggactccaaaaggaggaaggggtgggggcaagaattgggaaatttcctattgggtactatgttcactatctgagtaatagagtcaatagaagcccaaacctcagcatcatacaatatacccttgtaacaaagctgcacatgtgcccccaaatccaaaatttatatttaaatttttaaaagattattcaaatgttaatatggcccactagtagtttgcaaaaaaaattatataatctttggattaagaaaaataacctcttttgatattaaaagcattacgagtcatgtgtgctttaggtacttatggattatttgacaaagctccattggataggccatgtatgtctttatacaaataaaactggaaaaatatgaggaaaaaaaagaaaagaaatgcagaattcaagcccacctcagacctacccttcagaatcggcattttaacactggtcctcaagtgagtcatatacatattaaaatgtgagaaacactccttggacagccaaatgtactcagtcttaaggaaagagggctcgttcccccttgcatttaacttgcctctattagctgatgccgggtaagatgaactcacagagcttcagaagggactgcggcaatatgaagtgtggatgtggggagagggagatgacaaaataacttcctgcctctcatccccgggccacgcaggtcctatgagaatgttttgcaaagtaagatcccgtgaactgctggcatcagagaaacctagcaccttggttctagagcccctttgccaaccttcccaaactttcccaatcagaatgtctgggggtgggagccaagacccacatattagtaagctccccttggtgatactcacataggctgaaatttaagaacgattctccctctgcccttcaattgctattggatgattagtaccatgtcccaccctcaggagcaaaagtgaattgctagcacttctggacccaaggaggggagacagcctttgaagttaagaccagcctacctctgtgtcccttggtcttttatacctcctgcctagggaagtgccgaaatttttcattaaggaggtgcaggtgccatgcagcttgaggacaagcctgtggttccaagtgctgccagcatctctgaggcacaagcgtcaagcagtcctgacccttgggcaccccaaactccaccacggtgactccagcagctggaactgagatacctttgcacacacttcatcatccttttgcagacttaaaaaaaatggaaatggtgggtcatggtggtgagcttcagtagggggtggcaatgacatctccacccagcctaaataaattttctttcttattaaccacagggagctaaaaggaaatatggacattttccttggctggactagtatctcactattttaccagtcaggtacattagcatgtgagaatctttctggactacagcatgactttgatagaatgtttacaagtcctcataccacaccttaaaaaaaaagttgtgtctctgtgcttgggcgtggatttgggtaacctgggaatattttatcacttctgggtaaaactgacagttgtctgcggtttggaggtgacttactgatcagggaactacatccactgaagttgtcactgtaattgcttgcagaattagaagtcacatggaagaattcctgaggcaagaagcacataacctaatatgaaacagcttgggctgggtatggtgcagcactctgagtccaaagggaagctcggcagggagcgcagacatcacgcctacgcaagtgggatgcaggagccctgggttctaattccaaccaggcgagtgacctgggagtcccagactagttgggaaatcccagctatatccccatcttacgttaaaagagtggatatgttcctctccaaggcctcctatgtgtctaagactccagataaggacaagttttccaattctagttggtaattctaacattgagttgagccggaggggaaagagaatgtttccatgagaaacatggaaaagaaattcaggcagggccgaaagctacattcttgtagagcaagcatttaaccttctctctgatctgaaacacacacaaccaggagaaacacttctggaagttatttataggagcagatggtaaatgggagggtgggggccacgggtagcctgtggtgcctcccaagttctccttcagcccacccacacccagttaccatttgcaagctgttgaactgggaccagaaagcatcactgaagaaactcaagaggagaaagatacatgtggttcaccggaaagggtgagaagtgtatgactgagtgggaaaaaaaagtcacagctcacagtatcattgattaattgagtgattttagtcaagtgaatattgatacatggctgaaaaagcatgaaaataaaatgaacacgtacgggaattactattaacataagcgataacatcaaaacatctggtaaaatgcagttaaaaaaacaacacaaatgaaatggaatgtaaaacattttcacagtattcaaagcttttgtaagagacttaggatctaaaagaggagtactacaggaagaaactagaggaaacgggaatttcatccatgtcctgtgtatctgctggcaacaggtcagaacggccagtatgttattccctgcaggctgcctagggtgctctcctcaaacagatcacctgagcctcctgcatctatgaagttatgacacagcaaccagttactcagagtctgatgagaaaaacagattttaggtttgggaaatgggattactgtaatttacacatccaaatgcaaactggagctctgattgaattctaccctggggagaacttgatgctaacccacaggtaccaagagccaagtgttacacaggatattttaaaaataaaatgtttttggaatcctcacctcccatgctatcttctaagataactacaaatattcttcaaagatttaactgagttctgccaaggacctcccaggactctatccagaatgattattgtaaagctttacaaatcccaccttggccctagcgataattaggaaatcacaggcaaacctcctctctcggagaccaatgaccaggccaatcagtctgcacattggttttgttagatactttgtggagaaaaacaaaggctcgtgatagtgcagctctgtgcctacagagagcctcccttttggttctgaaattgctgatgtgacagagacaaagctgctatgggtctaaaaccttcaataaagtaactaatgacactcaaggtcctgggactctgagacagacggtggtaaaacccacagctgcgattcacatttccaatttattttgagctctttctgaagctgttgcttcctacctgagaattcccatttagagagctgcacagcacagtcacctgctcttccgtattctgtggtaactactaatgttccaggtaaacccctccactaaggactctgccgcagagagagggcccggttgcatgaggcactttgtcaaaatgagcagatacgtatgagcactgaactcttgagtgaatcaaccagaactaagacccagatccacgcactcaggaacttgctctgaatttcagtttgacaacagagaagtagaatatttctaattagctaatatatatacacattttttaatcatccaaaattacaggcaaatcacttaaggtccccagcactttacgatgaaaggtcagagagaaccccacaaaaaaggtgttaaaaggacaggatcactaactgtgagaggttaatttatcaggataactctccggtaggtaactaggcgggcatgctgattttcatactggagtcttcaagagttaacagaatctaccatcctttcctccgggtcaggctagggccgcagggggccactttacagcctcactgcagcatcctcactgggtataagcattggcccagagggacaatcataaatgtcctcaaagtgttgcagagaattaagaatccggctttgggggaagaaattaatatgcattttttttagaactacttcctgtacattggacaagaagggtaaagttgtctaagtgaactggcttatatacatcgctgattaaacataagggctttgggaagtatctcagggtacttgggaaaaactgcagagatgttttgcttttgaaactctctcgctggatggggacaccccacccatgtcaactttccatctgcagaaatgaaacaaatatatgtaaaaagtgcggggggacaggcaggctgttctgaatttctttgatccataggcaatcaagttcaaaggaaatgtttctttacaggaaagaaaaaaacggaaagctctgtgagttttgctagggggtgttaggttctagggcaaccacggactcttcaggaaggaaagccacacagctacactaccagggaaatccgcctcccttggcaaatgcctggggagagctgctcctctgggaagcagcctcggacggatcaggagaccttgttctagcacacctttcaaatgctcaatgtagactgttttaaaaccttgaaaaataagtgggtgtttgtcattgttcttttaaaaatgtgaaaaggaaaaaacatgagattagaatcctaagctcttcacccaatttcacaattcaccctgactagcaatttgctggactgttctaaaatttttttcatttgtttcttttttaactatgtgttttgaaaactactgccttctcagcccgaaaatcgccgtctctctcaggctcactgtggtttcctttttctgacacaaaggcaggcacaggctgcccctccacatgtcttggggatcagatcatgccccgggctcataggaaccgaaactttggggcatctgagactggctgattcagattcaaagacaatcacacggaaagactgtgggcagagaaggcaatgcctctcccctggtccctttgctgtcactattacataatggacttgcacttttcctccctgcacttatcactttctgggcttgaccttaattgtaagtgtggtatgagtctgtttccatttaaagcagacagaaagaaactactctggacctgaaaacaacgtgacttgccaatcattagaattttctagttgaaaggcatagatcagccaatagatccacaccaacaagttgcaaaatgtagtttttgctgctggctctcactttccgcccaatccccctttttgtgttttagtggctgtgttgctgttggaaatggtttgtcacctcctcctgtgcagtggctgctgctccacattgcggatcttaaaaaccttcctaatctaaatggcccttgctttacccggccatggctaccctggggtttggagcgtggctatggagggaagggagcgggaatgctgcaagaacaagccgactggattacaatgtccactactgacaggcgcagtgcgtgtgtgtgacccaccgggttcccggggcactgtcccccccgctcccaccccacccgaggctccctccccaccctgcccccgggagaatcacttaaacacggactgaaaggtggggcactcatggtttttcattttcttcatgaagtttttgaactccttgtttttcttgtcccacttgtggatggccgtcagcaagtactggctcttcaccttgcggcccatgatgaggaagtggtggctgaggttgtccagctggtggcagggacagtcagccccattcttcaggtacagcacaagcttcttcaggtccttcttcttgatgggccccaacttcaggggcttcttcttcttggggacaatcttcttgtcgccattttcttttttcacttcttttattttcatcctcagtgctagagatggagaggacagaagaagagaaaagagggtaagagaaagcatttagaacacagcttttctttttttgatcctcaaagtgattgcattttattattttattttttggcttatactttcttcttgtaaatatatatgtttttaattttagattcaggggcacaggtgcagagttggtttcatgggtatactgcatgatgctgaggtttgggcttctaataaccccatcgcccaagcagcaattacagtgtcggccatcctccctcatgtcttttggaatctccagtgtttactgtggaacaaagcttttcatctagaacaataacccaagtgtacagctgaggtggagaagaaaatgaaaggcaagtaacaagtcaagaaacaggcagttttatccataaaaaccaaggtctgttaatcccagcactttgggaggccaaagtgggtagatcctctgaggtcaggagttcgagaccagcctggccagcatggtgaaaccccatctctactaaaaatacaaaaattagccacacatggtggcaggcgcccataatcccagctactaaggaggctgaggcaggagaattgcttgaacctgggaggcggaggttgcagtgagccaagatcacaccactgcactccagcctgagcgacagagcaagactccatctcaaaaaaaaaaaatcaaggtctcagttacccattctgccaccgcctccgccccctattctgtggtgtccagtggtatctctctgtaatggccatcggtgccaggagatcctcaaataaatttcaaagctaaatcacattgctctttttaaaaatccagttatcatgcactgctttaagagaaaaaagggtcctataacccaatttactccacatgatctgatgctattgatctcatcattcaaagacaaaaaatcctgagtgtttttgttttttattgttgtctttgtggaggcagggtctcactctattgcccaggctggagtgcagtgtctcgatctcggctcactgcagcctcaaactcccgggctcaagcaattctcccacctcagcctcccaagtacctgggattgcaggcatgcaccatcatgcctggctgatttttttttttttttaagagacggatcttactatgttgcccagaactcctggactcaagaaatcctccctcctcagcctcccaaagtgttgggattacaggcatgagtcaccacgcctgaccatgagggtttctttttgtttggttttgttttgaagagcaagttattggtttagtattttaacattgaaagacctacaattccttgaaaattgagtcctataaaatgacaggcagaactatgtgtgtgcactcagcaagggaaagttaaaggttgtttcaaatggtcatgcttcctgcattaaacatcaacgtccaaccacagcatgggagaaatcagtttctactactgggtctctatggcggtaagacagcaggtactgctagtatcagtcaatcgctaatcaaccactaatccccactgacaggcagcactaatgttctgccaactgagaagacctacacaaaatccaaatctactttgactttctggcagattagagcaagttctggtgaagtcctaattgataaatccaggtgatgagctctcttcaaatccaatatggtaccagggctgcttctgttctcaactcccaggagtgtgggaaaatcagcccattcaccaactctgctttctcttttctctgtcccaatggacactgaattaacagtgttaacctgtgagccacatcctgtagcaatgactccacaggggctgctgatgaagataaatgagcgtggacatgctctataaacgaagcagactgaacacacagtgtcgcgggtacaatcaactcccctttaagactggtcagcccgagatattcccaaaggagttggaaatcactttctaggtgccagtcaccagataatttgcgtatcttctgaactctttttaatagaaaattaccaagccccctctttttaatgatgcaaggcttccacccacacaccctgaggaaagtctttaacctgaactaaatcacagtggctaacaattatgaaagcatgtgacctgccagaacatgtgctaagtattttccgtgcatttcctcagttaattctaacaactccaggaggaaggcataattattttcccatctaatagatgagaaaactgaggcatagggggttaagttggcttgcctaaagtcactaatcctaagttgaaacccatgtctaaatgtgcacttttaatctgcatgttgtccatgctgactctatggttccaaaattctttagaatggaccccaaacttggagtactgattaaatggaccaagaagatcacagggaggagctcagaccctcttcccagtttcacctacatttcaaaatgacttcacttatgaaatggcaaaagagtgcctcctggttgaaagagacttctctggcaaaggagaaactgcatttgtgaaagctttattatttaatattttaatttattttatttattagagatgggagaaactaatgcatactccagctgacaaggcgagcgccctcttgtctgcagagaagtgagccattgtaaggtagtacccaccacatgctgggctctgcagatgagaatgggatatgtctatctacgactccttgtttaatactcgcagcaaccatgttaagaaggcatcaatagtactttattataatcaaggagaaggactcaggttaagtaacaacagcatgaggccacagtttgtaagagacagaatcaggatcagaacccacacctaaccccaaaaccactctttcctgccatacacaccacgacccggttagaagtgatattgcttcattggaaactatttcactcttctgattgtgttgctttcaatcacaattcaaatcaaaaattaatgttcctttgccatgaccgtgtaaaggaatgtagtttacgtaggtgggggagcagccagggaggagaaatcagagtatgggaatgtgttacacattagactttacttcttgtcttgccacttggcccctttctttttttgaggtggggagagcaggaaagaaggcacgtatggccagaaattactaacatctttccatctttcaagggtttgttttaggagtgcagactaccaacaatgttgaaaagatcatgagctgtcccgggtggatttttccttgtgggtgtgtgtgcagaccccaccatgatgcatcccggggctgctggggcgagggcaggtgctggcccaagagcagcccggaactgatcaccaccaccccatcccatcatgctcacagggcctgggccccagcgatgttgcccatggcctgaatttgcaatgcaaatggtggtggtgaacaaacagaagcccagaaggtagcagctggggcaacagctggatacagtcccaggtcctgggttcttctctgagtctcagtactctgtctgtaaagtgcagggcaccatccgactgcaggcctggtggatcgaccatctgaggagcccctgctgggtacttctgggagacagcaaagtttatctccagcactatccccaccctgtgctcactccatgcttccctgattgggcaccctgctgtgcctggagcatagggctaaaactaaactaccaccttggaccctggatctcagctccctgtaacagctagaccctaatctaaaaccaaacaaaaaaattttaaaaattatgtgttttttttcttaagcaacaattttaacatcctccaagggtaggacatgactcccacctaggcatagctgccagcaagaattcagagacccagaaactttgaaaactcaaaatttgaggctgcaacaagggcctgcctgggtctttctcgggaaatcttaaaataatccattatatttgagtaggccattaagctttcattctacttgcagtcacccaaaccatttttgctcacaaattatacttccttggtagcctccctcaagaagcctggccttatttgggaagctgaaatgagaatgaggaagtcatcacacaccatcccaaaccctcacattcttcaaagccgtctcttcctcctgactccctgcttctatgagtggtgcctccaaccctcccaagcccgagacatcctacccatgactttgaacgtaaggcaaccattggcccagagccagtcatttcataaccagtcctgtggaatggctgtaggaatccaggaagggtctgtggggaaaggtggcatggggttgcattaggaatcaatcttataactcctctgatggcagatgatagtagcaatgaagggtaaagtacagagggaaagagggacatactagagagcgccttcgtcaggtgaaaggaagaagagttactgtaaatgccacgggaggccccgctgggaaaccaggcagcccagtgtcaatgaagaccacagggtccatttaaatggaggaaacacccctcaaccctaagtgccgaagagcttaagaatgagtctgaaactagagcacttcactgggtgattagggggccacgccaacccataggaggccaggatctggagtggtgagggcaaattccagagagcaaaaatccaatgggaagggaaaagaagagagaagccatatcaccaagcttctggactgagtgcgaaggagcacttgcaggcacgctagccacatggattagactgagcccgtgcaatcattcccactcttcttgaagtcagtttaaaattagagtcaaaaaaacaagttataaacacatgcaagaaagtggtaaaggaaaaaagaacatatcaacattttgtatgacagaaagcaaatggatggtagaatctggcttaaaagggagaagaaaagctaaaatgcagatagggatgccagtaaagtgcagagaaaagaagaaaaagagggacagacagggatgccagtaaaaaacaagcccatttgcactccaggtcccacaaatgctcctgattggggcccccggacactcctgaactccatcacagaggctgtcaatgttgggattggcagcaagtttacatatggacactcaaacctactcccctgggccatgagtccaggtggctgccctcaccaactccagcagtagccatgggcttcattccatacagaaggcctgtagttccagctacttgggaggctggaggtaggagaatcgcttgaacccgggaggtggagattgcagtgagccgagagcgcacactgcactccagcctgggtgacagagcaagactccatctcaaaaaaaaaaaaagaaaaagaaaagaaaagggggaaaaaaagaaggcctgaacctgcacacagcctgccgctggggtatactagacacagaggaggaccggacaggtgctgctgcgtgaacaccaaagggttacatgaaagtctgcaaagtgaagaatgagacactcgggtcttagaacactacatttatatgcctgtgtcagaggattgagtggtttttctctaaagaaactattaggctgttgcaaaagtagtcacggtctttgccattactttcaactgcaaaaaccgtagttacttctgcatcaacctaagaatagttcaaaagaaaagacatatgggccctctgcaaaattctcaagtgaggcctaacaaatcacaggccctgcatgtacacaaagagcttccaacgtcatgtctcgctgttaaattcaaatggacagtcaagggctggcaagtatttaaggaaagcctccaaatgtgaatggcagagactgtaacatacaaaacagaaaaggaagaaaaggaattcagagataacagagacaatgcagggagtattaaaaaaaaaaacttttcactttttgccttgttgcactcctaaaagcaagatgggtcaccagcagctctcctggagccatccaaaaaaattcggccagggttctcattcttgtcattatggcctcaatatgtgctgccagtgtttccatcagtatgcagaggaggtaggcttcattaggttagactaagtgagcttccctgaatggattatccaaggcatccaccaagtgaaagaaaccatgctagctctctgtacataaaataaaattttaaaaaaaaaactttaaaaaatgataatatggccaggagtggtggcccgcacctgtaatctcagcactttgggaggctgaggcaagcagatcacttgaacccaagagttagagaccagcctgggcaatatagtgagaccccatctctaccaaaaaaaaaaaattagccaggcatggtggtgcatgcctgtagtcccagctactcaggaagctgagatgagaagatcagctgagtctggggagattgaggctgcagtgagctatgactgcacccctgcgctccagcctgggtgacagagtgagaccctgcctcaaaaaaaattgttttaaatgataataaattagataagacttttgtattcctaaaacaagaacagaaagctattaaaaggaatgttcagagactgggaaagattacttggaaatttaaaatataagagaagaaatataaaatgcaagacaagtaaaaagatgtgaaagaaaggaaataaatatgcagtacactacatggctcagctgcaaataatatttacataattctaataaattaaacattcaatattaaccaaaagtgtgatgtaattatattggaaagatagtgtaaaagagataaatctttaacttcaataacagaaaatcaataaataatggttttaagataaggttaaagaggccaggcacggtggctcacgcctgtaatcccagcactttgggaggccaaggcaggtggatcacttggggccaagagtccaagacccgaccagcctggccaacgtggcgaaaccccgtctctactgaaaatacaaaaattagcctgtgtggtggcatgtgcctataattcctgctaattgggagggtgaggtaggagaattgcttgaactcaggaggcagaggttgcagtgagctgagattacaccactgcactccagcctaggtgacagagccagactgtctcaaaaaattttttcaagaatattttttaaattttttttaaaagataaggttgaagaaatttcatgaaaagatgaacaaaatgacaaacagatgggaaacagaggaaagaaaaagagaatcaatccaagagtttcaacatctgagaaaagggtattatagcaagagagaacaagaaaacaaacggcagaaaataccaaagaaataatacaagaaaactttccagaaatgaagaacatgagtcctcaggttaaacaacacccagctcaaagaatcatgacatttacaaatatgaaagacaaaaagaacttttaaaatcttcaagagaaaagggtagacatctaatacaaaggatcagtatcccagttgcactggatttatcaatacagacactggaaactggaggataatgaatcaatgcctttaaaattgccaaatttgatactgaggcaagctatcaatcagcatgcaagagtagaatgaaaacatcttcaggcattaacaggttttaaaacatcatctcccatgtatcttttcttaggaaactactcaatgatgtgctctacaaaaatgcagaatttttttaatttataaaatgtattatcagccaggcacagtggctcacacctgtaatcctagcactttgggaggcagaggtaggcagattgcctgggctcaggagttcgagaccagcctaggcaacatggcaaaactctgtctctactaaaaatacaaacacttagccaggcatagtgatgcgcacctgtgggccgatctactcaggagggctgaggcaggagaattgcttgaactcgggaggcagaggctgcagtgagccgagatcatgccactgcactccagcctgggcctctgtctcaaaaaaaaaaggcattattaatgttatttttgattgaaaagtaataattgtataaacttatgggttacaatgtgatgttttgtataagagaaggaatgattaaatcaagctaattagcatgtacatcatctcacttacctatttaaaaaaatgcagaattaaacaagacacgggattcaggaaaccaaaggtctaacctaagaaaggaaaaggaaggcttaggatggtttttcccgaacaactgtgtggcaggctgtgatggttaattttaggtgtcagcttggattgagggatgctgagaaggctggaaacgtgtgtgtgtccaagagggtgtttcagaggagactgacatgtgagtcagtgggctgggagaggaagagtcagacctcaatgtgggctggcaccacccaatcagctgcgagggcagtcagaataaagcaaggagaagaaggcaggtattcagcttgtggagtttctgctctccctcccttcccaataatggctgtttctcttctcctgcccttgcacatcagactccatgtttttcggctctgggactttggggcttgcaccagtggcctcctgggggctttcaggctttcagcctcagactgggggctgcattgttccaaggcttctctggttctccagcttgcagacagcctatcgtgagacttctccaatcctgtgaaccaatgcccctaattaactccctctcccatctcctgttgtttctgtttctctgaagaaccctgtctaacaaaaaagcctaaagctccatcagcccagaccaatggtaggaaagagaactcaggcagatttcctgatgcatatctgccagaaagcttggggctgaattcataatatgaacataagtaactgggttaataaaatggggcagttactatctccaggaaaaacaaaatgatgtaaaagaaaggaaataaatatgcagtacactacatggctcagctgcaaataatatttacataattataataaattaaacactgaatattaaccaaaaatgtgatatacctgtactggaaagacagtgcaagagagataaatctttaacttcaataacagaaaatcaataaagaacatctaaatattaaaaataagaaatccaattataaccatgttatttatttgctccagtttgctgaatatgaagaaatcactaaaatacttgaaaattattacttctaggtcataggaactagaggtgggaagggaactgcatgcagtttttgttaaaaaccattcattccaatttaactttttaaactatatttacgttgaatcaaaaatttaaaatttaaaaaacttagtctaataaagaatgtcagtgtatataaaatataaatgaaccacaaaatgtcagatcatgaaggaaatacagagatttcacatctccagacccttcaccctccattcagctggagcaacttggccatatagttaggacttcttaagggttttgattaagaattctgctttctcaaccagctttttgttgtttcctttttttttcttttttgaggaggaggagggaggcagtccactgatttagtcaatccccatcatttttcagataacaaaatcaattgggttagaatgcaaattatttacttagaactggaagagacgttaaatctggttcaaccgatgctcaaaagtgaagtcacttgtcagctctgcctggaacctgctccctgcttccctacccagagctttatgattcatacagcagttcctccagtaggagagcgagaggggatgaatgggggcctagccatctgggatgacggggcaagcagttggatccattttttccaaaaggtgctgttaaaaaaaaaaaaaaaaaaatcacccagagacagataccagaccacacactctgattcctaagagacttgctttttccctaaattgctttctttttcagaggggcctaaagttcccaaagagataacaagagaagtagagggcaagctagtcacagtgagactggcaaactctttttgttttttttttttagacagagttttgctcttttgcccaggctggagtgcagtggcggaatctcggctcactgcaacctctgcctcctgggttcaagcaattctcctgcctcagcctcccgagtagctgggactacaggcacacaccgccacgcccggctaattttttgtatttttagtagagacggggtttcaccacgttagctaggatggtctagatttcctgacctcgtgatccgagactggcaaactctttaagagacagggtctcactttgtcgcccaggctggagtgcagtggcgccatcacagctcactgcagccttgatcttctgggcgcaagtgatccttcagtgtcagcctcctgaggagctgtgactacaagcattcagcatcacatttggctgattttttaatttttgtgtagaaacagggtcttggcatctttcccaggttggtctcgaactcctgagctcaagtgatcctcccacctcagcctctcaaagtgctctcaaagatgtgagccaccacaccagtctgtaaactctacaaagtggcttagcccagcttggttgatcaggaaaggcccacagacgggcaccccaatgcaccagtcgcatgggcctgctccacccctcctaccccacagagcctccaggtggaaaagtctgctcagataccaaagcctcactaagccatgaagacagagcactggtttcctgcctcccagccccagatcacacatgtcttgggtaaccctgaggtctgaggcagaaagcaccctccccaagtccaattgtgcaaatgagattcagtaacagcactgggtacggcatttggctgcaagcaaccacaacctccttccaacactcagcagagttctgggcaccatggcgagctggctttgcggcactagggcccagataagtcctactgacaatggccttgcaatggcagcttaacagaccccactgttcccagcaggagccaatgtctggcatcattaattcgtttagcagagaaaggggcttgtgctttgtcacaataactcagcgtctctcccctgaccacaagccacatgctgcatacttggatgcatttgctgactacaagacatacgttacacacaagaacaaaaaaaactaaactaaaagaacaagatccaaagcagatttctttttctctcatctccaaaaacaaaacaaagcaaaacaaacaaaacaaaacaaaaaacagcagatgtggaaaatgctcctgagtggctcatttgggacaaattatttaattgaagttgtcctgttttctggaccccagacacctcaggaaggtggccaggcaggagagtagagattgcaactttgcagagccctctccccagtactcacatatgaacgcacacacgcaagctcatgtacacatgcacacacactcgccagcatcatcaatgcatacacaccagcagcatcggtgtcagccatccagaatcctgctgctaactgcttgatttcctggattgtgttaaatccccactgagttaagctaatggtgcaaaatgaaaaccccactctgagagcaaagtgctgcctggtgtgatttcatctgggaagccacgcatcttggggagcaagggcttgggcctcagagtggatcagagaagaactgtggcccctccccttcccagtgtgcagcttagcctcttccacccccagccccccaccctcaccaccatcctgcactggagggagagaaagaagaataggagaatcacttaaataaagtccatcactaggattgattgaatcttggctctgagtccaggcaaacctgccaaggcaaacagcttttcctaccatggggtcactggtttttcattcctctccaatctacttcctggtgtttgcccaaatggcaagttgaaatgtgggatggtctcctgggagggaaaagatggggagtgggctacagaaaaggcaaaaactatccctcgctctgagagatgctagagtgagcatcatcagaatcacctggaggattgttaaaaatgcagactgctgggctccacccctggagcttctgagtcagcagccatgagatggggcccaggaatctgcattggtttttatttttagagaccaggtctcactctgtcacccaggtcagagtacagtggtgcaatcacagctcactgcagccttgaactccagggctcaaaggatcttcctgagtaactgggactataagcatgagccaccacaccacctaattaaaaaaatgttctttagttttgtacagatggtgtctcactatgtttccaaggctggtctcaaacttctggcctcaagagatcctcccaccctggcctctcaaagtgccagaattacaagcatgagccactgtgcctggccagaaatgtgcatttctaacaagtccccaagtgatgttaatgctgctggcctggggatcacacttgagaaccactggtttaaagagcctgagggttgggacagggtgggttgtttgatttgtcaccttggttattcacagtggtatcttttaaggactctttcttggatgacgtctaaacatcctagaggcccagagcagccccccaaacccactggagctcaggtggaagccagcaaaattggcacaggcctgtccaagacacagcggagtagggcaaggtggtcagcactacttacagaattgctgaggtctcttccagagctgtgggtgcttgcaaaatcaagaaaacaaaagcttggatagcaagaggcagcacatttcagaggaacggaccccaagtggagagtcagcagaccccagctgaccaatcccaccactcacattttagtggattagactccaccattaacctttagcataaacttgggtaaaatcattttacttctctggatcccagcgtagccatttgcaaaacgaatgtgttcattcattgagatggatccgttcatttcagtctccctgcctgcaatggtgagctacatctgcatcttcctatttcctttccctgtctttgaaatccagtagagaagcccagaccgcacaatgggaacatcccacctctcagatggcaatgctgcccaagccgctccacccccaggggccttgcttgcatgtgcccgaggccagccctgcagggcagacagtagcacaagagcaccatcttggtcacaaagttgtctaagctcaaagacagccccggaaaaacacctgacacactccacaaataataatcagcagatcttcatgccatcccatgtgacagatggggagcagaggcctagggggctgctggcccctttgctgagagacccctgacaaagttagtccaatgcctctgcaaaatcgcagcagttgcacctcactcttctccctttatcatgttctcggtttgtcctctctgaaggaagggggtgcaggtcacctgtgcttcaggccgagctacagaccatcttctccttgatgcctccccagcccagtctagccttggccttcctggctctccttgcctcaacattgatgcagcagagctctgcatgagaatgacccacgagtgttcctacctctcctcctcccctctgtgagctcatgtaggacatggcccaaaacgcatccaatctctgttcaatgactagtgcaatgcctgacatcagggggctcagctaaacacacgtggggcacacaaatgaacagagagatggaaagagctcagccactgcccggatgttcaaagactcactcgccagactggaactctctgcacagaactccgcttcagcactaacaacaacagcaagagccagtggtcaccgagtgcttgcccaggccggggtctggtctacccacctatcagtagatgcactccgggacacctctaacagcctagaaggcagatactccaataatgacacccagtttctagatgtctgggagcagaacctttctgtcccagaaaggttcaagtcccacaactagtccatggcagagcgggactttgatccaagaagcctggctcacaacatataaacactaccagaagcaaaacgaaccacataagcagaacaggaggcctctgtcttgggggttccctttctactggggatagctgcttttcaggcctgggggcagagaagggtctcactggccccctttccctccaagagctttctaggtataaagggatttagagagggaagcatctctctgatccatcatagacagttccaaagtacaaagctaagaaagcaaaaaaaaaaaaaaacctatgtccaaaatccttcatcctcgccatcacatgattctctccaaagcaaaaatagaggcctcatctctctggacctgatagtgtcaacaagcacagttcaaggttcttgcttattcccatttctgaccctacctatttatccaactttctacacctgaatagtctctttctttttttcagctttctaggctttatgtcaatagcaggaaggcttgaagacagaggggccctggtggcctgctctgactccggcccttggcgggcacgaggtccagtctgagcctgggcccaagccacacaccttccccggcataagatgggcagcgctgggcttccctcccaagtccaggggagtgcagggggagggctgacggagctcatacagttttcctttgtggggtgcagggtcgggggatggtgcggcaaagccctgcccgaggcacacaatcatccagtgagatgacaatgtacaccaaacaggatgcagaggaacgctggcctctcaaagctgaaaagtgtcttgacctgagacaggtctggccaaagccaagaatctaaaaagctaagaggaatcagcacccggtcctatgtcaaagctggccttacctctattttctggaattcgcactccctgccctactccgctggcacgcattcaaggcagccaggtggcaccggcctcaagctgaatgccctgactccggcttccaggtcctcagaccctccctgggtctttcctttctctcaagccatctggagcctacacacaagtcacggggcagaggttctgagagctgaagggagcaagcggcaataaaaacccatacgaccccaactctgcacgccctttctacttcttcaggaagccatttcttgagaagaaacaaacaaaaagcttccctgtggctgcaggagctgctgacccatggggccaaattagcacctgcagagggacaaacagccccagccctagaggagaccacagaaggctgctggatgggcaaagactcagggcacacatagacagagctttgcaggaacgggtgctcggcccacattctggagcgcctgccccaactcccagaagcgttcctagcatgcagaaggcaagtgctttctaagtatctctaccaagtggctccacaacagacagattcttttaatgttccaagtactctccagggaccgtgcttctcttcctactgaagatagtcaacatccaggtttgggggccaaggctgagccctgtgggacaggcccgtgagctcctagcaggcatgaccacctctaatgtatgcagctccctctcctctatttccttttcctgcctctcctgccacctgccaagtgctcctacctcgttcatggccttccactccgtgcagggagggagtgggagtcctctctcctgcacctcctccccaaggcctccagtttgcatcaggggtgctgatcacagccccacctcaccagccttcaccagcaagctttgccctgttacacagctgggcacattcgggggccatgcaggcccttcaaggatttgccagtggagtgggagtgcagtgcccctcactccctcagcatggggggattgatgttgcagccacagacaggggaaaatgaaagacaaatgtcagcttgcactcacccatagctagaggcaaagtcccttcagagcacagaagggttaagcccatggctgccatccaaagagttgagacacattgaggatgcggaggcagctagtctgtcctcaggtgctatccaagcacccttgtggctcctatctcttgtgaatggatgtgtacacaggggcataatataaacaagtcacagggtcaatctgtcattgactgagggttcactgtgaagccatccctcatatactgcacacaccctggctaagcaagatcagtaacctgaggagctgcaatgctgtgtgcaggggaaacccccacaccctacagggtgatgaatttcatatacatggccaactgggaaaggcacagtctcaagatctaggatcccctcccaaccttgctgaccactctctggtgttctcgcctaccctgatcgtgatttgtccagagcacctctggcgaatgcatatgtcgtgcctcatggtcaacaaataaacaagtttcaaagggtcctcatttgtctgaagagcctgaaatgagctgctaggacaattcacgagacagctggagaccttcagagcactcagggccaagggcgcaaaaggtggcccctccattcctctcgtcaccctataggactgggttgctaagggccttttgggtagctgtttggttgcctcccacatctgcctctcactgtccctggtttgcctgcatggcaaagggcctctcacccaaggtgttcagatgtgtgcaccttgtagctctgtgttttgtaatgttagaaattaggttttggccatgcagggtgactcaggcctataatcccaacactctgggaggccaaggttgggggatggcttgagcccaggagtttgagaccagcctgggcaacatagcaagactccagctctacattttttttaactagtcgggcttggtcgtgtgggcctgtagtcccagctactcagaaggctgaggtgggagaattacttgagcccaggaggtcaaagctacagtgagctaagattgtgtcactgcactccagcctgggtgacagagaaagaccctgcctccaaaaacacacaaaaaatgcttgtttggaaatctgaaatagaaaaaaataaataaataaaataaaattttaaataaaataaaattttaaataaaataaaaataagctcaagcatgggaaagcattttgaacatggcaacctgttcctcttacttttaattctgtattatttggacattttttattttatacaatgtgaacacattgcctttttgaaactacatattcaaaaatattatatacacaaatatatgtacagagttatatacatgtttaggttttattcatccattcatttattttattttcctggctttctgtacaattttaaagtactgccctgccttcaagaaaagccagagacaagcaaataaagtttttttgcactgatcgggccaaaataactccagctttagaaattttgattcatttccctatgttctttcaagaagctctctgtggctatctacgatctcattcttcttcattccactccaaaagaatgaagattccaacgtatctcacagataagaacactgctgaatttagattcttgcttttattacatgaccttggacaacatgagtctccatcctgtttcttcctctctttctagatgtagatttcaatatctttattaagtttcaggtcagtcatgtccttgtttctccttccctttgctacaataaaaagtacttttccctgacaagtgtcagaattagaccaccaggtaggcgtcacatctatctcctcctccgagtccctttcagagtgtgtgtgtctcccatacaatgggagtaggatgatctttaggccttgtcctgcgaataggtcacattctctgcattagacagagctggtggccagataggaaacccccgtgagaccatctagacagaaaacgtgcaggcccccgattgctgtttcagccatgctcaagatttacttaaagacaatccaatgaagtgatcagaagatcaggccaaagtcagcggctgaacttgtaaaaatcattcagatcaacgctatttttatagaaactaaaaaaaaaaattaaactcctccaactttctttttttttttttttgagacagtttctctctgtcacccaggctggagtgcagtggcacaatctgcctcccaggttcaagtgattctcctgcctcagcctcccgagagtagctgggattacaggcacccaccaccatgcccatcttatttttgtatttttagtagagacggggtttcgccatgttggtcaggctggtctcgaactcctgacctcaggtgatgcacccaccttggcctcccaaagtgctgggattacaggtgtgagccaccacgcccggccaaactcctccaattttcttgtatctattgatgagttgggctaacacaaagagttgattagagcttgttactttgctcagcctgactgttccatccaacctactgctgtacacaaggtgtcctagctgggccaggggactctctgggggattgcctacagctcccaccagcattacctgtttgccatggcaaactttaagattgtcagcaagtaggatccaaacctaggcctgcacatctagagtggctgacaggagcctcatcactgagtgaagatgggaagctggagaatccaagaataataagaaagagtctggttcattagcccagactcagatggaagaggagaaggagaacggcagctccaggtgcagcacagtggctattatggaaaccggccacactgtgggaagaaagtgccaggtaaacaccctgaagagctctttcactagaggctgggacacaccagggcccggccaacattgctggagggcccctcccacattgctggagggccccctcccacattgtctgagcccctcccacattgctggagggcccctcccacagcaaaccccactcatgcactgggcacagtgctctggtggctctgtgatggctgagagcgtcagcagggaccctcagtctggcaatggagctgccactcaggagatgctgggctgcaaatacccacggacctccagcatggctgacaacagccaggacagcagctcagggcagcagcaaatgaagtgacctgcagggaccacacctgctcactccacagagcccagcctgcagggcccacacctgctcgctctacagagcccagggaaggtggcgtagggggaggggtctcccctgcctcctctgaagagcattcttaggtgaggcagaggcaaagcctctgggagctgctggtaagcgcaggcaagtgcaggctggcaggctaacatggcctgccatcatgggtacccccaggctgcaaggccaaggccgatgctccagtccagggagaaagtacagagtcagtgactcattgagttcactctgcccttcttccctcaggtcagacactcactcttccctacgccccacagatgcaccgcaagagtaagtggaggccaagccagcccgacactcagtcccctccgcttccgacctggtggcctgtgctgcctggttttccacaatggagttccgggtgagatttcctctaaagaaaaattgtgcttcgtggcacatgagtgtttaacaaacacgaacttcacatatagatgcacagaatgttaaagcacaatgggatttaagaggccatctaaccaaagtctcattttaccgatcagaaaactggggcccagagagaaaatgaagcccccagcccctcagccgtcagcatctgagctggcaccagaaccaggactcccgacttcctggagccactgctgtcctccgcccctcgttccccacgcactattcccttcacacactcatttccggaagggtgatgccccagcccctcgggttccagccccatgggctcaatcagcctccctcatttcttccacaaatgcaagcaagccactccctacttccctgccagaataaaatgccaaaaaccagagaactaagccccactccaggcggaagaagtgcagccccagcttactatcagataagtcgtttcctaaaaagaaatgcggctgcagtaaggcaggaaagccgggagccagggaccctgaggccagcccacctggcctcacttttcccaggaccacagtcagatacaacagcagggctgtggcccagccccccaacccttccaactcaggaaatgctgagcccccgtgagtgccagggagtgcccctgccatgcctcctctgaagagcattctggggtgaggcagggacctaggacagacaggcgtgctcagttagctcgagcgggatggaggctccaccggatgggatggccaggctcaggctagggtcgggggtgccaatgatccctcccagccgcctcagaagtggccaccctttggtgttctctgcggagttttggggtatgggtccccaggaactctcaggctgagggctccatgggaggaacaggcaacgtttccactccaacccagggtcctcattctatggaactgggcggggggagggggtgggtgggtaaagcagaagctcatagttgccagccggcccagacccgattcctggcatcaccccacttccaaagagcgtcgggaatggggggacagggatggggacgatgaacccaagagagagaaacactctgtgttcctccctgggcttgcctattcccgacttcgagtaatcatccaaaacaaggaaacctgccaggagatacattaagtctgtaagcgaagaagcctccaggcaaagagctgtcagtcacagggaaaacccaacacaatacatggattctactcctgttccgaggcaggggcggttcccgctcaaccttcccaccgcctcccccgccgcacaaacacagggacacaactgtgaaggcaaaaaaggatttgtttttcaaagtcaccaggaaaatcaacaccaagggaggcagagggagtgtggggccagtggctcctccttggataaaggaagcggggcggggggagggggttcagccctgggcctggacttcattccatgtccatgctccttgctgccaactgcaggtccgttcccaaagagtcacagccactagaatgctccaggccatctggccttcctctccaagacacgcaacatggaacgactccaggattctgtctttacacaccctggcgtcatccctttcttcactgaagagggggtccacacacgaggtcgggggcagctaggaactcatttcaagggtaggattcatacgctgctggtgacctaaagagatgggggccctagctggctcctccaccttcttcagaaagatcatcttacatctccaccagaaggaaggttcacccaccaacacagccaacttctggagagaagccagtggccagaaagcacacagtgagtgccccaagcgtggcatctgaagggctgaaaaagagtcctgtgggtcatgcctctggcttcctgcccagtgcaggcctccaggtatcgcagctaagaggctgccaggtctctgaataacgtctacagtgggaccctaccacggaacaaggcagcctgcccctctgctgaacaaggtttcatttcctcaagcccagtttctccggtgccacacaggagtcttccctttgctggactgcacagccttggccctcacatctgttttcttcctgacacctgcagtcctaaaaggtggacatcctgaaacacacaggcttgtccacttgaaggggttatatagggaagagaatggccaggccccaggaaagtgggaaatgcctgggaatgacaggcgtgccagcttgttttctctcacctcacagctcctcttacacaaaatctctgccatcggccaccatggccgaagcgatgctgagcgctcattctaaatgctggcatcggctcggaggaacgtcatggagagtgggtaagagcaccaggtcatgtgccactgcaggctggtggccccgatgcatccatcccacctgcaccagggcctgctgtgggctctgttccctctttaggggtgagcctggctctacatctcaagcctggatttttcaagcatcctttctgatttgatgctttcgatctcagggtcttcagctaatatttgctctccctgtgagtccacagagaaggtgagggaatagattcgtgtgtattataataacctctgaagttctttttaagcttctctgagaaatacattaccattactatcctggcttcaatttggtatatctataaaatgcattcacctgttacagtttaaggaaagtgcagcatgtgtcacaaatgctttgagggaagggaccacaagggatgctgacagcctccacataaacaggaagcccttccagggatgccacatggagctgtaagagagcaactgggactggccgccacagggtgaatgacaagttagaggagaactgcactttgtatgctggacatggcagctcatgcctataggcaggaggataacttgaggccaggagttcaagaccagcctgggccacatagcgagaccccgtttctataaaaaaaaaaaatttaaatttggccaggcacagtggctcacacctgtaatctcagcactttgggaggccaaggcaggcagatcacctgaggtcaggagttcaagatcagcctggacaacatggtgaaaccctgtctctactaaaaataaaaaaattagccagttgttgtgggacgtgcctgtaatcccagctactcaggaggctgaggcagagaatcacttgaacccaggaggcagaggttgcagtgagccaaaatcgtgccattgcactccagcctggatgacagagactccatctccaaaaaaataaaatgaaataaaaataaaaataaaaattagctaggtgtgatgctatgcacctgcagtccctgtacttgggagactgaggcagaaggatcgcttgagcccaggagttcgaggctgcactgagccatgatagtgccaccgcagtccagcctgggcaaagagaccctgtccaaaaaaaaaaaaaaaaaaaaaaaaaaaaaaaaaaaaaactgcaatgcactttgtagtttccaggactcttccatacactctcatgtctacacaccagctctgtgggggatgcatgatggccatcatttggcaaatgagaaaactgtggttccaagcattgcccttggccaaagccatgcgactagtaaattgtggggcaggaatgaaaactcagttctgagttttagaaagtaactgcttccaaactgcttccccatagcaggctctctcctaccctatgcagcggaaggggctcctatgccatccatctctgggtttctgagaacagaagggaagaagcagcagctcagagacacattcaggagaggggctgcaaatgcggggatcagcccaagaagatggcgctggggccaggatgtccagcagtgcccagccctggtcagagaccactgatccacagtttatgcaatgcactgccctttgcagtggtcctacgccctccaatgcacccccaactcaacccttcaatgaatgcgtccaactcagttttcatctgctccaccctctcaggcacatagcgacttctcttccccatgcacccaaggtgaaggccagtgttcccaggggccttgcctggggagcaggaggtgccaaccaagatatcacacctagagagcaagtcacagagtttttgccacagaccaaaaccacctaactgcagagctggaggacactcacagatcacctatggtgaccccttcaactcgcttaaggaaacaagctcagagatttgaactgactggccaaagtcacaaacagttcagtagcagcgcagaaattagatgccaggactccagaatctgtgttatttttttcttactccatattttatcttctaacgcagaagtctttgtttttgtttcttaacaggtgggtaaactgagccaccgagtgcttcagtgacttgcaggcgctgacacagtaggtggtagaaccaggcgctgggctcacgcctgtacagctcctaaggctacacgtgttctttccaatgcactctttaaatcctagagattacagcaccgcctttatgtcaatccctgctaaccgctggaatcctctaaggaagtgactcctgcccagagaaccagcagttctaaatggacttgctgcaaacactgaaacctaaacaaaagaggtctatttggcactcaaagtaataaacaaaataccaagaccataggagtgttccccaaacttacaaagatggcactcagtttgtataatggcatcaatgcagagaaatccctcctgggcttctcagaagctcttctggaggatagtggattagcagcatgctctagacagtgtctctctcaagtgctgggggaggaagtgaccctcgggcctcaccagtggagaccaagtccctgggaagcccaggccagctggaaaaggcagctgcccagcacagccaggctcaccaggcagatgtgctatgcacacacagacagacgcacaggagggcacacgtacacagctcatcacaccacacactacccacatctgtctacacccacacctcacagactgacccatacacaggcaaacacagacacaaacacacatgtgtgcacagcaggtggtcccttgtgtcccccaactacacataggcatcgacagacacccatatctcgcagatataaccccacgtgcacagaggcataaacacacaaaccacacatgcacctccccttgtcccttattgtcactgcagcctctcctgcctccctctttcagggaagctccagacacctgggctaacccagccctgaaggccctcataaatgccattcccagtgcaatgctttggggctggctccggaggcactgctcctgctgcccctggtcaataacaaagtctggagagaaaagtcaggaccatttatgatgggtcctaatgacaactgctcttggtaatggccagctctgcggtgacctaagtatgagctgattacaggctctggctcccgctctgcacacgcagaacacaggtgtcccgggggcactgaccgcagcagatggccccttccctgacggccaggacagctgtgctgacctcatcagccacctcccgagggctccttcaagtgggtggccctgagcaggcccagacccaacaggcaccaccctgagccctctcatacgggacgcggctccagggctcctctctccctcccaccctcactcagagactccctgtccaaaatgtctcaccactgatgtctgcagttctgccattaggacttcattatttgattaatgaggtctttgtcttcttctcctcctcttcctcgtcttttttttttttttttttttttttttttttttttttttgagatggagtcttgttctgtcacccaggctagaatgcagtggcgcgatctcggctcactgcaagctccacctcccaggttcacacctttctcctgcctcagcctcctgagtagctgggactacaggcgcccgccaccaggccccgctatttttttttgtatttttagtggagacggggtttccccatgttagccaggacggtctcgatctccggacctcatgatctgcccacctcagcctcccaaagtgctgggattacaggcatgagtcaccacgcccggccttttttgaggacttttttaaagatataagacagtcatgt

SEQ ID NO: 372 - DNA, 2555 bp, Homo sapiens
ctcctaaaaggggagtatctgagttttctgagagtaggtcagtcataatctttgtttttcccaagatttaggacttagagaattcagtagatagacaattgaataaatagtacaatgtgataggatacaattaaagattgatgctgttgtgttcaagaaaaaataggcttttcttagttgatgatggagctgaggaatagtcgtgtctagcttctgacctgggaaatggcaagagggctctgggggcctggaattcctagggacggaatgggagttatcagtggggaccagtgccgagctgacacatgtctgtgtttgccagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtgagtagaggagcagggctaaggaaaggaggaccgtttccttctttatacacacacacacacacacatacacacacatatgcactgatgcctacaaatatttctacccaaatacaacacagacttggatgctcacacacacatttggacaccccacttggacactcacacccgcatgcaccctcagacacactggcaccctttcccttgggctcttacatctgagactgccccagtcacttgtgcatttgacaccactcctccaatatctggaagtttcaacaaacaatttgagtatctcctgtggttttccaatgtaggtggcgtcccccaggtgttcctgacagcatcatctgggacagtgcagatccctgtttcagcagttcagctccaccaggtaggtagggatatctttcaccccatcccagatagccacttctttgtcttgaccttaggggatcctgttaccagttcatcaaagccaaaatccctagcctggaagcccatctgcttttctgctcaggcctgtggttggcaggcagggaagccaggggagcctgaactggctggccagtccctgcccctcctcatacatccccttccctccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaa

SEQ ID NO: 373 - DNA, 85921 bp, Homo sapiens
agcatctgaaaaaatgggtaggtaattggcaaaaagaaaaataagcaaatgaaggggaaaaatctgaagctattattattattattattattattattattgagatggagtctcactctgtcacccaggctggagtgcaatggtgcaatcttggctcactgcaagctccgcttcccaggttcatgccattctcctgcctcagcctcccaaatagctgggactacaggtgtccgctaccatgcccggctaattttttgtatttttagtagagacggggtttcactgtgttagccaggatggtctcgatctcttgacctcgtgatccatccacctcagcctcccagagtgctcggattaccagtctgagccaccgcacctggcctgcttttattatttttaatctacacataattgtatatatttatgggatacagtatagtatttttatacatatgtacaatgtgtaatgatcaaatcataattagcatctccaccacctcaagcatttatcatttctttgttctgggggcattgaaaatccactcttctagctatttaaaaatatataataaattgtcattaattatagtcacccaatagtgctaaagacactagaactattccttctatctagctgtactctttttttttccccagacagggtcttactctgtccccaaggctggaatgcaatggtgcaatcacaactcactgtacccttgacctcttgggcccaagtgatccttccacctcagcagcccaagtagctgggaccacaggcgtgcaccaccatgcctggctaatttttaaattttttgtagaaattggatctccctatgttgcccagcctggtctcaaactcctgggctcaagtggtcctcccaaactgctaggattacgggtgtgagccactgcactcagccatgtactcttgtatctgttaacctgttagccaacccttggctaccccctcccccttacccttcctcaccgctagtaaacactattctaagcaaatagatcttaaatgttcttaccacaaaaataataataataaaagtatgtgaggtgattaaaatgttaattaacttgatttaatcatttcacaatgtatgcatatatcacattgaacactggaaatatacacaatttttatttgtcaattatactttaataaagatgagggaataattgaatataatgttaaaacaaaaaacaattgcaaaacctaaagaaaattaataatctagagcagaccagccttttatacatgaggtcactgaagtgcagagaggtgaactgacttgtctcatcttacacagcaagtcactggcagagcttgacctgaaacccaaagccaagcgttttctattacctccaggtccttcaggccagccctcccagggctcggccttgggaattggtattggtgacaaagggaataaagaggaacatgcatagagctctccatttagattgacatattcacactgtgccagggcatcagcaagaaacagtgcaggctccaagcgcttgccccaaccccatcctctctcataaccaacttcagctaaaaggtctgagaagataagggaatcttaggtgactctcactagggtgtaaatgactcccaccatgatttttatcttatcaagacataactctaaaaacagtttgatggatacgatgccaggcagtaggatgaagacagatggggaaactgcctaccttaggtcaggagtttgagaacagcctggccaacatggtgaagctccatttctactaaaagtacaaaaattagccgggtgtgatggcgtgtgcctgtaatcccaagctactccagagtctgaggtgggaggatcgcttgaacccgggaggtggaggttgcagtgagtcgagattgaaccactgcaaaccagcctgggcaatagagagagactccatctcaaaaaaaaaaaaaaaaaaaagtcagaccaacccacggggaggcagagggtaggtgaggggggtgtggctgggtttacggtggtgcactcatagagtcggcttgggaacagggagctgtgtgtgtgtggaagttaaaagataggctttggagggacctggctttaaatcccagctttgctgtgtgaccttggacaacctgcttaccctttgtgatctcatatgcaaatgggggtgataatgcatacttcacaaattgtgaggattgaatgagacagcatatagaaagtactaaatttagtgattggcaacacactaaaaaataactctatacacccagcaccctagaccagaaggcattgtgctgactcccagaatgcactagaaagcagtctgcttcttcccttcctgcccttcctctcctctcctctgttctcctttcctctgttctctccttttttctctcctcccctgcccaccctatccctcttcccttccccttcctctctcactctcctctcccctgattccagcccatttagtatctaggtgactctatcccaagcttcttctcctggtgcctttgtccccatctctccaagccaccttgattgtctcctctacctgacagggtcaccctgctggctgcaggctggagggatttatagcaattccctccctccttgcctgcacggggctaccagacagccggaagatatgtgggttggacacagtggggccctgggagaggcaaataaatacatcaagttcccagctgagtctggagataaggacgcaggaagatggggctgcaggattcacagatgctgcactgcacggggtcactcttcatagcctgattcctctggcttccccaggaaagtctatttggggcactttgaagaggacacagaagaggacagcacctgagcaatcttttcctgggaggcgctgcactgaggcacccttcctcagcttggatttggtagggacaggcttgaggagtgagaatgtgacagacccaaccccaagatgaggcaggaaggagggaaattgagccccacagcacaggaggggaaactgaggctgagaagggagaaagacttccaaagtctcacaggaagtcagtgaagagaagttacagtcccctaacccctgatctaccactttagacccccttacactgaattgtgcctggcttcccccagacttggccatttgaactggccttgcctgggtacagaattccaggtatctctgcaacatgccaggatccacctcagggagggttctcctccctccagatctctgccccagccagctgcctgatgagatgccctctctatggggcctgatttggggtcagcatcctattatagataactcaagggtacaacatcagtctctcccacacatggatgggattctgttctagtgcccgtgggcaatggagtgggggtacgggggactaacgcaggagacctgaagtgggggcgcctgtcccatccaccccagagacagctgcccttgccactgtcgaggccacacctgcccaagagcctcaagggcctcctaatcagcaagctcacccacagccaccaggcttggcacgtccttgacccagactgcccagataggctggggacatttcccattcccaactgctctgtgacctctctttggcctctgtctccctcccagtaaagtgaaagggatagaggacctccaggccccaaactctgatgctgggtgactctctgatccttgaaggctgtcattgcatctccctaaggtgggtgcagacttcacagagtctttccaggctactagagctgattgcctacaggcaaggagaggggaaagtgcttgggagtcccatcccccaggggcagcccttggccaatgtctgactgctgtgcatctgtggaagtgagcttccctgcctctcattgggacaaacaggattcattttcattctggagcttcctgggatcagtccaacattgagactgtgcctgaaatcacacctttgcttagcttcttcctcttcctttcctacttccccttctctcttctggttgtttttcgcttgggcagttttttaaacagccacctgcacacaaaacattgtctcagctctgcttctgggaagccactttcaagagtaaatgaaaacagtctattgaaagcaagagactgaaggtctgagggaaaagtcagttttatttcagcccaccaagtgccctccctgtgctgttctgggctttgatggggacagtggaggggaaggccctgcgcagccccccaaccccaggagctttgagtctgggggatggaggaggaggaggagactctgggccagccctcctgcggtctgcaggaggccacaggaggtggtggggggttctctgaatgtgtgtttattgtggcctttctgtgtcctgtgatggccccacggaatggaggactgagagttgcagagcaggaaggggtggcagccttgttctttcctggtcaatgtgccaggctcccaaaatattcagtgatcagattttaacctcaaatagcagtgccccaaccgcccctgaatcttgctatggaaagagcctttggtaagtgttttgaagcaggaagactccctctgcccacagagcagtgcacagcagtttgggggaggggctagctcctgggacccaagcgggcctcaagagatgaggcgggaggcgggttgcagtgtgatgggaggggagacacagaaattgccaagggccatgaggaagagaggaagccacaaccccaggctcccaaggagggtgtcttcctgcaggaagccctgtcagatggcagcctgcggcccaaaagccccaactcaacctgcaaactggcttcttctaaggccacagcacccaagggcctcaagacacacatctagcccattcccctaccattgcatgggtggaaacctagaaggagagagggcaaggagttgcttaagaccacttagagagtttgtgaagctggagtgagctttcaggttgtggagctccaagcccagtgtggtctgccccactttgcactgccccacatttttcctaagaccaaggtagaattattcctcctgttttccacctcaacagtaaaagtgcctctcttctctgccatgggactgggagacatgttcaggatgtgaagtcatatagggacatctttgagttcataaacatctcctgttcataaatatccgactaaagactgaagcttccactgctcccaaaatagctttggatcccagcacaggcatttccaagaacagatttttatcctttcaagaattccgtgaaagagctgggtgcgatgtgtgcctctaggcacagctacttgggaggatgaggcaggaggatcacttgagcccaggatttgaggccagctggacaatacagtttgatcctcagcccaaataaataaataagtataaaaataaatcaatcgatccaagaattctgtgaaagcaaagaatcctctggtttgtatgcctaccagagtttcctgaagttggtcacacacactgccctgaccctgactgtgatctcagactgtggatatagattggtctaaactccagataaggaagtatctagtatggtccattataatcctggtcattctcatttcaattcattttgatacaatattaggctactctgaacatgcaattccccaatccttctatttaaaagggatttcttgcttgtagtgagccttgggattgactcctctatagccatatcagggccagataattattctgaaccaatcagtttcatccccttcaccagtgactggttcagagataaacagtcctatgacaataggtgtcaagacccaggggagaggctgtggcttcggaaaagagaagcctgtctttctaacccactagtctgttaacattacgtttgtggctgggcacagtggcttacacctgtaattttcagcactttgggaggctgaggcggaaggatcacttgaggtcaagagtttgagaccagcctagccaacatggtgaaaccctgtctctactaaaaatacaaaaactagcggggtgtggtggcacgcacctgtaatccaagcaactcgggaggccgaggcaggagaatcacttgaacccaggaagtggaggttgcagtgagccaaaattgtgccaccgcacttcagcctgagtaacaagagtgagactccatctaaaaagaaaaaaaaacaaaaaacacaataggtatgtttccttggtggctccggaagccctccagtgacaccaaggcaccaagggacccagtccttgggctggaagccctattaagggtggcagaggggagagatgaaagaacttgcaactgctgatgtcactgagccgctgaatcaacagccgggaagccagccttgcttcctgctttgtgagacgatacacttaatactttccatccttgggggtgggaatcttgttatttgccgatggaaatattacacatcatccccagcccccactcccctgcctcacccggccctaccctttaccatggcaagtcctgccacggaggagctggctgcctcagaaaatctcttggggaaaccagtcctgcctgaattggggtgggattgccaagcattttgcatcccgccccccttacttgttttttggtgtttttttgttttgttttttgttttcgtttttgtttttgttttgagacagagtctcactctgttgcccaggctggagtgcagtggtgtgatcatggcttatggctgcctcgacctcctgggctcaagcgatcctctggtctcagtctccctccagagtagctgggaccacagttgtgtgccaccacgcccaactaatttaaaaaaaatgtagagatgaggtctgactatgttgcccaagctggtcttaaactcctgggctcaaatattccttctatcttggcatcccaaagtgctgggattacaggcatgagccatcttgctcagccatgttcccctttgaatgcaggagtatcgcctcttccaggcaggagttcctcttattcagtgagacaagcacagacccagataattacatgagctgccactggaagagctgctgttaattttgatggcaataaaaggccttgccagtacgttaagctaatttcatgaaaatgctgggaggagggtcatgggctggatcccagattattaataatgtcgagcttcatttgaaccattcagaaaattcctctcagttgcctccagcaaactgcaacaggttgctactttcctctgaaatcaacagtcttctcataggcaaatgtggatttttttgtttttccctagaaaataattaaagtcacaaagtccaataaatacttaaacagaatgtagttttaattaaaaaccttccaccaagtctgcagttgcgggtctctctttgcaaacaggcatgctgacaagcatcagtctaagtatctgaaactagaaacctttacaaataataatagtaaatctggtttctacatatacccatggtgtgtgtgtgtgcaaagggggtggtggtggtgaagaggtctgggggcagagccaaggtgctcccctgtggaggaggcaggacacaagcctgtaggggtgtgtgcagcagaaccttttatcaaacttgtgtcccactctgcaaggcaataataatggctaattcagctattatataaaaaacgtatctcaagtactgagcactaagtgtcaggtactaagtgctttgcgtacattgattcatttaatcctcaaggtgaccgaaaagcataggtatttttttttttttttttttttttttgagacagagtctcgctctgtcgcccaggccggaatgcagtggcactatctcggctcactgcaacctctgcctcccgagattctcctgcctcagcctcctgagtagctgggattacaggcatgcaccaccacgcccggctaatttttgtatttttagcagagacgaggtttcaccatgttggtcaggctggtctcgaactcctgaccttgtgatccgcccgcctgggcctcccaaagtgctgggattattacaggtgtgagccaccgcgcctggtcagtactcttatttatgcctttttttcttgaggcacagagaggttaaatagcttggctaaggacacacagtcagtacataatggagtctgacgctaggacctgcccgcctgacgactacatagaacctgtacaaggaaaggccggaggagggagtataaacagggcctggcttccctgaggagtgatctttcgactggaaattagaaaaggaaagcagcttcttgagggtgtggggctggagagaacatttgtgtgtgtgtgtgtgtgtgtgtgtgtgtgtgtgtgtgtgtgtgtgtgtgtgtgtgtctgtgcgcgcagaagctgaaagatgggaagtagtgagtgttcaggggcttctgactggagggcagccttggggaaggtctccgcagccttaaccggctgctatgctggggatgtttgatgcccatctgggccccggctttcttattctcagaggcccttcccacatctttaggcaagtccattaaatcctccgcgtgccacattaaaatacaagggcaagtacaactctgagtgcagttgcaacagaatcgtttgcacaatgtcgcatgtcttaaacattcaatcaaacatcgattacttccaattttgcagttttctttgcccctgttagcgccaacagatttttttttccagatctcagacatttattttaataggcccctgacaaagtcataagactcagagagaagggagagtgggagaggtgtataggaaggttttgtgccagggactagtcgctcaagaattaggagacgccctgggcactggaaactacgcagcgcgaagtagggacagcgcctgtgttgtgtagtggaccagaggttgctgatacctgggacatagactgggtgggcacgggaagtaaagcctcgggactttggttaagcgcgccccactggcgtatcgcgccgcgggactgcagagccgtgagcagcggtcgccttggtgcagggttccagccacatcttcctcgcccagccagcaccctctgccgttgacccgcctctgcgcccggcaagcggcttccagcagggggcgcgcgcggaccaggcttgggccctagaacagcgcggatggagtcgctggagcaagtccccagatccaaccggtttcaaccctccccaccctcccgacgctccgggttcgcgacgttgaagttaagggtcgatccgcagaaagcggccaggggctccagctctccattcctgggtctgtctggggtcggctccagcctggttagaagccttagtctggattcggcagattctgaatctgggaccctctgcgctagcggcttggaaccttgtcaccctcccctcccccacccctacttccacacacctgattagttgtctgtttctttaatgatcaaagacgtgggcggcggcgggatgaggtcttggttcccggctccacagccctccctaactgtcattattaacgttataaacattagacccgcttctgcgcgccggacggcgccggacgaggtgcgcgcagtcttctagctgagctcggaggcagatccagaagtcgcggctcccaccccaggcctcggcggactctgcctggggcgactcgggctccagccctgcccgggcgggcactgggctctccagggtcgaaggcaggggtaaggggcgtctttcccccagggcagcctccgggaacaaaagcatttgctgtagagtgagctagagcctccgggcccgcgggagtcagctcccgcccaggggtggtcaccgcgtccttaaccaccccaggagccccgtctccctgccgaactccttggcttctgcaaccctgtcaagacagcaaggaaagggggtcttccctggtcctcgggccccgaagtttcggggttgcttataggacgggttcctgcagtccagggaagctctgggcagatagcgagcccattctcccttccattacccagattctgcctccctgcggaaggcaaaaaagaaagaaagaaaataggtaaaaaccggcggagggccttgagcctccccgcctggcgcccctcactcagtcccgaaaagtcccctggacacgccatgccggaccggactcagctcccgctgctgggcccctgcctccaaatatccttcccaggcacaggctcccaagaccgccccctcagggttcccaacacccggacaactgcccaagacgccgctccccgcccccacccccaccttgttcggcagacaaagaagggtgtgctggccccgccgtctgcctccttctcccgaccccacaaggcctagaaacctcagggactcaccccgggctagggacccaatcctggctgtcccaccacaggatccccggcagggacgggtcacagtgctctcacccctcgaccattttcgaagacaccttccctgaaaggcgccttgcgccctccccatgggtcggcggggggggactccaggcccgagcaggcggtgtgaagttctgtgttctgaactggggctgagcaagatgcgatggtctcagcccgctgggccgcccgtagcgacggcaggagtaggggagagggagggacgcttggagtgtgagcgcaccagtctgttcatatttaatttacaaagcagcctcggaaccccgggccgggtggtctctttagacgctgcgctcttagcctgtctctcttccccaccccctcccctagctcattaagatgctcaacactcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaactgggctcggtgactttttgtcaggggacagagggaggaggcctgggcgatgaaggaggaaaccgcggaaggaaggagcccccccagagcctcccgttggaatcttttgagtgatttcctgtttgcgtgaccatcctgtgatttttttgccaggtgtttgcacccagccctgctcttagtgtctccaactccagggtggggtgacaaaaaacgagggcaggctgcaagtgagtagggggaggttgcaggaaaggaaggcgggtgtctgcagaccctgaacacagggagtctgagtgtgcgtgcaagtatatttgcactcaagggtgtgcggcaccctctttcacttgagactgtctgtgtagtggggtgtggctgtatatggtgtcacactgcccagtttctgtgtctccacatcagcctttgagttccctgagaagccggtgggaagaggatgggattcatagggacaagaccgctgtggcttgcacaagagaagtcacaaataacacaaagtacagagcgggcaaatgatgtaaagcaggaaagggggagaacctggccaggccgattgcccagagcgagccggcacgtttggcctgggagccaagtgtgtgcgttgtgtgggtgggtggggagcactcagtgaatgatgcatgcacaaccgtcagggtgtgccaagggggtgcacctggggaatcagggttgaaaacacactgatttcatagtcctagaaaggggctttcttgggtgaggaacaggagagacagggggatcaagaaaggagactgtgctcctggccagcctaaaacacacgggttgggctgctgtgtgtctcagctgaatccccctaagatgggaagaggcggggaagagagatggaagaggaaagcaacagaaatgggaagcagataaagattctctctctcccctcccttcttcctgcttccaatttcttgtcctcttttgctgtctctgtgggtcttcctaattggaccagtccaggctggcaacaggcccaagttccaatgctcagggtcctaccccagcctcaggtctgtcctctggcataggtggtggctgtgacacttcttggggcctgagcccagattcccttcccagaccagcaaagctgttttctttcttttttttttatttttttatttttaaaatagatcagttttattctgctagttccataaaaacaatgtaaacacaagcgttctgtacatcttcttggtgaattcacataatgctttgttccctgatcctttaacctcctcgtcttcttccagtcattttctgtttggaccactggccacaggagtggagtggggttggggcttaggagagagcaatgtggctttttcgtatgacttgttttattgcttgccctctcagcacactcctgttactcctaacacaaagtctgagatttaagcccttaaacctgtaggtttcaccatcagctttttctttttcttttctctttttttttttttttttttttgcataggcattactagggatgtgaatgggagactggtatagaaagtggtgaggagccgaagccaagaaattgctttaaacacaagatgaaaacgctctgttctgtacacaaagaatcacctaatactggtgtgaggcatctcacttagctgtggagaagtccttggaattagatctcagaaagacagttccagctttaagacagtaaaacctttaggcaatgggctaattgccttaaaggaaagaagagttctacttgaaagagcttgcaggtgagaaattgtcctacaaagattcttagaaatgttagcggagataactgacatgggtagctgtgggccaaccaagaactgtcaacagcccgatctcatagcaaagctgttttcaagaaaaattcccttctgagggccacagcctgagccctgctcctggtcacagcccaacactgcagtccaccccactgcctgggacacaactcaagaatattatctcttaggaagacacctgttttgttctacctgcaaatcctaccgctgagcacggggcaaggactggcccaattcctagggcctgtttaggaatccagccacgtgattgcttctgggaacaggcctggctgggccagtgagtgctcagcagttttggtgcaactcaatcatctggtcatgggtctcttgtgggaagacaggccccttcctttccctccctgtcctaagaattgggggccctcctcgagaccctctaggatcctgagtgccactagggcaggtggagaggaggtgaaagctctgcccctctttgtccagggccacgtatcctaatggatgagcaaatactactcagctagaccttgtgccttctgggcttggccaggcccaaaggctccaaccacaggtaggaatgaatacgtgttggaggccaaggaccagggtgctgggacactctgccaactgcccactgaaatcccagccctctcaggaaaactctagtttctgtccaaatgtttggccaatgcacagaatggtccccagcctctggccttccttcctacctctttttaaatgtaattaatttaacttatttaattacattaaaataaaatgtcttcctttcatttcctctccctcattcctctctgttcttttttgaattgttccagttcaactaccaatttgaggttgaattcattttcacagtgtccccatcaggtggttgtaaaactctggcttatacttatccagagatggggagctcacattccactccccgcttccagggaatcagttgtttagcagtttaaaatgtgtctctgcctgggttccacccctcaggcctgactgccactggcaagttctctgggagaacctaccaggtgtggaggtgtaatcttcacctctgaccctctctccctggctccaaggctttccattcaatgcaacttttttgagcctttcctgtatgcttcatgtgctgtgctagcttcaatctctccagtgtgtcttgctgtaaaacttatttggatactacatgggaatggagtctaacggcttgaggagtgtgtgtgtgtgtgtgtgtgtgtgtgtgtgtgtgtgtgtgtgtgtgtgtcttgagagacctggaaaatggtcggagaatgcaatatgacagcagtagcctcagaactcagagcaatttatcaggagcagtaattctctgagttacagaaaccagatggccaggatgtggccttgaatcagatcagaaacctgtctaaagaaaggttatttgaaaggagtgcctcctccccctaaatgtttcctaaagatcagctgaaatgagaaccatcttgaagatcattaaagtccattaatataaaagaacaaaggaaggcagggcttctttgagaaagaagcagctggggtagggtcctctggtcccagatcttgtgtctggaatgcagccctccacccatgacatcaaaataacaaccacaactaaagctaacatctccaaagattcgttgtcagtacatatatggcctgtgacttcctggtagacatctcagtttttcctccttgatctcagggaaatgcattttggtaggtagagggaaaggagtggcatcttgctatgactaccctgccccacatttgttaacagagccccagttatgagacattccatagggaaaaagggacctgctctctgcacaacaggaggtgtcgcctgcaaagaaaggaccatgactatgtaagcacagagcaagggaaactgggggatctcctttctctgcagaaatccaagcctgtattctgcagaaagccaagccctagtaccaggacataagaaaggccccttgttgaggctataaattgccaagtctgacctaacaaatacctttaccttatacatttccaacataaaggtatagataagagaaatcctgctgggcagttcggaggaagcaagtggagccatttcagttgtaatgtgtcaattcattgattacatttgaaatgtagccacccacacctatctgttcaatgataagattttgccttaggactcaatagagaataacattatattgaaaatgaaagatctgctgtgactggcatatagaagagattaaattttaaaatgttttgcaatattcgcattttgttcaaaatatgaccagtgttcctaatgagacttgatatggattttttaaaaagccatccaaaggccccatgatgggcacaaaaacaaaaccaacttgttgggttaaattagttggaaagactttgtatcattccattgttgaataagtaatttatgggatttaaagacaggacgattttgaaaattgtgctaattgtgtgtgctttgtttgaacatgtgaatgtaagtttaataattaagtttaagtccacatagaacaaggagagaaaaagtgtttgtatttttatcaactgtttactgcttacatgtattcccttgtgtattaggagttaatttggttttggcaaattaaatgcattttctcccagcaacattctcaaactgtttcttaaattgaatctaaaagccattcaaggcatccagccatttgagagaaaaatttctatgattatataaattaccgaggaacttcgtaagaattgatcattgtcgaaatggggagagaataggaatggagaattaattatcaaatgcgtcttaataatagaggcttgtcacacatctagactaagaatgctaatagtcaccacctaatattagtataaatactaataataccaatagtggctaacatttattgaactcttactatatttcaggcacatactatggatcttacaagcattattttgtcattccttatagtgatcctgtgaggtaatattattattctaatttacaggcaaagaaaccaaagagcacagagggttagtagtttgttgaagatcacacagctggcaatttgcagggttgaagtttgtccttttgttatctgactccaatgccagagatcttagtcaccaagccaaacctcctcctgaagcctctacaaaccagtgaagtatagaataacatattttctatatggttaaatttgcggctaattacagagtttgtctagaaaaaggatttctcttgctgtttctcttatttctcaaaatagcatttttttttttcctgattataaaagtagtgcaggccaggcgcagtggctcatgcctataatcccagcactttggcaggccaaggtgggcaggtcacttgtgatcaggagtttgagaccagcttggccaacatggtggtctcaaactactatttcatgtctctactaaaaatacgaagaaattaggcaggtgttgtggtgtgcgcctgtaatcccagctactctggaggttgaggcaggagaattgcttgaacccgggagttggaggttgcagtaagcggagatcaggtcactgcattccaacctgggcaacagaacaagactctgtctcaaaaaacaaaaaaaagaaaaaagaaaaagaaaaaaagaaaagaaagaaagaaagaaaagaaacaaatataaaaataaaagtaatgcatgcttcaactagaattgtctttggttgccattgggaatgtaaatgggcatagccactttggagaaatatttggcaatctagaaacattaaagatacacatacgtctgactcagtaatctcactcttgggtatatactcaatagaaatgaatgtttacatccatcaaaagacagaagagtcctttggtggatgcaagtgcaacgatgttcatagcagttttatttgtaatagccccaaattggaaacaacctaaatatccaacagtagaatggaggaagtaacctgtagtatattcataccctggaataccacagagcaatgaagaacaaactgcagctacacacaacatggatgtcatcacagtgagtgaaagaagaaagacacaaaagattatggaatgagtgatttaatttaaaggaagttcacatacaggcaagactaatttttggtggaaaaagttggaaggtactaaccgggattaggagaaggctcaagggagacttctgagattctagaaatgttctataccttgatctggatggtggctacatgggtgtatgcatatgtagaaatccatgggctacacacttgagttgtatactttattgaatttgttatacctcaatttgtgtgtgtgtgtgtgtgagtatgtgtgtgatggagtttcactcttgtcgcccaggctggagtgcaatggcgtgacttcggctcactgcaacctccagctccctggttcaagtgattctcctgcctcagcctcctgagtagctgggattacaggcacctgccaccacacccagctaatttttgtatgtttagtagagatgggctttcgccatgttagccaggctggtctcaaactcctgacctcaggtgatctgcctgcctcggcctaccaaagtgctgagattacaggcatgagccacggtgcccagcccttattatacctcaatttttaaaaatggaaaaataacccttggaaatcaggcaccaaagtaatacgtgctccttattgaatagcactgtccgatactagccactagccacatgtggttatttacattttaattttaattaaggtgaaataaattttaaaacttgttcctcaatcccactagccacattttaagtactaggcacattgctaacagcaattgtttatttggacagcagagctatagaaaatttccatcctaatggaaagttctattgctagtgttgttataggaaattgaaaaatatagaagtgtattaaaaaaacaatttattatttataattccctcatccaaaaaataatgtattaacattttatgttaacttctaatttctttctaaaataaattttattaaattacaagagtaacatatgaatgcattcttgtcctaagataattaaatattgataaactgaaactctctttgaccattgcctgcaatcctagagctctccccagtggtaaccactcttactagcgtactatgtacctttttattttttttgagatggaatttcgctctctcgcccaggctggagtgcaatggcgctatcttggcccactgcaatctctgcctcctgggttcaagcaatcctcctgcctcagcctcctgagtagctgggattacaggcatgtgccaccaagcccagctaatttttttgtatttttagtagagacggattttctccatgttgatcagctggtctcgaactcccaacctcagatgatgcgctcgcctcggcctcccaaagtgctggggttacagatgtgagccaccacgccctgcctggtaccatgtatcttttcagaccattttcgcaggtacttataaacatgatgtctgtgtatggaaatacacagcagagccattaacatcaccctgactcaaggagcttccacctggttcagttcagtctcccgaagtgcacaggaagggtgttatccccatcatccacatcccacccagtgtctagggctctcttcctattcatctcgagctgctgtggtcctgggatattgtgagaggggacgtcacatggggcaagtcagatggtcactaggtacagtcacactgcagaactggcaatgccactcctgttgggtgttcctagggcaaggtgtaactgtaaatccaggggagccatcactccacactgtctgtatgaagagctagcctgtggtgcagctctctagcctgaaggtggtgcttcctaaggtagagtctaggaggtctgcaggcatgactcagctccctctgggtcctctcgcagaggtcctttgctgctttcatgaatgccacactggagcatggaacccttttgtgaagctgccccagatccccttggtaccaacatcatcattttctctctggtataaggcacaggctccgtctgactcagaccaatgcacctctcagtgtttaccttttgagttcaattctgaattcacgaatttttaaactttcttcattttaatgtatgcatttacagctattaatgtcctcctaagtactgttttaacagtattccccaagttttaataggtagtgtttacattgccatttagttttaaatattttatttctgtgagatttgttccttgactcatgaattatttagacatgggctgttacattttcaaatgtatgtgtttttttttctgacacttttgtttttgataccacttgcattacctcgttgtcagaatacagactgggtgatgctgattatttggtaattattaaaacttgcttggaggaataggatgtagtcaattttttgcaaatgtttatataagtttgaaaagaatatttattcttgaattattgggttatgatttttatattttaattagatcaggcttgttaatattattgattacatattctctatttcctcacttaattttttgtttgcttgttttattaatttctgagagaggcatgttaaaaatctcttatgattttagacttgtcaattatttcttgtaattctgctcatattgcattgtatatttttgaggccatgtcataaggtgtatacctttttggttaaatttttgttgaagtctaacacacgttcaggaaagtactttcataaagagaaaatacctcttatgaccagtacccatatcaagaaaagaaaattaccagcactcctgcagcatcttcatgctccctcggagtcactcctccatccccactctcctgacttctaatatcatagattagttttgcctgtattgaaacctcatatattccaggagtcttcaaaatgtacacgaaaaatgcatattatgaaaaaactaaccatgatttcaaaatgttttcactaacttgtactaacttgttataacatgtctgaacaggatctagtttgaggctctaagaaggataagatatgagtttgaaaagaacctccattacagcaacatgagttctgctaaaatcaaagcaagaatgaaaatcaaatttatggtgaagcttgggtggaagaattatgaaatcattgataccttaggaaaagcttatggagacaatgccccaaagaaatcagcagtttacaaatggataacttttcttaagaaggaataagaatatattgaggatgaagcccacagcagcagaccatccatgtcaatttttgaagaaaaaaatcttttttttttttttttttttttttttgagacatggtctcactcctgttgtccaggctggagtgcaatgatgtgatctcagctcactgctcccttgacttcccaagctcaggtgatcctcccatctcagcctccaagcaagtagctgggactgcaggtgcgtgccaccacgcctggcgaattttttgtatttttagtagaggtaggatttcaccatgttgcccaggctggtctcaacttcctgggctcaagcgatccatctgcatcagcctcccaatatgctaggattacaggcatgagtcactgtgctggccaaaaattaatcttgtttgttccctaattgaagaggactgacaatagcacaaaaaatatccaatgccgtagacatgtcagttggttcagcttatacacttcttactgaaaaattaaagttgagcaaactttccactcactgggtgctgaaaccattgctcctagatcagctacagacaaaagcagagctttcaatggaaattttaaacaagtgggattaagatccctgttgcattcttcaaagaattgcaacaggagatgaaacatggctttaccagtaccatcctgaagacaaagcacaatcaaagcaatggctaccaagatgtggaagtggtccagacaatgacaacagatgtttgggatgctcaaggcattttgcttgttgactttctggagggccaaagaataataacatctgcttattatgagagtgttttgagaaagttggtcaaagctttggcagaaaaatgcccaggaaagcctcaccagagagtccttctccaccacaatgctcctgctcattcccctcatcaaagtgggcaatttgcaagagtttcaatgggaaatcattagccatccaccttacagttctgatttggctccttttgacttctttttgtttcctaaccttaagaaaaatattttaaaacacccatttttctttagttaacaatatttaaaagatggcatcgacatggttaaattcccaggaccctctgttctttagaggtggactaaatagctggtatcatcagttacaaaagtgtctagaacttcgtggtgcttatgttgagacatagagtttatatttcttatttttatcttttaattccatttttccacaaatggtttgaagtcttgtcatatgctcagctttggtagatactgccaaacagtttttcaacatgtaccaatttacacttgcaccagccgtgagagtcctcatcaaactcagtattatctgtttttggttttagacattctgttgggtgtgtagtggtattgcattgtgtttttaattggcattaccctgacaattaattaagttgaatactgttgtttcctgtccatttgaaaatcctcttatgtaaactgtctttctctctttttcattgggttgtctttttcttattgatttgtagaaattcttcatatattctgggtatgagctttctgtacagaatgtcttccctctctcttcagcttctcttttcacactttttgtagtgtctttttatgaagagctgtttttagttataatgtgctccaatttatcaattttttctttatggttagaactctttaggaccatatttaagaaatctttgcccaccctaagatgatgaaaatattctcctatgatttcttgtgaaaaacattatgattttaccttttttatttccatctacaatgcatgtggaagttacttttgtataaggagtgaggtggggccaagattcatttttttcccatgtgaatatccagttgacctaacaccttttattgaaaagattatcttttcccccactgtaagtaaggccttagcacctttgtcatcagtgaggtgaccatatatgtatgcattgtttttccccttgcagtccggactcggcttctgtcatcacatctctttgtctgactctctttgctgtgtctctcttccacttttaaggatcctagtgatcacattgagtccacccagataagccaggataatttccccattttaaagccagctgaatcacaactttaattctgtctgaagcctgaattctcttttgccatgtaacctaacatattctcaggtttgggggatttttttaccattgatttttgagagttctttatgtattctagatactagagagttctttatatattcttcttttctttttttttcactcttgttgcccaggctggagtgcaatggcatgatctcagctcactgcaacctccacctcccaggttcaaggaattctgcctcagcctcccgagtagctgggattacaggtgcacgccaccacgcctgcctaattttgtatttttagtagagttggggtttcaccatattggtcgggctgatctcaaacttctgacctcaggtgatctgcccgcttcagcccctacagagtgctggattacaggcatgagtcactgtgcctggccaagagttctttatacattctagatactagtcctttgctggatatgtgatttgcaaatgttttcttctattctgtagcctgtattttcatcctcatcagggtctttcacagaggaagacttttaaaaactttttgatgaggtcaaatttatcaagttttccttttatggatcatacatttgatgtcgtctaagaactctttgcctagtcctagatcctgaagattttcccctatgtttttgtctgaaaacatagttatatgttttatagttgcacatatatagttttatagttgcaagttatactttttcagttaatttttgtataaggtgtgaggtttagatgaacccattgtctgtagatgtccaatgtttccagcaccatttgttaagactatccttcctttgttgaattgctattgcacctttgttaaaaaatcagttgggcatgcttgggtgggtctatttctgggttttctattcaattccattgatttttgtatctgtgcctccaccaataacacactgtgttgattattgtaaccacatagtaggacttaatatcaggtagagtcgttccgcctacttttttttttttttttttgtaagattgttttagttattctaggggctatgtctttccatataaattttagaataagcaaatctatgtttacaaaagaaagacaaagacattgcattaaacccataaacatttttacaatgttgaaccttttaatctgtgagcacatgatattgtctctctacttctttaggttgtctttgacttttttaatcagcattttgtaatttttagcttgcagatcctgtatgaattttattatgtttggccgggcgcggtgactcacacctgtaatcccagcactttgggaggccgaggcgggcggatcacgaggtcaggagatcgagaccatcctggctaacatggtgaaaccccatctctactaaaaatacaaaaaaaaaaaaaatagccgggcgtggtggcgggtgcctttagtcgtagctactcaggaggctgaggcaggagaatggcatgaacccgggaggcagagctcgcagtgagccgagattgcaacactgcactccagcctgggagacagagcgacactctgtctcaaaaaaaaaaaaaattgttatgtcccaatttctttgggggtgttcattattagtatataaaaagtgatgatttttgtgttgatcttttttttttttttttttttttttttttttgaaacggagtctcgctctttcgcccaggctggactgcagtggcgctgtcttggctcactgcaagctccgcctcccgggttcaggccattctcctgcctcagcctccctagtagctgggactacaggcgcgcgctaccacacccggctaatttttttttttgtatttttagtagagacggggtttcaccgtgttagccaggatggtctcgaccgcctgacctcgtgatccacccgcctcggcctcccaaagtgctgggattacaggcgtgagccactgcgcctggccttgtgttgatcttatatctgcaaccttgctgaactaactattggttttaagaatttttagtattttccttgggattctctaggtgaattattttattttattttattttattttattttattttattttattttattttatttgttttattttattagacacagggtctcactacgttgagaccaggctggtctcgaactcctgggctcaagttatcctcccacttttgcctcccaaagtgctgggattacaagtgagaggcaccacaccaagcaagatgttttaaatgttatttttataaccaatccttatttttatttattcacatgatcatgtcttcattatcactcctaatgttgttttttatgtctcctctctttttttctgttaagattcccaagctgtggtcttttcacaaaacacctagcttttatttttattaatcaactctacatctttttctgtctagttcattaaatttttttttttttttttgagactagtcttgcttggtcacccaggcaggagtgcagtggcgcaatcatagctcactgcaacctccaccttccaggttcaagcgattctcctgcctcattcggcctcccaagtacctaggattacaggtgtgcacctctacatccagctaatttttgtatttttagtagagttggggtttcaccctgttggccaggctggtcttgaactcctgacctcaattgatccaatcgcctcagcctcccaaagtgctgagattatgggtgtgagccactgcatccatcctagttcattaatctctgatttttatctttaccagtatttttatttctactttctttggatttatttatttttcttttttctagctttttgagttgagaccttagttaattttttaaacatttattgcttttgggtgaatccattggttatagatcccctgcatattgttttggatgaatactgcaagttttactatgtaatgttttaagtgttcttgtaaaagtttgcatctcagtatgatgatgaaaaagttctagagatggatggatggatgattaactacaatatgaatgaatgtaatgccactgaactgtacacttaaaagtggtgaaaatgttatgttacgtatattttaccacaatgaaaagtttgtaattcttgtttgagttatttctttaacccaataatatttatatacatatttaaaacttttcaggatcattttgtggttgctgttgctgttgctcttgttttatttgactattcttttttttgttttgttttgtttttgttgttgttgtttttgacggagtctcgctctgttgctcaggctggagtgcagtggtgtgattttggctcactgcaacctccgcctcctgggttcaagcaattctcctgcctcagcctcctaagtagctgggagtacaggagcgtgccaccttgcccaactaatttttgtatttctagtagagtcggggtttcactctgttggccaggctgatctcgaactcctgacctcatgatccacccgcctcggcctcccaaagtgctgggattacaggcgtgagccactgcacctggcctattcttttttcagccctaattttattacatgtgacttgtgaaggtgtcatgtatgacttctgttttttgagttttattgatttcttttgtgagctagtacatgtttaatttttttttgaaaattttgtgtgtgcttgaagagaatatgtattttcttattgggtaagatattttagattacttttaagatcaagttccttaatttttatcaaaccattcatatccttacttattttctatctgacctgtggacttctgagaggtgtattagaaatctcctaatttgatttgagatttgttttctctttatatttctgtcaaagctatattagtagatgcatgaatgtttgtgcctattatatcttcttggtgaactatcctatgttttaatatgagtagcctccttgttcttgttctttttattgtgttttgccttgactttctcttttttctttttttttttgagacaggatctcactctgtcacccaggctggagtatagtggcataatctcagctcactacaacctctgcctcccaggctcatttgatcctcctgcctcaacctctcaagtagttagaagtacagacatgcaccaccatgcctggctaaattttgttgcggtttttgtagagatgaggtttcaccatgttgtccaggctggtcttgaactcccagactcaagtgatcctcccgcctcagtctcccaaagtgctgggattacaggcctaagccaccacacccggtcctgaatttatttttctaatattaatattctcactcccactttctttttaaaaatatattcctaatatatctttttctagtgttagaattcatttttaattaataattctctaaggtttataatgagaaaacagtcccatactttatctctgattccagttcctagtgctttcccttccactttgaactttttcagttttttctgctgtttcctaccatattaaaaaataacatgctttcctgttattttttcaattttatgtatcacctattgacttcctatggaggttgaataaattcgttctttcacaaagacacaaacacactcaactttcctttcatccttccaatatgattaaattgcaacttttgctgaaatgattgttccaatgtttacattataataattatgcaaacacagttcacagctgatccatgtactgaattctgtttttatttcttttctcatacaacctttcttctcccgcggttgataattaccttgttttttgtttttttgtttttttatttgttattttcttagtttctattacgatatcctaaaatttattgcagaagtataaatttcccctcaatatgttttaaaaattagatatttgatcagtttctttttctttcttggagacactcccagagctccccatccttctgctcccatcctggctgctgaaggcctgatgcacagctgtcatcctgggacttccgtgcaccatcatccctgtttccggatcctctgtcttcctcttcttggtttattctctctttttgatggagcacattctctagagaagcaagagaggatcttgatcttgtgaggcctaaaattatgcaattatacagaatcacaaatggaaaattagacatcaaagaaatgtgggaaaagaaatcacaacaaactgcagtttttgaaaatggtgacaattaccacaaaccacaaaatccaggaaagtagtcgaacattaaactacatgacattgctttataatgattttctcctgaacttttagttgtatctctgaagacctttgtatcagttgaccttcaatcaaaagcagaagcagatcctgctagaaggatatgtttctctctctctctctctctctctctctctctctccctctctttaaatggatttgctgtagggcttcaacattacacaattgtggaagctgactaagcatgctttgtaaggctgttaccttgcatctgatgctggagtttgaagtctgcagggcaggcagggtggaaaggaagagggaaataaaactccagggagagcaagaacaagctagagtccaagaacatgaggtggaacctataaggacagagcagaactgtctccaaccttgatgatgtgggtgtcttgtgggagaagctggtgccctgcctcgcagagcttaacacacacctgggccaggagtcagagcaactgaaagaggatcaggagaagttggaggaggtacaagcccagctgctgccccatgcccaagaggtcagccagcaggtaagcaaccaaatggctgctgcctgtcttccaccctctaaatcaccttcaaaaatgtctctgtggctgggcgcggtggctcacgcttgtaatcccagcaccttgggaggccgaggagggcggattgcttgaggtcaggagtttgagaccagcctggccaacatggcaaaaccccgtctctgctaaaaatacgaaaatcagccaggcatggtgatgcacacctgtagtcccagctactcaggaggctgaggcacgagaattgctcgaacctgggaggcggaggttgcagtgagccaagatcaagccctgcactcgagcctgagccacaagatgggactccatccccaaaaaaaaaaaaaaaaaaaaaaaaaagaaatatcgtgtggccaccctacttggaaacattccagaaaggcaattctgaaaaaaacagttcagcctagccaagttaacatagtacaaagccactgtgcttcttcttaatggtaatggtttgtaataatttccagaaagaaaaataaaaagacaattcagtattttcttcagtatgtttgatcaaaatttgttttttattattggtgatcttgaagttataatactattgcagttttgtgtcccacagacatagggattctgataaattcgatttcatgtgattctcactcaaaaataaaaaaaaaaagtgccctgacaattaatagttttgctggacgtagaattctaggtttgaaactattttcccttagaatgttgaaggtgttggtctattttgcaatgttgaatacattattgacaggagagactgctggctttgactaaacgttaatgagaactgagtactctcctcgcaaatttctatatctaatgggaagggttttccctagccaagctttttggctctgtacatctcaaaatttgttttttctctactacccagctgcttcattgccaaatgccttagaacaagttcatttttgttttgttttgtttttgagacaaggtcttgctctgttgtcctggctggagtacagtgacatgaacacagctgactacagcctcgacctcccagtctcaagcaatcctcctgcctcagccttccaagtagctaggactacaggtgcacgccaccacacctacctaatttttgtattttttgtagagatgaggtcttactatgttgttcaagctggtttcttaacgcctggcctcaagtgatcctcccaccttggcctcccaaagtgctgggattatagatgtgagccaccatgccagcccaagttcatattgtgatacatttgaccctgacctttcatgtcacaatgcctgtgagtcagcccagtggacagcaagagtattcctaaatggtcatttttacaataggacaactaccacatggaagagaactgaggcgccccagtcaagacaattactgacccccagacatgcacgggggacatcctggagtctccagctctggctgagctgtcagctgacagcaaccacatgagtgctcccaacaagatcagcagaagaaccacacagataccagcctacaggactatgaaaaatgatcaatcatcttcatcttaaaccattaagttttagagtggtttgtcatgtagcaatagataactgaacacttgtaaatcatctaactggattttcaaaaacccaatttgaatgtctttcctttaatttataacaacttattcataatttcttatacttaatgatatgtttgggttgattcctgacactttgagttttctatcggccatgcttttttgcctcccacccccatttgtgccctttgttagataggtcaggttttatttatggtatttttcttcttacagtcaggaagttataaatcctatttccattcttcgggcttttctattcaagaaacaaaggaatatatctgtttcttcatctttctttggcgattgggtgtgcttcgggtttaattaggttgaattttacccatcagaaggaagctactgttcgtggcctagaaaacgataaagtatagagtaaggcaatcaaaatcaccacaggaaaggagccctgtgggtctgtctgtgtgtggatgtgtgagcggatggttattagaaaatggttgaggaatgcagctcatcagctgaggctcggtgctcatcagccacccatctgacactcatcaaaagcatcggttgctggagattgaccaggtgtccgcagcggcctgtttcttaccgtctgctttggcttggccaaggtttaggcagcttctctctttcctccaggcttctgaggtctgctttcctccaagcctgagcaagcataacagaaagtggattgtgaccccttatcagctcctcctgggaatcggctgaccctgtctttcctaggcacactcccgccagaccccaccccttgtgtggccagcttcccttccaaacgtttgcttacctctgcttgtcctctctttaccctgtgaaagaaaaagttatttctgtttgattttgagacactcacagatttctgagatgggagagttctccatattgcaatcgtctttctaattaaagcctctccctccctctctaattctggatttgtttttatttgacaaaatatagtcaccattttctggggatgaaaacttagtcaatatcagaaacctgactgcagtcaggaatagagctcattcacctttcttccctagaacttagactgtgcttgaggcatagtgggtacttctttatgtgttttatgaatgaatgaatgaatgaacgaacagatgctgaactcaggagacagagaaggaagctgggagagctggtgtctggcctctgcttgctccaggagctatgttctccctgttcacagctatagctgccagggattctggaaacacatcctgctgccatggaaatgaatgcagtcacagagtgggaacagttaagttacttttctgagagagttacatcatttagaagcagatctctaaaagtccttgctcctgcaggagttggtgactgagtggcagtaattgtgttcacatggttaactatgacagtgtcacatgaagctcaaataatgggttggaaacgcacaaatgattgctagttgcttgagctctctgctagcccttgccttgctctctccatatttactttctccagcttgcaactggatatacagacgtgtctctgcagcagcctggcccaccctattgactgaggcaggaagttgatctgcgggttgcagctgctcttgaggaagctgagtctactaaaatctgttcaccctttccctgacactgctgctgaggccggtccccatccccggcagcttcgctgggccttgtttatcttttcatcactcttgactggctctggcctatttctggatctcatgtctgtcctctgacaaaccctgcctctctgccagctttctggaatctgtcaatctgagaggcatgggaaaacgacattgcccaacagaaccagcatctcaatgtggcaaaaatagactcatccaaagcaatctgggcatacactaatgtccccagcactgaacatccccaatcactggtttcccccatctgattaattttttccccatagagaggttttgcaaacatttatgcatctttaagcattttagtgatctgattttcttaattttgatggatttttctttttttctttacctaaaaatatcatttgaatccattttcagctgattattcctttttttctgtttgtaatagcaacgagctagaaacaaggtaattatccaacaataaaagacattttccctccactttgtgtgctctttgatgctcatgctgcaggccgagggtcacttatatcctcccactggccttattgctggctaacccgtgacccggtagcctagccctctgtctttcctgggaatctcttccaaccagctgacctctgcctggtccttcttagtttgacagagcacctgtttgttcctagggtgccgaatggagcactgtccttctcctggataactgatgacaaagatgcatccaacctgcacacgcaacatgctccctcttccatgaatgccggttgcacccgatgatctgcgcctgctcactctacctgcctccctgcccagggcagagaactgaggatgttatgttagtgaaatcctcagatcactcacagcgcagaacactccccaacttctctccatcatgtgtcaggcccagaagcagttacaatcattacaacatcacctcccacctttccatctacacggttgaacagctgtgcattagtctagaaaagtcaccctgaaaactggctctagtttggggaggtgacatgctcttgctttgtccccagagatgttcttctgttgtccttgcagtgcagggagtacctcctgggctgtgtgcagcagccctgcctgaggtaggggagtgctgttcactaatatagatctgaatctcaccagtctaggaggggacaggtacttctaagtcaatcaatcaatcaatcaatcatcagtcaatcaatctttcaagttttctcatcttccaaaaagacactaatgcccagttgaaagtggtagccactcaattcacctgggcttatcacacaaacaaactctcgttatcatattttttccttgatgctgtatgaaactgagtgaagtcacatttcctgattcagaagttgcaactgaaatggcccaagtgggaacaaaaggggaaattttgataacagatgggttgaccctttatggtatagagctgattctgagaactactccaacaagcatgcattctaaactctatcaagcaatgtgtggaatcacggcaacaaaaacatgttctccctagctcttaagtattttttatttggaaaatggagtttcaagttgttttcctgacttctatgaagattgtgatgaaattgcagaatatataaaacaaaagattgttgatattgtgttcaaatgcaaactagactgctcatctatctgcatatttggcaaatggtgcaaatgtaaatattggaaaattccattcagtctataaacttaccaaaggaaattttaaaaatttcctgctaaacgtcctgacccctctgtaccttttacataacactgctaaaaagaggtatgatttgcctactgtgacattgacagtttcataatgacatttttggttagttttcagtttcctcaaagcatgcagaggcgctttatgagatttttgatttttatgggcgtggtaggagatagccttcttagacatgcctacaagatgtcttgcagaaaagatgttagcatgttggcctactataaaatcatattttcaaagtgtaggatgagaagaatgtccttcactactttggaaatacattgaggatgagaacagagaaaaggattactgtaaaatggaaatttatatgccgtttctccaagactgtttcataatctttaaaaaagctacagaaaaggatgaactaagtgcatctaactcgttccatttaggtgtaggttgtgacaaaaactcatctagtgaacaaatgactcatttcttggaaataagactgctttgaaacttaaaaaattatcactaggaaaggacagccaagttaaacaggattttctcaatttctttactaaaactgtaacttatttggaatccagcttcaatttcacaagttcaaagtacctccctgctttgaaaccattttttccagagaaaagaggcttaccttatgatgacatccaatgtgctttgaagtgttttagaatgacagacattttagacatcgatagcctgtgtgattaatttattgaagcaaaagaactgattgacgaacagctggcctaccaaaacaagcccatagatacaggggatggacatttatggagaggtggaaattaactcctacaagtctaaaaacctgctgttgctagtaaataaaagcctaggtactccatgccctcacacagtattgttgagaagctatttagcattgtgttatcacatcagactgacactagaaatcagtgtaatgtgggcttgagaagagcagagccgcaggccaaagtgaatgttatacttatctccattcagttttatcattgcataaaagaaaggatgggtgtcataaatgccacaggcaattcagagaactattattaagacaggaagctgaaagaataaaaggcatcttactgtagcatgggacagaaggaaactgacattaaggcatcttactttagcatgggacaggaggaaactgacatttttaaaaaatcaaatatatgaaatacctgtttcatcattcctattctattttcattttcctttttaattttttgccttccttttttttattcttttccaacttttaagtttaggggttcatgtgcaggatgttcaggtttgttacacaggtaaacgtttgtcatggtggtttgctgcactgatcatcccatcatctcagtattaagccagcccagcatctattagctattcttcctgatgttctcctttctcccacccctaccctctgacaggccccattgtgtgttgttcccccgatgtttccatgtgttcccatcattcagctcccacttataagtgagaacatgcagtgtttggttttctgctcctgtgttagtttgctgaggataaaggcttccaataccatccatgaccctgcaaaggacatgatctcattcctttttatggctgcatagtattccatggtctatatgtgccacattttctttatccagtctatcattgatgggtatttaggttgattccatgtctttgctatcgtgaatagttacgttttcctttttagaagtcttatgtttatatatcttaataatataaaataaatagcctataaaccttaaatattcaataaggacttttaaaaagttaaaaacaaattgccatatacaaggataaaaacagtgtaaaaatattgttttattttttcacacatatttaattggtcttactattaattgtcactacttgttattaactagtcctattgtctggtttaaataacatttatataacagaaaggtaaataaatcagaatatataatttcaaataagcacctatcttccatattttatggtaatattttaaaatcaatggcacatccgtgtataattatttattatatatggtattatggcttttgtattcgtctggcatggcatggcatggctgtgtcccgggttgtctttctaaaatattggtgatcctgtctgtcacttgcatcatgtttcttttttcttcatcatcttcttctttttttttttgagatggagtctctctctgagcccaggttggagtgcaatggggcaatcttggctcactgcaacctccgcctccgaggttcaagcaattctcctgcctcagcctcccaagtagctgggattacaaacatcccccactattcctggctaatttttgtatttttagtagagaaggggttttgtcatattggccaggctggtctcaaactcctgacctcaggtgatccacccacctcggcctcccaaagtgctgggattacaggtgtgagccaccacgcctggcccggcatcatgtatctatggttccatccacatggctgtcgtgcatatcagtagctcaatcctttagactgccgagtggtgttccattgtatggatacaatgagcccctggtggtggtggtggtggtggtgtttttatccattcactagctgatggatatttgggttgtttccagttcttggtgattataaacatgtgcataaaggttcttgtgtgcacatttttatttttcttgggtaactgcctaagtgcagaattcgtgggttatattatgaatgtatgttttactatgtgaggaactcccaattatcttcccaagtggctgaaccatttttgcattcccaccagcagtgtatgagctgctttgcatgctagttagcacttgataatttgtttcatttttaaaaattttcagctattctaatagatgtgtagtggtattttcttattttaaaattttatagcagtcattttgattggcattcacaactgcctcagagggaaccaagacaaaaagaaaacataaagaaagaaaattctgcctgtggagcggaagaatgggaacaggtgcggaaagggtcccaggaatgggtatgacattgagcatattctgggtaaaaaatcagctttggctgaggaaaagtgccccagggaggtggggggttatgtcaaccagactgccccctctcccagagctcagacccagggctctgagagtcctcaggtcttcgtgtctcaagaggaaaaaaggagttggggtggggggagggcagaaagagttctgccctttattatttattatttatttatttatttatttatttatttatttatttatttgagacagggtcttgctctgttgcccaggctggagtgcagagacatgatcatggctcactgcagcctgaaactccctggctcaatcgatcctcccacctcagcctcctaagtagctgggactacaggcatgtgccaccacgcccagcaaattttttattttttgtagagatgggcttttgccatgttgcctagaccaatcttgaactcctaggctcgagcaatcctcctgcctcagcctcccaaagtactgggattacaggtgtgagccaccacacctgacccagaaagcttatttttgatgggcagtgtccacgtcaccatactgtgagctccatgaaggcaacccatcgtcactcttgtcccctgctctgttcccacacctggcttactgcctgtctcatggttggagcccaggaggtacttatggagtggatggaataatgaatatttctagaccgctgaagctgctttagtgaacgtcacacagaacagtgactgcactctttctgccagtctagtgaaagccccctttgcttgccctaggcccagtttatgacccatcttgtcatttcttcaccacctctcacacctgttcactttactaccccttccctcaccactgcttcttctctgggctgttgacatagcctccttacaactctcacagcctcccccagtcctcttctgtcccccagtttctaatctgtcttatctttgccagatgttggattcataagccttgctcttatcctgacctgtcacatcaaagcccctgtactggctcttgatatccacaaaagaagagccaacaggaaactggccccagctcccttcctatatcccagctcccattggccctctggagggctcttgattttggtcaaagtctatctgcatgtttgttgttgttttttgtttgtttgtttgtttgttttttgagacggaatctcgccccgatgcccagctggattgcaatggcacgatcttggctcacagcaacctccacctcccaggttcaagcgattcttctgcctcagcctcctgtgtagctaggattacaggtgcaaccacaccctgctaactttttgtatctttagtagagacggggtttcaccatgttggctaggctggtcttgaactcccgacctcatgatccgcccatctcggcctcccaaagtgctgggattacaggcatgagccactgcgcccagctgccttcatgtttttaaaactgccctttcctgctgaaaccgaacctatcctgtctgcatggcctctcaaaagaacgaaagaaccagggcttcgggatcagagagatgtgggttcaaactctagtcacctatttcctaaccaaggggacattgaaaaattccttaacctgagtctcagtgctcttttctctagatgggcaataaaaagtacctacctttacttgggaggctgagacaggaggatcctttgggtccaggaagttgaggctgcagtgagctatgaagcaccactatgctccaacccgagtgacaaagggagacctcatctctaaaacaaaacaaaacaaaaaagtacctaccctgggtttgtgtaaggagatggtatgtataaagggggcctggcatatactaacaatgtaggaatttaaaacatagtagatatgatttttggtaattcctgcctaaagaaaaaaaggctaaaaataagggtataattaattaattgttttctaattctttcccagccgtaacactgaaggttgcttccctagggagggaattacctgggtagagattaagtgtgggtgctgctgcccccagcctaatgggtcacatgccctaaagagaagctggtcagtcacaatgctccctccagctcctctctaccttgggatagaggcctcatgggttaaaagaccaaccaaacaacaacaggacacaatagagaaaatagccagtgagggagaactttttcatcctttcccacagacatatgggatcatttcatgtgtgaacatcatgaaggaggaagacaaagacaaacagaaagtggtcctcctaactgggtgctccctgagggagaggcatgagcctgatgatgattggagattgctatggtttgtataatagtgtctcctctgaaattcatgttgaaacagaatgccccatgcaacagtattaagaagtgtggtcttgaggtcgtgattgagtcacgagggctccataatcataaacggatagggttagggggttagggctcttataaaaagacttgacaggccaggtgtggtggctcacgcctgtaatcccagcactttgggaggccggggcaggtggatcacctgaggtcaggagtttgagaccagcctggccaacatggtgaaaccgtctttactaaaaatacaaaaattagccgggcatggtggcaaatgcctgtaattccggctacttgggaggctgaggcaggagaatcacttgaacccaggaggcagaggttgcagtgagcagaaatcatgccactgaactccagcctgggcaacaagagtgaaacaccatctcaaaaaaaaaaaaaaaaaaaaagacttgacagatggagttcactcttttactgcccttccatcccttctgctacttgagaccatggcattccttccctctggaggatgcagcaacaaggtgccatcttggaagcagggaacagccctcagcagacataaccaaacctgctggtgccttgctcttggactttccagcctccagaactgcgagaaaattaatttctcttttttataaatgacccaatctcaggtattttgttatagcaacaaaaatgaactaagacagagttgctccaagaagaagacgcttaaaacctttccaaagcaaatgggtctccttggagtagaaagctccccaacatcaatgagattctagagggaacattatgatcacatatcagggaagagagtgaagcttcaaatgggctctgattagatgctctctaaagcccagcttcattctgggttctgcaactgaagaggctttagggttaaaagggcttccagttgcttgaaaagcaaaaataaaaagaagaagctcatatgtcaataaggtaagtcattaagaaagtaggtgcttttaataccaggtaatgtcagcataagaatatgtatacaaaggtgggttatttttagtattggttgaaggcacattattcttttgacaattagaataaagaaagcaattagaaactccaggaaaatgaaaagctgtgcagaaaaagctgtagcccaaatataaagcaaatgaaatgtggcatgtctttgagcagctgatggagcataagaaaattgaatacatttgaccttgatgctaaggaccccttctgagcagcctgggcatcatgacattggatcagaaaggaaagaaatgtaattcttggatattccttggctcagcggtgacagtgaactgtactcacacaggcatgagaatgtaatattggtttattgattttttcagagtcaatttatggacaaaatgcagctgttataataatgacttcagaatagtatctaaatgttatcatcatttaaaatgtaaaagtaagactattaaagacttgagagatagaggagagatagaagtcggtttcttattttacatagtgggaagtcattcgattgtatcttcactctatggagtaggatgtaggtctattacttagagctcaaaggtaaccagtggaagaaccaagaatattttaactcgcaaaaaccaggaggaatgaagagtgatgaaagggagccatgcgtatgaactaaaaccttgtttttcccagcagagtgaatgagtttcctaggactgccataacaaagtatcaaaaacagtgtgactcggccgggcgtggtggctcacacctgcaatcccagcattttgggaggccaaggcgggcaaatcatctgagatcaggagttcaagaccagcctggtcaatgtagtgaaaccctgtctccactaaaaatacaaaaattagccaggcttggtggcaggagcctgtaatcccaactactcaggaggctgaggcaggagaatcgcttgaacttgggaggtggaggttgcggtgagccacatcgcaccactgtattccagcctgggtgacagagcaagacttcattaaaaataaataaataaataaataaaaataaaaaacagtgtgactcaaacaacaaaaatttatcatctcacagttctggaggctgaggttgaaatcaaggtgtcagcagggttggtttctgcaggggaggatctgttccaggcctctctactaggatctgttgcttgctggcgatctctggtgcttgcagatgcacggctccaccagctgctttcatctccattttatgttctccctgtgtcttcaccttgtcttccttctgtatccaaatttctcctctttatgaggacaccaagaattctaaattttgaatttggccttccacgtagttattaagacacatttgtcatggattggagaacagaacatattaaatcttttgtagaatttataactttaaaatatttacacatatggccagatgtggtgtctcatgcctgtaatcccagcattttgggaggccaaggcagacggatcacctgagatcaggagttcaagtccagcctggccaacatggccaaaccccgtctctacaaaaatacaaaaattaaccaggcgtggtgatgggcacctgtaatgccagctacttgggaggctgaggcaagagaatcacttgaacccaggaggcggaggttgcaatgagccaagatcatgccactgcattccagcctgggcgacagacccaatctcaggtattttgttatagcaagacaagagtgagactctgtctcaaaaaaaaaaaaagaaaagaaaagaaaagaaaataggccaggcgaagtggctcacacctgcaatcccagcactttgggaggccgaggcgggtggatcacatgaggtcaggagtttgaggccagcctgaccaacatggagaaaccctgtctctactaaaaatacaaaaatagctgggcgtggtggtgcgtgcctgtaatcccagctgctcaggaggctgaggaaggagaatcacctgaacctgggaggcagaggttgcagtgagccgagatcgcaccattgcactccaacctgggcaagaagagtgaaactccatctcaaaaataaataaataaataaataaataaaatatttacacatatggtatatgggcctccaattattcttttgtcacaggccctgcaaatgttatgggcaggcctgacgtgtgtaaccacagccgaagaagaaccagaaaccatcagttgttgctctggagagtgcataagagaaggcgagggtgggagaaggaggatcgtagtgttttgttagaggcctctctgtcaatgtgatgctctgttttgccatttgcatgcttcacttcaataaaacttatgaaaattatccaagttctcacctcctcccttgagtcttcctgatccgcagctctcacctctcttctctcagcttctacaaccctcagcagctgtgccgccttctgtcctgcttggcctgctctcccagaggcccctgaagacaataccacctccccaggcccactggccacctgtcttcttgtctcccccgagaggttccctgggctgaggtcagcacagcctgcttgccctgcctcctcttggtcagcattctctgccagagcttctctcctccctccatctctagcctggtgctcccacctgtacctcctggtagcccctcagggttgggagaaggccaagctctgcccacagtctctgtctggtggctgggggtgggtggggaggtgttgcatggaacagcgctgcagcctcacctcttcgtgagaagcaggtgtctgccaagccagatgggtttctgctgtcagtgagaggctccaccttcctcctgactgtcccaggcctttgccaccactgttctctttatgtctcagtctccctccctcccccttccctcaccctcgctttctgctgggtccccccgtttctccttttctctctctctgcattaccctccaagccctttaccctcaattccatcttcccctggagcagagggattattgtgactcccccattccagaccccagatcctgcttcatcctcagggttaaactaaccctgccccacccactcaacctgcacccgcgtctaatccagacccttcatgctgacccctaacaaatggcccttggcccattcctagtgccccacagctaacagagggtcgtgatcctgaccctatagcactggttccaatctagaactttaaactgaacactcactgtcattcataacactccccagtcccacccctaccctttgggaagggctggggctgaaaactcgaggtctgtgatgtatcctgggggtgcggccaagttctgcattcctggaaactgggactggcttggggaaaaacaaaaataattcctatgaagtatgcttcaattggtgctactgctgaaaatagtccctgaggatgaacatgaaggtcaggagagagcagtgggaatggtgccaggagaggggaccagaaaagtggctggagatggccctgagtggaagggcagtgacagtcagcagggagggcttaggaggccctgggcagacggaggagggaggagagaggggggcaaaggctccagctggaaggtcaaggttattgttcattcattcctttgttcagcaactatttgttaagcacctactaagtggcaggccctttgctgggcactagggggatagcagtggacagaacgaagtacccacctgtgtggagctcacattcagattgcggagatagacaggaaacacactaacagagatgtcaggggaggggagggaagaaggacaagtaaggcaaggtgaggagacagcaagggacaaagactgtttatatagagtggcctgggaaggcctttctggggagctggcatttgaacaaacctcaaaagacaagaggaagggagccctgcaggtgtggacagactttgtccagttagaggaaatagtaggagcagcagccccaaggtgggagcagggcacacgtggggctgcacacagtgagcagggccagagcaaaggggggtgaggccagggaaagtggccaggttgcccaccaaggctcacctgggttcctaggtcagagatcctgagaagaggggagaagccctcatgcccaagtggtgggaaggggtggaggagaatggggaggaaatgggagtgaggccaccccaggtaaggtcagctgcaacctctgggctagggtgacgccagaagagaagatagggcctgcagtgcctctcccccatccacagccctgggtgcacatgccacgagctcctgctcactccacctcacatccccacacttgtgcatgaacaacacacacacatggagaatagtcacaggctcacctttcacatgcatgcacacagaaattgtgcatgaacacacgcatgcacacgggccccttgtgttagtgtagacatttttgagaattctaaacaggcagaatataggggccaaaggactttagaccaactctcacgtatgacagaggcactaaggcctagaaaaaggaagcctcataatttggtgacctaggcagatcactctatgtccccccatgcatgtgcatgttgtgtgtgtgtgcgcgcgcacacacacacacacacacatgcacgcacgcagtcccaccagctgtccaaagctccttccataaccctatcttctcaacagcctctctctcccaggacacccacaggcttaaccaagtcccaccaggagtgccccgagtttcctcccagctattccagcaggctgctggggggaatacagtgtcgggaccaagatagactctgcccctcttggtgggatggctacagcccacaaccacagctgaccacagcagcccccgactgcctctctcctctcagagcctgtttccgggttcagaccttcttcctccatctctctttctgggtctttctcccttgcttcctttctctacctccagaaaggaggctgtgattctctgtttttccctctctttcctggtgtctctctcatttctctgtttctctccagttttctgtctctgctgggcttgtccctctcgctccatcttctcatcaggatctttttttttgccttccaggaaaagctgacgtggtgcccctggtcagtgggagtgaggccttctggggtgggggagtcctggttgagcagccacagctggggtgcggctggcgccctggctaggggcagcaggagcaggagcagagcgagaggcagcggaatgggaggagagagggctggacctctgcaggcaggaaggggagcagggggaaagaaaaactgtgggagggagtgagcccccctcccctgctagggtgaccaactgtactggtttgctgagactgtctcgattttagcatggaaagtcccatgtcccagaaaacccatcagttccaggtgaaccaggactgttggctggtcaccctacaagctgccagggacccacaggagacagggccaggactcacaggaggggctcccaagcttggcctcctagttctggggacagtcagggccgcacatactcaccaagggtccccatctcaggcctgagcccaatttagaggaggccaggagaggggagatggcagcccagacagcccacaggaagctcccagcctgaaaagatcagggagcccgacttctgacttgtctccctgcctgctggcatgatctcctgtgaggtgggctttacagaaagaacttgagctctgacagcaagagaagagcagaggggcaacccaggaggtcatacgccccatcctcagaggcctgcacaactgctcctgggctctgctgaggagcaggcccacctgtcccactgtgagacaccttggagagtcaatagtccttggctgagatcctggcggccttattgtccttcctggtggaagcgggtatggccacaccttgcaggcagtggcaggacctgagcagaccaggaagatacatcagtgaccagcacgcacagtctcatttctgcccaggtgggctggtccctcccacttttcccgccctcagccccccacatctgttttgaggtgggagtctgagcttagtgtttggctgtcattaaggtcttaggtagggaatgaggggacagactccctgcccccagaaggctgctgacatactcacccacccaacagagcatgggtctcctacactgtatgaaatattctctaaaatgtcttgggcatgccccttccctagcctgggcccaaaggccctatctgtaagttgatgaggagatgaagtgggtgagctctaaaatgcttccttctgatgaccacccaacttgtccatcatgccatgaagggggcgcttacagagtgtcttccctgtgctggagatcaatagcacctgggaagttaaggcctctgccctcagtgggcttcctctctagtaaggggtcgcacattaagcacgcatgaataaataatcacagcttataggaggagctatgaagaaaagtcaggaatgtctgagagaacagtcactgggaactgagggctgaggaggtgcttgtactctgaccctgatgtgcttgcaaggagggaggtggggtgggaactatgagctcctcagagcaccctggaggtaaagctggtggcacagactttgtgcaggtgagggtgtgtgtatgggctgtgcagaacatagtgaagccccctccaccaggaagccctccctgactgacactgaggtcactgagtctcccctctggtttactgaaccctggatgtgtttcttgcagcctctggttggcccaccaaattcaggactttcctagaaattctccagcacagtcaggatgatgcaagagagggcttcctctgcaggggaaagagagggtgctctccattggaccataataatatcctcagcatcagactcgggtgttttgcaggcagcatgctggggacttctgtggccttgcttggtgacagggaatggggtgtgatgagctggggcaggcttcctggggatgctttcagccaaagatgagccctgtctgcccttggccctgctgagagggtaagttgagtcatgagcagaattcaaccagttatcagatggaaggccaaggaagcttggggagggctactgaggggatacggtaggcttgtctgtggagagcaaaattcttcagtctacaaagttcttttctgggctccttcatctttcggtttctcttccagctccctcgttttgggcctcttttgtttccccattcccctcccctgggccttcccgtttggaaaaggggtcacatatcctcaccctggaggcgtctgccccttccacacagttggtgttggaacagtggagctcagagaggccgatgctgaccgcgtagatgtccagcaccaacagtgggattttgggccctgtgggggacacagagagaactctccgggagtgcggccccttggcctcccctctgggtgcccagtgggcagtgggcctgggtggctcagaatcccagccaggagcactgaaggtcaacaggctcccgccctgagttttctgagccaggcctccctgtttcctccccagccagtggggagcgcagtgaggggcggggcctggagtcttgggagctccctggacaacaacatgcatttagcgcagctcagtctcagagccagcaggatatgttttcttaaaaaaaaaaaaaatgcctaacatcttggctttcaccgaagggttggtatctgctttgtacactttggccttcttggcttttcactgaaacacacacacatggatgcacactcacttccacacacaaacccacaccaagacagacacacacacacactcacacacaaactcatgtacatggtttcatacccacatccatgcaaacacacatacaaatccagaaatacgcaccctcacacccacaaacttgtacacacacacacacgtatacacaccaacacacatacaaccctggcttggacaaaagcttcccgttttttcttgtttgaagtggaaatctcccaccttccatgagattcaatttctcgcccttcccccgctaaaatcctcctggccccatcatttcttgggtcctttccagacagtgctgtgtctttaaggaagttgaagctgctaaaagtgagtgagagagagagaaaaaacacaacccaaaaaaatttggcatctcttcccccctcaagtttctggtgtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggccaaggcaaagcatacctatggggggctccggtgggagggactgcggccaggatgtgggagggcagggggaggttctgcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcccctccgtgtctgcctggaattttgtctggatctaggagcctctgctgggagataggatcaggagctgaagagtcagggcagccagcctgcctgcccacagtggcaggggcctctgagactccaacagactgtggaggcacaggagtgctggcccgatgctgtgtcaggggctgggccttgcggtgagctgagctgcagatgttcccttcctccaaaccatcccacaggacagctgggggcaggagcctggggtggctggcgaccctgagcagcgcctgatgtcagcagtggcttcaagagaggcattttggaaaggcgcaaggaaatggaagtgcctgggtggtagctcctcttccctgtcctgctcctggaagagatgttaggaatgaagaggaaagaggggacaggtggggcaagatggaggagacagatgaggagaaggggacacaggacagaggaggagaaagccccagagagactgggaataagagaacatatttacatatttgagggagaaaccaggggggaaacaaatcgtacttatctttctcccaaagaagaaatggtattccaagaggaaagtccaaatgaggactgcagattccctgtaggaatctttccccacagagcaagtggatcagtaactggcctgggccgtgtgtgtgtgtgtgtgtgtgtgtgtgtgtgtgtgtgtacagcaacctgagcggtgcgtgtgtgtgtgtgtacagcaaccttcagcctctccagtgcatgtgtgtgtgtgtgtgtacagcaaccttcagcctctccagatgaggagcataaggatgaggtcctaacctggagactctgcacaacctcctatctgtgccaggtaggatatatgtcttcctactgcctctatcccatccctttcaagatcgaggatgctgcatgcagagacaatggcctgggggagaggctctgtggcctttctccagagctcccagaactgctgagctcagcaaagtggaggcaggatgctaaggagtctggggtagcagctgtgagccttggctgctggccagccccattccctccctccaggtccacatacagcacctccccctgcccactctcccctcatcaacttgcagctcctgctgagctgatgtcaccagcagcatgtatcaagaatgactcctaatctaaaataaaagttgaaaaaaatgactcacgtctggtggaaaacagcaggatggagccaaattccatgcgctaggccaccttgggtaagtcattgcccacgtctgggcttcagttgcctcaaaaaccaaatgacatggtaggactaggtgctacttcatggtccaatagactctgattgcctaaggcttgatattcccagcctgacttggacatccctggctccattcctagctgagtggcttggcttcttggagtaggacatggacctaagacctaacacagggaatggctgtgccttgagtggactagctgctcccctgctttaaggtcttccgtggtccccactgccctccaggtaaagcctgaattccccacttagagcctctctgacctgctcctccaacaagcgcacccttccttcctcttcttggaacagctatttaattgttcccttaatgttccatggtgtgccatcctctgcacctttgcttatactgttccctccgcccaggcaccctttccctgttcttcatttggctaagtcagtctttgagagtgggctctggcatcaccacctccagaaagccttcctggatgttcccccatccccaatgtgaacaggccccctttctctgggaacctggattctcctcccctgagaccctgttagttgctgaaacaaggtcaggaagcctttttcaacgggctgcagtgggatcacagtgtgccctctttggcctcctcggggcagccttgaaagtgggtttcaggtccctgaccccacccctggctttacaggtatttgaggctgtagcaggaacctgagcttggggcaggggactgttgatctccactaactgtgcaggcatttctcaaggccctgctgacctagatctgtagggtggccacatcttcctaccctctgtagcccccagcccctcagtggacccagggcatgttctttattcatataccccgccctccacctccaccaagcccccagtagggaaaagaccccagtctgtctccaccctcctttcccctccgtattctcattctcctcccatcaggacagcctacgctatgtccccccatgtgacacgccccttcctacctccacacctggagtcacactgcttccccagcattcctgaagtcgcttctcctccccagatcctgccccttcttcaagacccagaataagtcccacttccaaagccagcattcacatggctcaggggtggcatcatagggtccccagtctctttgccacccaaaaggatgcagctatgggttctgccttccacccagtgtctggcccagcatgtgaccagaacaccccaagccccatccccatcaatgcacagtgttcctgacagtgtaggcggggttttccctgcatacccctcccgctatgaggacagtttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcagggg
